United States Patent 12,569,549 (FLAVIVIRUS VACCINE) - sequence listing, part 54

SEQ ID NO: 19239 - RNA, 9882 nt, synthetic construct
  misc_feature 1..9882: note = derived and/or modified CDS sequence (opt5) from DENV-1__JF937615__SS-prME
  source 1..9882: mol_type = other RNA
tccgtgaccatgctgctcatgctgatgcccacagcccttgctttccacctgacgacccggggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacagatcctgccgttctccgcaaactgtgcattgaagcgaagatctccaacaccacgacagacagcagatgtccgacccaaggagaggccacccttgtggaagaacaggatgctaattttgtgtgccggcgcacattcgtcgacagaggctggggcaacgggtgtggactgtttggcaaagggtctctcatgacctgcgccaagttcaagtgcgtgacaaaactggagggaaagattgttcagtacgaaaatcttaaatattccgtgatcgtcacggtgcacaccggcgaccagcatcaagttgggaacgagagcacagaacacggaaccacagctaccatcacgccccaggccccttctaccgagattcagctgacagattacggcgccctcaccctggactgtagcccccggacaggcctggattttaatgaaatggtgctcctgaccatgaaggagaaaagctggcttgtccataagcagtggttcctggacctccctctgccctggacgtccggggcttctacaagccaagagacctggaaccgcaaagatcttctggtgacatttaagaccgcgcacgccaagaaacaggaagtcgtggttctcggatcccaggagggcgctatgcacaccgccctgacaggggccacggaaatccaaaccagcggaacaaccacaattttcgctggccatctgaagtgcagactcaaaatggacaagctgacccttaaagggatgtcttatgtgatgtgtacggattccttcaagctggagaaggaagtcgccgagacacagcacggcaccgtgctcgttcagatcaaatacgagggaaccgacgcgccgtgcaagattccttttagcacacaggatgaaaaaggcgtgacccaaaatgggcggctgatcacagctaaccccatcgtcacggacaaggagaaacctgtgaatattgaagccgagccgcccttcggagagtcttatatcgtgattggcgccggggaaaaggctctgaaacttagctggtttaaaaagggatcctctatcggcaaaatgttcgaggccaccgctagaggggcccgccggatggcgattctcggcgatacagcctgggactttggaagcatcggcggggttttcacctccgtcggaaagctggtgcatcagatctttggcacagcttacggggtgctgttcagcggagtctcttggaccatgaaaattggcatcggggtgctcctgacgtggcttggcctgaactccagaagcacctctctctccatgacatgtattgccgttggactggtgaccctgtaccttggcgtcatggtgcaggctgacagcgggtgcgttatcaattggaagggacgcgaactcaagtgtggctccgggatttttgtgacaaacgaggtccacacctggacagaacagtataaattccaagccgattctcctaagcggctgagcgcggccatcggaaaggcttgggaggagggcgtgtgcgggattagatccgccacccgcctggaaaatatcatgtggaagcagatctctaacgagctcaaccatattctgcttgaaaatgacatgaaatttacggttgtggtcggcgatgtggctggaatcctggcccagggcaagaaaatgattcggccgcagcccatggagtacaagtatagctggaagtcctgggggaaagccaagatcattggagctgacgtgcaaaacacaaccttcatcatcgatggccctaatacccccgaatgtcctgacgatcagagagcgtggaacatttgggaggtcgaggactacgggtttggaatcttcacaaccaatatttggctcaaactgcgcgatagctatacgcaggtttgcgaccaccggctgatgtctgccgctatcaaggattccaaagccgtgcacgccgacatgggctactggattgaaagcgagaagaacgaaacatggaaacttgctagagcctctttcatcgaggtgaaaacctgtatctggcccaagtcccatacactctggagcaatggcgtcctggaatctgagatgattatcccgaaaatttatgggggacctatcagccagcacaactaccgccccggctactttacccaaacagcggggccttggcatctgggaaagctcgagctggatttcgacctttgcgaaggcaccacggtggttgtggacgagcactgcgggaatcggggaccctccctgagaaccacaaccgtcacaggcaaaattatccacgaatggtgttgccggagctgtaccctccctcccctgcgctttaagggcgaggatgggtgctggtatggaatggagatcagaccggtgaaggaaaaagaggaaaacctggttaagtctatggtgtccgctggcagcggggaggtcgactccttctctcttggactcctgtgtattagcatcatgattgaagaggtgatgcggtccagatggtctcgcaaaatgctgatgacgggcacactcgccgtctttttcctgcttatcatggggcagctgacctggaatgatctcattcggctgtgcatcatggtgggagccaacgctagcgacagaatgggcatgggcacaacctacctggcccttatggcgacctttaagatgcgccctatgttcgctgtcgggctgctctttagacggctgacatcccgcgaggtgctcctgcttacgattggactgtctctcgtggccagcgtcgaactgcccaattccctggaggaacttggcgatgggctggccatgggaatcatgatcctcaaactgctcattgacttccagagccatcaactgtgggctacccttctgtctctcacatttatcaagaccacattctccctgcactatgcctggaagaccatggctatggttctgagcattgtgtctctttttcccctgctccctgtgcatgatctgccgaaaaagacgacatggctccccgtcctgcttggctccctggggtgtaaacctctgaccatgttcctcatcgccgagaacaagatttggggaagaaaaagctggcccctgaatgaaggcatcatggcggtgggcatcgtttctattcttctgtccgccctcctgaagaacgacgtgcctctcgctgggcccctgatcgccggaggcatgcttattgcttgctacgtcatcagcgggtccagcgccgatctgtctctggagaaagccgctgaggtgagctgggaagaggaagcggagcactccggagcctctcataacattctcgttgaagtgcaggacgatggcaccatgaagatcaaggacgaggagcgggatgacacactgaccatccttctgaaagctacactcctggccgtcagcggggtgtatcctctctccattcccgccacgctgttcgtctggtacttttggcagaagaaaaagcagcgctctggagtgctttgggacaccccgagccctcccgaagttgagagagctgtgctggatgacggcatctatcggattatgcaacgcggcctgctcgggagatcccaggtcggagtgggcgttttccaggaaaatgtgtttcacacaatgtggcacgtcaccagaggggcggtgctgatgtaccagggaaaacgccttgagccttcttgggcgagcgtgaagaaggatctgatctcctacggcgggggatggagactccaaggcagctggaacacaggcgaggaagttcaggtcattgctgtggagcccgggaaaaatccgaagaacgtgcagaccgcccctggaacgttcaaaacctctgaaggcgaggtcggggccatcgctctggactttaagcccggaacatccggcagccctattgtgaatcgggaagggaaaatcgttggactctatggcaacggcgtggtcaccacatctgggacctacgtgtccgccatcgcgcaggctaaggccagccaagagggacccctgcccgagattgaagatgaggttttcagaaagcgcaatcttacaatcatggacctgcatcctggctccgggaaaacgcggagatatctgccggccattgtgcgcgaagctatcaagcggaaactcagaaccctgattcttgcccccacacgcgtcgtggcttctgagatggccgaagcgctgaagggaatgcctatccggtaccagaccaccgccgttaaaagcgagcacacaggcaaggagatcgtggatctcatgtgtcatgctacgtttaccatgagactgctgtcccccgtccgcgtgcctaactataatatgattatcatggacgaagcccacttcacagatcccagctctattgctgcccgggggtacatctccaccagagtgggcatgggagaggccgctgcgatttttatgacagccacccctccgggcagcgtcgaggctttcccccagtctaacgccgttatccaagacgaagaacgggatatccctgagcgcagctggaactccgggtatgagtggattacggactttcccggaaagacagtgtggttcgtgccttctatcaaaagcggcaacgacattgccaattgcctcagaaagaacgggaaacgggtcatccagctttcccgcaagaccttcgataccgaataccagaaaacaaagaataacgactgggattacgtggttaccacagacatttctgagatgggagctaactttagagccgatcgggtgatcgaccccagacgctgtctgaagccggtcattctgaaagatggccctgaacgggtgatcctcgcggggcccatgcccgttaccgtggctagcgccgcccagagacgcggccggatcggaagaaatcataacaaggagggcgaccaatatatttacatggggcagcctctgaataacgatgaggaccacgctcactggacggaagccaaaatgcttctggataatatcaacacacccgagggaattatccctgccctcttcgaaccggagcgcgaaaagtccgccgctattgacggcgagtatcggctgagaggggaggcccgcaaaacctttgtcgaactgatgagacggggagatctccccgtgtggcttagctacaaggtcgcttctgagggcttccagtattccgaccgcagatggtgctttgacggggaacggaataaccaggtgctggaggaaaatatggatgttgagatctggacaaaagagggcgaacgcaagaagctgagacctcggtggctcgacgccagaacctacagcgatcccctggcccttcgcgagttcaaagaatttgccgcgggacggagatccgtgtctggcgacctgatcctcgagattgggaagctgcctcaacatctgacgcagcgcgcccagaacgctctcgataatcttgtgatgctgcacaacagcgaacagggaggccgggcctatagacatgctatggaggagctgcccgacaccatcgaaacactcatgttcctggcccttattgccgtcctgaccgggggagttacactctttttcctgtccggccggggcctggggaaaacctctatcggactcctttgcgtgatggctagctccgtgctgctgtggatggcgagcgtcgagccgcactggattgccgcttctatcatcctcgaatttttcctgatggtgcttctgattcctgagcccgatcgccaaagaacacctcaggacaatcagctcgcctacgttgtgatcggcctgctgtttatgattctcaccgtcgccgctaacgagatggggcttctggaaacgacaaagaaagatctgggaatcggccacgtggccgtcgagaatcatcaccatgcggccatgctcgacgtggatctgcaccccgcttccgcctggaccctttacgctgttgccaccacaattatcacccctatgatgcggcatacaattgaaaacacgaccgcgaacatcagcctgacagccatcgctaatcaggccgctattctcatggggctggacaagggatggcccatctctaagatggatattggcgtgccgctgctcgcccttggctgttattcccaagtcaaccctctgaccctgacagctgccgtgctcatgctggttgcgcactacgccatcattgggcccggacttcaggctaaagccacccgcgaggctcagaagagaacggccgccggcatcatgaaaaatcccaccgtggacgggatcgtcgcgattgacctggatcctgtggtgtatgacgctaagttcgaaaaacaactcggacagatcatgctgctgattctctgcacaagccagatccttctgatgcggaccacatgggccctgtgtgagtctattaccctcgctacgggcccgctgacaaccctttgggaggggagccccggaaagttctggaacacaaccatcgccgtttccatggccaatatctttcgcggctcttacctggctggcgccgggctcgcgttcagcctgatgaagtccctgggaggcgggagacggggaaccggcgcccagggggaaacactcggagagaaatggaagcgccaacttaaccagctgagcaaatccgaatttaatacgtataagagatctggcattatggaggtcgatcggagcgaagctaaagagggcctgaagagaggggagaccacaaagcacgccgtgtcccgcggaaccgctaaactccggtggttcgtggaaagaaacctggtcaagcctgagggcaaagttatcgaccttgggtgcggacgcggcgggtggtcttactattgtgccggactgaagaaagtgacagaagtgaagggctacaccaaaggcgggcccggacatgaggaacctattcccatggcgacgtacggctggaatctcgtcaagctgcacagcgggaaggatgtgtttttcatccctccggagaaatgcgacacactgctctgtgatattggagagtcctctcccaaccctaccatcgaagagggccggacccttagagttctgaagatggtggaaccctggctgcgcgggaatcagttttgcattaaaatcctcaacccttatatgcccagcgtcgtggagacactggagcagatgcaacggaagcatggaggcatgcttgttagaaatccgctgtcccgcaacagcacccacgaaatgtactgggtgtcttgtggcacagggaatatcgtctccgccgtgaacatgacgagccggatgctcctgaatagattcaccatggctcaccgcaaacctacatatgagcgggacgtggatctgggagccggcaccagacatgtcgctgttgaacccgaggtggccaacctcgacattatcgggcagcgcattgaaaacatcaagcacgagcataagtctacatggcactacgatgaggacaatccctataaaacctgggcttaccatggatcctatgaagtgaagcctagcggctctgcctccagcatggtcaacggggtggttaaactgcttacgaagccctgggacgtgattcctatggtcacccagatcgcgatgacagataccacaccgtttggacagcaaagagtgttcaaagagaaggttgacacccggacacccaaggccaaacgcggcaccgctcagatcatggaagtgacggccaagtggctgtggggctttctctccagaaataaaaagcctcggatttgcacaagagaggagttcacccggaaagtccgcagcaacgctgccatcggggccgtgtttgttgatgagaatcagtggaactctgcgaaggaggctgtggaagacgagagattctgggatctggtccaccgggaacgcgagcttcacaagcaaggaaaatgtgctacctgcgtgtacaatatgatgggcaagagagagaagaagctgggggagttcggaaaagccaagggcagccgggctatttggtacatgtggctcggggcccgctttctggagttcgaagctctgggctttatgaacgaggaccattggttctccagagaaaattctctcagcggagtcgagggcgaggggctgcacaaacttggatatatcctgcgggatatttccaagatccccggcgggaacatgtacgccgacgatacagcgggatgggacacgcgcatcaccgaagatgacctccagaatgaggccaagattacagatatcatggaacctgagcatgctctgcttgccaaatctatttttaagctgacctatcagaacaaagtggttagagtgcagcggcccgctaagaatggcacagtcatggacgtgatcagccgcagagaccaacgggggtccggccaggtgggaacctacggcctcaacacattcaccaatatggaagcccagctgattcgccagatggagtctgaggggatctttagcccgtccgaactggagacgcctaacctcgcgggaagagttctggattggcttgaaaaacacggcgtggagcggctgaagagaatggccatcagcggggacgattgcgtcgtgaagcccattgacgatcgcttcgctgccgctctcaccgccctgaacgacatgggaaaagttcggaaggatatccctcaatgggaaccctctaaaggctggaatgactggcaacaggtgcctttttgttcccaccatttccaccagcttattatgaaggatgggagagagatcgtcgtgccctgccgcaaccaagacgagctggtcggccgggctagagtgagccagggagccggctggtctctccgcgaaacagcgtgtctggggaaatcctatgcccagatgtggcagctgatgtactttcatcggagagatctccgcctggctgccaatgccatttgcagcgctgttccggtggactgggtccctacctcccggacaacctggtctatccacgcccatcaccaatggatgacgacagaggacatgcttagcgtgtggaacagagtttggattgaagagaatccctggatggaagataagacccacatctccagctggggagacgtgccctatctgggcaagcgcgaggatcagtggtgtgggtctctcatcggactgacagcgcgggctacctgggccacgaacattcaggtcgccatcaatcaagtgagacggcttattggcaacgagaattacctggactacatgacctccatgaaaagattcaagaacgaaagcgatcctgagggggctctctggtga

SEQ ID NO: 19240 - RNA, 9879 nt, synthetic construct
  misc_feature 1..9879: note = derived and/or modified CDS sequence (opt5) from DENV-1__GU131814__SS-prME
  source 1..9879: mol_type = other RNA
agcgtgaccatgctgctcatgctgatgcccacagcgcttgctttccacctgacgaccagaggcggggaacctcatatgatcgtgtccaagcaggaacggggaaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccgtttctggagtgtatcctctgagcatccccgctaccctttttgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtcttccaagaaaacgtgtttcataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacaacccccggcacattcaagacgccggaaggggaggtgggagcgattgctctcgattttaagcctggcaccagcgggtctcccatcgtgaaccgcgaaggaaaaatcgtcggcctgtatggcaatggggtggttacaacctccggaacctacgtgagcgccattgcccaggctaaggcctcccaggagggccctcttcccgagatcgaagacgaggtcttccggaaaagaaacctgacaattatggatctgcaccccgggtctggaaagacgcgccggtatctccctgcgatcgtgagagaagctattaaacgcaagctgcggacccttatcctggccccgacaagagttgtggccagcgagatggctgaagccctcaagggcatgcccatccgctaccaaaccacagctgtcaaatccgagcataccgggaaggagattgtggacctgatgtgccacgccacgtttacaatgcggctgctcagccctgttagagtgcccaattataacatgatcattatggatgaagcgcatttcaccgacccttcttccatcgccgctcggggctacattagcacccgcgtcggaatgggcgaggccgctgccatctttatgacagccacaccccctgggtctgtggaggctttcccgcagagcaatgcggtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacgtttgatacagaataccagaaaaccaagaacaacgactgggactacgtggtcacaaccgatatcagcgagatgggcgctaatttcagagccgaccgcgtgattgatcctcggagatgcctgaaacccgttatcctcaaggacgggccggaacgcgtgatcctggccggccctatgcccgtcacggtggcttccgccgcgcagcggagaggacgcattggccggaaccacaataaagagggggatcagtatatctacatgggacagccccttaacaatgacgaggatcatgctcactggaccgaagccaagatgctgctcgacaacattaatacacctgagggcatcattcccgccctgttcgaacctgagagagaaaagagcgctgccatcgatggggagtatcgcctgagaggagaggcgcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagctcaaaatgcccttgacaacctggttatgctgcataattccgaacagggcgggcgggcgtatcgccacgccatggaggagctccctgataccattgaaacgctgatgcttctggctctcatcgccgtgctgacaggaggcgtgaccctgttctttctctctggcagagggcttggaaagaccagcattggcctgctgtgtgtcatggcttccagcgttctcctgtggatggcctctgtggagccccattggatcgccgcttccatcattcttgagttctttctgatggtgctcctgatcccggagcctgaccggcagcgcacaccccaggataaccaactggcgtacgtcgtgattgggctccttttcatgatcctgaccgttgccgctaatgagatgggactgctcgaaacaacgaagaaagacctgggcattgggcacgtggccgtcggaaaccaccatcacgccgctatgcttgatgtggacctgcatcctgccagcgcgtggaccctctacgccgtcgctacaaccatcattacacccatgatgagacacaccatcgagaacacgaccgccaatatctctctgacagctattgccaaccaggcggccatcctgatgggcctcgataagggctggcctatttccaaaatggacatcggggtgccccttctggctctgggatgctatagccaggttaatccgctcaccctgacagccgctgtgcttatgctggtcgcccattacgctattatcggccctgggctccaagccaaggcgacccgggaagcccagaaacgcacggctgccggaatcatgaagaaccccacagtggatggcattgttgctatcgacctggatcccgtggtctatgacgccaagtttgagaaacagctggggcagattatgctccttatcctgtgtacctctcaaattctgctcatgagaacaacctgggccctgtgcgaaagcatcacccttgcgacaggacctctgacgaccctctgggagggctccccgggcaagttctggaatacaaccatcgctgtgtctatggccaacatttttcgggggagctacctggctggagccggcctggccttctccctcatgaaaagccttgggggaggccgcagagggacaggagctcagggcgagaccctgggcgaaaagtggaaacggcagctgaatcagctctccaagtctgagttcaacacgtataagagaagcgggatcatggaagtggaccgctccgaggccaaagaaggactgaagcggggcgagacaaccaaacacgcggtttctagagggaccgccaaacttcgctggtttgtcgagcggaatctggtgaaacccgaaggaaaggtgattgatctcggctgtgggagaggaggctggagctactattgcgctggcctgaagaaagtcacagaggttaaggggtacaccaaaggaggccctgggcacgaagaacccatccctatggccacatacggatggaacctggtgaagctccattccggcaaagacgtgttctttattccccctgaaaagtgtgatacgcttctgtgcgacatcggggagtctagcccgaatcccaccattgaggaaggacgcacactgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgctgtgaatatgacgtctcgcatgctgctcaaccggtttaccatggcccacagaaaaccgacatatgaacgcgatgtcgacctgggggcgggaaccagacacgtggccgtggagcctgaagtcgctaaccttgatatcattggccagcggatcgagaatattaagcatgaacacgagtccacatggcattacgacgaggataacccctataaaacctgggcctaccacgggagctatgaagttaagccctctggatccgctagctccatggtgaatggcgtggtcaaactgctcacaaagccttgggacgtgatccccatggttacccaaatcgccatgacggatacaacccctttcggccagcagcgcgtgtttaaggagaaagtcgacaccagaacaccgaaggctaaacgggggacggcccaaattatggaagtgaccgcgaagtggctgtggggattccttagcagaaacaaaaagccccggatctgtacacgcgaggaatttaccagaaaggttcggtctaatgccgctattggcgccgtgttcgtcgacgagaaccagtggaatagcgctaaagaggccgtggaagatgagcgcttttgggacctggttcatagagaacgggagctccacaagcaggggaaatgcgccacatgcgtgtacaacatgatgggaaagcgcgagaaaaagctgggcgagttcgggaaggcgaaaggctccagagctatctggtacatgtggctgggagcccggtttctcgagttcgaagccctgggcttcatgaatgaggatcactggttttctcgcgaaaacagcctttccggggtcgagggagagggcctgcataagctcgggtatattctgagagacatctctaaaatccctggaggcaatatgtacgctgatgacaccgccgggtgggatacacggattaccgaagacgatcttcagaacgaggctcgcatcacggacattatggaacccgagcacgccctgctcgccaagagcatcttcaaactgacctatcaaaataaggtggtcagagtgcagcggcctgccaaaaacggcacagttatggatgtgatttcccgcagagaccagcggggatctggccaggtcgggacctacggactgaatacatttaccaacatggaagctcaactcatcagacagatggagagcgagggcatcttctcccccagcgaactggagacgccgaaccttgccgaacgcgtgctggattggctcgagaagtatggggtggaacggctgaagagaatggctatttctggagacgactgtgttgtgaaacctatcgatgaccgctttgccacagcgcttaccgccctgaatgatatgggcaaggtccggaaagacattccccagtgggagccttccaaggggtggaacgattggcagcaagtgcccttctgcagccatcactttcaccagctcatcatgaaagacggcagagagattgttgtgccttgtcgcaatcaggatgaactggtcggacgggctagagtgtctcagggcgccgggtggtccctgcgcgagacagcttgcctcggaaagagctacgcccaaatgtggcagctgatgtatttccatcggagagaccttcgcctggctgccaacgcgatctgttccgccgtccccgtggattggattccgacctctcggacgacctggagcatccacgctcatcaccagtggatgacaaccgaagacatgctctccgtttggaatagagtgtggatcgaggaaaacccttggatggaggataagacacatattagctcttggggcgacgtcccctacctggggaaacgggaggaccaatggtgcggatcccttatcggcctgaccgccagagccacatgggctaccaatattcaggtggccatcaaccaggttcgccggctcattgggaatgaaaactacctggattatatgacgagcatgaagagatttaaaaatgagtctgaccccgaaggcgcgctgtggtga

SEQ ID NO: 19241 - RNA, 9879 nt, synthetic construct
  misc_feature 1..9879: note = derived and/or modified CDS sequence (opt5) from DENV-1__GU131815__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggagctctgtgaagataccatgacctacaaatgcccgagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgcggcttgagggaaaaatcgttcagtacgaaaacctgaagtattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccgcacgggcctcgacttcaacgaaatggtgctgcttacaatgaaagagaagtcctggctggtccataaacagtggtttctcgatctgcctcttccctggaccagcggggcctccacatctcaagagacctggaatagacaggacctgctcgtgaccttcaagacagctcacgcgaaaaagcaggaagtcgtggttctgggaagccaagagggcgccatgcacacggctctgaccggggccacagaaattcagacctccggaacaaccacgatctttgccggccatctcaagtgccggctgaaaatggataaacttacactgaaagggatgagctatgtgatgtgtaccggctctttcaagctcgagaaagaagtcgctgagacccagcacggaacagtgctggttcagattaagtacgagggcaccgacgccccgtgcaagatccctttcctgacacaagatgaaaaaggggtgacgcagaacggaagacttatcaccgcgaatcccattgtcacagacaaggagaaacctgtgaacatcgaagctgagccgccctttggcgagtcctatattaccatcggggccggagaaaaggccctcaaactgagctggttcaagaagggctctagcattgggaaaatgtttgaggctacagcccgcggcgctcggagaatggccatcctgggagataccgcgtgggacttcggctccatcgggggagtgtttacgtctgttggcaagctcgtccatcagattttcgggaccgcctacggagtgctgtttagcggcgtgtcctggacaatgaaaatcgggattggcgtccttctgacctggctcggactgaatagccgctctacatccctgagcatgacctgtatcgctgtgggccttgttacactctacctgggggtgatggtccaggccgattctggatgcgtgattaactggaagggccgggaactgaaatgtgggtccggaatcttcgttaccaatgaggtgcacacgtggacagaacaatataagtttcaggctgacagccctaagagactctccgccgcgattggcaaagcctgggaggagggggtctgcggcatccgctctgctacccggctggaaaacatcatgtggaagcagattagcaacgagcttaatcatatcctgctcgaaaacgacatgaaattcaccgtggttgtgggagatgtcgccggcattctggctcaggggaagaaaatgatcagaccgcaacccatggagtacaagtattcctggaaatcttggggaaaggccaagattatcggcgccgacgtgcagaatacaacctttatcattgatgggcctaacacgcccgaatgtcctgacgatcagcgcgcttggaatatctgggaggtggaggactacggattcggcatttttacaaccaacatctggctgaaacttcgggatagctatacacaggtctgcgaccacagactcatgtccgcggccattaaggatagcaaagctgttcacgccgacatgggctactggatcgaatctgagaagaatgaaacctggaaactggcccgcgcttccttcatcgaggtgaagacatgtatttggcccaagagccataccctgtggtctaacggggtgctcgaatccgagatgatcattccgaaaatctatggaggccctattagccaacacaattaccggcccgggtacttcacgcagaccgccggaccttggcatctgggcaaacttgagctggattttgacctctgcgaagggacaaccgtcgtggttgatgagcactgcggaaacagaggcccctctctgcggacaaccacggtgacaggcaaaatcatccacgaatggtgttgccgcagctgtaccctgcctccccttagattcagaggggaagacggatgctggtatggcatggagattcggccggtcaaggaaaaagaggaaaatctcgtgaagtccatggttagcgcggggtctggagaggtggactcctttagcctgggcctgctctgtatctccattatgatcgaagaggtcatgcgctctcggtggagcagaaagatgctgatgacagggacccttgctgtgttctttctgctcattatgggacagctgacctggaacgatctgatccgcctttgcattatggttggcgccaatgcctccgacagaatgggcatggggacaacgtacctggctctcatggccaccttcaaaatgcggcctatgtttgcggtgggactcctgttccgcagactgacatctcgggaggtccttctgctcaccatcggcctgagcctggtggcttccgtggaacttcccaactctctggaggaactcggggatggactggccatgggcatcatgattctcaagctgcttacagactttcaaagccatcagctgtgggccaccctcctgtccctgacgttcatcaaaacaacctttagccttcactatgcttggaagaccatggccatggtcctgtctattgtttccctcttccccctgtgtctcagcacaacctctcagaaaacaacgtggctgcctgtgcttctggggtccctgggatgcaagccgctcaccatgtttctgatcgctgagaataagatttggggccgcagaagctggccccttaacgaaggcatcatggccgtggggatcgtctctattctgctctccagcctgctcaaaaacgatgtgcctctggcgggaccccttatcgccggcgggatgctgattgcttgttacgttatctccggaagctctgccgacctgagcctcgagaaggctgccgaggtgtcctgggaagaggaagccgagcattctggcgctagccacaatattctggtcgaagtgcaggatgacgggacaatgaaaatcaaggatgaggagcgggacgatacccttacaatcctgctcaaagcgaccctgctcgccgcttccggagtttatcctctgtctattcccgccacgcttttcgtgtggtacttctggcaaaagaaaaagcagcgcagcggcgtcctgtgggacacccctagccctcccgaagtggagagagccgtcctggatgacggcatctatcggattatgcagcgcgggctcctgggaagatctcaggtgggcgttggggtgtttcaagaaaacgtcttccatacaatgtggcacgtgacccggggagctgttcttatgtaccagggcaagagactggagcccagctgggcctccgtgaaaaaggacctcatcagctacgggggaggctggcgcctgcagggctcttggaatacaggggaggaagtccaggtgattgcggtggagcccggcaagaatcctaagaatgttcaaaccgctcccggcacatttaaaacgccggaaggggaggtcggagccatcgccctcgatttcaagcctggcacctccgggagccccattgtgaaccgggaaggaaagatcgtgggcctgtatggcaatggggtcgtgacaacctctggaacctacgtttccgctatcgcccaggcgaaagctagccaggagggccctcttcccgagattgaagacgaggtgtttagaaagcgcaacctgacaatcatggatctgcaccccgggtccggaaaaacgcggagatatctccctgccattgtccgcgaagccatcaagcggaaactgagaacccttattctggctccgacacgcgtggttgcctctgagatggctgaagccctcaagggcatgcccatccggtaccaaaccacagcggtgaagtccgagcataccgggaaagagatcgtcgacctgatgtgccacgccacgttcacaatgagactgctctcccctgtgcgggttcccaattataacatgattatcatggatgaagctcattttaccgaccctagctctgtggccgctcgcggctacatttccaccagagtcggaatgggcgaggccgccgctatcttcatgacagcgacaccccctgggagcgtggaagcctttccgcagtctaatgctgtgattcaggatgaggaacgggacatccccgagcgcagctggaactccggatatgagtggatcacagatttccctggcaagaccgtctggtttgttccctctattaaaagcgggaatgacatcgccaactgtcttagaaagaatggaaaacgggtgattcagctgtccagaaagacgttcgatacagaataccaaaagaccaaaaacaacgactgggactacgtggtcacaaccgatatctctgagatgggcgccaatttccgcgctgaccgggtgattgatcctagacgctgcctgaagcccgttatcctcaaagacgggccggaacgggtgattctggccggccctatgcccgtcacggtggcgagcgctgcccagagacgcggacggatcggcagaaaccacaataaggagggggatcagtatatctacatgggacagccccttaacaatgacgaggatcatgcccactggaccgaagctaaaatgctgctcgacaacattaatacacctgagggcatcattcccgccctgtttgaacctgagcgcgaaaagtccgcggccatcgatggggagtatagactgcggggagaggctcgcaagaccttcgttgaactcatgagacggggcgaccttccggtgtggctgagctacaaagtcgcctctgaggggtttcaatattccgatcgcagatggtgcttcgacggcgaacggaacaatcaggtgctggaggaaaacatggatgtcgagatttggacaaaggagggagaacgcaagaagctccgcccccggtggctggacgctagaacctacagcgaccctcttgccctgcgcgagtttaaagagttcgctgccggccggagatccgtgtctggggatctcatcctggagatcggaaagctgccccagcacctcacacagcgggcgcaaaatgcccttgacaacctggttatgctgcataatagcgaacagggcgggcgcgcttatagacacgccatggaggagctccctgataccattgaaacgctgatgcttctggctctcatcgccgtgctgacaggaggcgtgaccctgtttttcctctccggccgggggcttggaaaaacctctattggcctgctgtgtgtcatggccagctccgttctcctgtggatggctagcgtggagccccattggatcgcggcctctattatccttgaatttttcctgatggtgctcctgatcccggagcctgaccgccagagaacaccccaggataaccaactggcttacgtcgtgattgggctcctttttatgatcctgaccgttgccgccaatgagatgggactgctcgaaacaacgaagaaggacctgggcattgggcacgtggctgccgagaaccaccatcacgcggccatgcttgatgtcgacctgcatcctgcttccgcctggaccctctacgctgtggccacaaccatcattacacccatgatgcggcacaccatcgaaaacacgaccgcgaatattagcctgacagccatcgctaaccaggccgctatcctgatgggactcgataaaggctggcctatttctaagatggacatcggcgtcccccttctggccctggggtgctattcccaggtgaatccgctcaccctgacagctgccgttcttatgctggtggcgcattacgccattatcggacctggcctccaagctaaagccacccgcgaggctcagaagagaacggccgccgggattatgaaaaaccccacagtcgatggaatcgtggcgatcgacctggatcccgttgtgtatgacgctaagttcgaaaagcagctgggccagattatgctccttatcctgtgtaccagccaaattctgctcatgcggacaacctgggccctgtgcgagtctatcacccttgctacagggcctctgacgaccctctgggagggaagcccgggcaaattttggaatacaaccattgccgtctccatggccaacatcttccgcggctcttacctggctggggccggactggcgttcagcctcatgaagtcccttggcgggggaagacggggcacaggggcccagggagaaaccctgggcgagaaatggaagagacagctgaatcagctcagcaaatccgaatttaacacgtataagcgctctggcatcatggaggtggaccggagcgaagctaaggaggggctgaaaagaggagagacaaccaagcacgccgtgtcccgcggcaccgctaaacttcggtggttcgttgaaagaaatctggtcaagcccgaggggaaagtgattgatctcggatgtggccgcgggggatggtcttactattgcgccggcctgaagaaggtgacagaagtcaaaggctacaccaaagggggacctggccacgaggaacccatccctatggcgacatacgggtggaacctggttaaactccatagcggaaaggacgtgtttttcattccccctgagaaatgtgatacgcttctgtgcgacatcggcgagtcctctccgaatcccaccattgaagaggggcggacactgagagtgctcaagatggtcgaaccttggctgcgcggaaaccaattttgtatcaaaattcttaatccctatatgcctagcgtggttgagaccctggagcagatgcagcggaagcacggcggcatgctcgtgagaaaccccctgtcccgcaatagcacacatgaaatgtactgggtctcttgcgggaccggaaacatcgtgtccgccgttaatatgacgagccggatgctgctcaacagattcaccatggctcaccgcaagccgacatatgagagagatgtggacctgggcgccgggacccggcacgtcgctgtggaacctgaggtggccaaccttgatatcattggacagcgcatcgaaaatattaaacatgagcacaagtctacatggcattacgacgaggataacccctataaaacctgggcttaccacggctcctatgaagtcaagcccagcgggtctgcctccagcatggttaatggagtggtgaaactgctcacaaagccttgggacgtcatccccatggtgacccaaattgcgatgacggatacaaccccttttggccagcagagagttttcaaggagaaagtggacacccggacaccgaaggccaaaagaggcacggctcaaatcatggaagtcaccgccaagtggctgtgggggtttctttcccggaacaaaaagccccgcatctgtacaagagaggagttcacccggaaggtgcgcagcaatgctgccattggagccgtttttgtggacgagaaccagtggaactctgcgaaagaggctgtcgaagatgagagattctgggacctggtgcatcgggaacgcgagctccacaagcagggcaaatgcgccacatgcgtttacaacatgatggggaagagagagaagaagctgggagagtttggcaaggccaaagggagccgggctatctggtacatgtggctgggcgcccgcttcctcgagttcgaagctctgggatttatgaatgaggatcactggttctccagagaaaactctcttagcggcgtggagggggagggactgcataagctcggctatattctgcgggacatctccaaaattcctgggggaaatatgtacgccgatgacaccgcgggctgggatacacgcatcaccgaagacgatcttcagaacgaggccagaatcacggacattatggaacccgagcacgctctgctcgccaagtctatctttaaactgacctatcaaaataaggtcgtgcgggtccagcgccctgctaaaaacgggacagtgatggatgttattagcagacgggaccagagaggctccggacaggtgggcacctacgggctgaatacattcaccaacatggaagcccaactcatccgccagatggagtctgagggaatttttagcccctccgaactggagacgccgaaccttgcggaacgggtcctggattggctcgagaagtatggcgtggaaagactgaagcgcatggccatcagcggggacgactgtgtggttaaacctatcgatgaccggttcgctacagcccttaccgctctgaatgatatgggaaaggtgagaaaagacattccccagtgggagccttctaagggctggaacgattggcagcaagtccccttttgctcccatcacttccaccagctcatcatgaaagacgggcgcgagattgtggttccttgtcggaatcaggatgaactggtgggcagagcccgcgtcagccagggagctggctggtctctgcgggagacagcctgcctcgggaagtcctacgcgcaaatgtggcagctgatgtattttcatagacgcgaccttcggctggccgctaacgccatctgtagcgccgtgcccgtcgattggattccgacctccagaacgacctggtctatccacgctcatcaccagtggatgacaaccgaagacatgctcagcgtgtggaatcgggtttggattgaggaaaacccttggatggaggataagacacatatctccagctggggagacgtgccctacctgggcaaaagagaggaccaatggtgcgggtctcttatcggactgaccgcccgcgcgacatgggctaccaatattcaggtcgccatcaaccaggtgcggagactcattggcaatgaaaactacctggattatatgacgtccatgaagcgcttcaaaaatgagagcgaccccgaaggggccctgtggtga

SEQ ID NO: 19242 - RNA, 9879 nt, synthetic construct
  misc_feature 1..9879: note = derived and/or modified CDS sequence (opt5) from DENV-1__GU131818__SS-prME
  source 1..9879: mol_type = other RNA
agcgtgaccatgctgctgatgctgatgcccaccgcccttgctttccacctgacgacccggggaggggagcctcatatgatcgtctccaagcaggaacgggggaaatctctcctgtttaagacaagcgccggcgttaacatgtgcacccttattgccatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacgctaactttgtgtgcagacggacattcgtcgatcgcggctggggcaatgggtgtggactgtttggcaaggggtctctcattacctgcgccaagttcaaatgcgtgacaaagctggagggaaaaacggttcagcacgaaaaccttaagtactccgtgatcgtcaccgtgcatacaggcgaccagcaccaagttgggaatgagagcaccgaacatggaacaaccgctacgatcacaccccaggccccttctacagagattcagctgaccgactatggcgccctcacactggattgttcccccagaaccggcctggactttaacgaaatggtgctcctgacgatgaaagaaaagagctggcttgtccacaaacagtggttcctggatctccctctgccctggacatccggggcttctaccagccaagagacatggaatcggaaggaccttctggtgacctttaagaccgcgcacgccaaaaagcaggaagtcgtggttctcggatcccaggagggcgctatgcatacagccctgacgggggccaccgaaatccaaacaagcggaaccacaaccattttcgctggccacctgaaatgccgcctcaagatggataaactgacgcttaaggggacatcttacgtgatgtgtaccggctccttcaagctggagaaagaagtcgccgagacccagcatggaacagtgctcgttcagatcaagtatgagggcaccgacgcgccgtgcaaaattccttttagcacacaggatgaaaagggggtgacgcaaaacggaagactgatcaccgctaatcccatcgtcacagacaaagagaagcctgtgaacattgaagccgagccgcccttcggcgagtcttacatcgtgattggggccggagaaaaggctctgaaacttagctggtttaagaaaggctcctctatcgggaagatgttcgaggccaccgctcggggcgccagacgcatggcgattctcggagatacagcctgggactttggcagcatcgggggagttttcacctccgtcggcaaactggtgcaccagatctttgggacggcttatggagtgctgttcagcggcgtctcttggaccatgaagattgggatcggcgtgctcctgacatggcttggactcaattcccggagcacctctctctccatgacatgtattgccgttggcctggtgaccctgtaccttggggtcatggtgcaggctgatagcggatgcgttatcaactggaagggcagagaactcaaatgtgggtccggaatttttgtgacaaatgaggtccatacctggacggaacagtacaagttccaagccgactctcctaaacgcctgagcgcggccatcggcaaggcttgggaggagggggtgtgcggcattcggtccgccacaagactggaaaacatcatgtggaaacagatctctaacgagctcaatcacattctgcttgaaaacgacatgaagtttaccgttgtggtcggagatgtggctggcatcctggcccaggggaaaaagatgattcgcccgcagcccatggagtataagtacagctggaaatcctggggaaaggccaaaatcattggcgctgacgtgcaaaataccacattcatcatcgatgggcctaacacccccgaatgtcctgacgatcagcgggcgtggaatatttgggaggtcgaggactatggatttggcatcttcacgacaaacatttggctcaagctgagagatagctacacccaggtttgcgaccaccgcctgatgtctgccgctatcaaagattccaaggccgtgcatgccgacatgggctattggattgaaagcgagaagaatgaaacatggaaacttgctcgggcctctttcatcgaggtgaagacctgtatctggcccaaatcccacacactctggagcaacggggtcctggaatctgagatgattatcccgaagatttacggaggccctatcagccagcataattatagacccgggtactttacccaaacggcgggaccttggcacctgggcaaactcgagctggatttcgacctttgcgaagggaccacagtggttgtggatgagcactgcggaaaccgcggcccctccctgcggaccacaaccgtcacgggcaagattatccatgaatggtgttgcagaagctgtacactccctcccctgcggtttaagggggaggacggatgctggtacggcatggagatccgcccggtgaaagaaaaggaggaaaatctggttaaatctatggtgtccgctgggagcggagaggtcgactccttctctcttggcctcctgtgtattagcatcatgattgaagaggtgatgagatcccggtggtctagaaagatgctgatgaccgggacactcgccgtctttttcctgcttatcatgggacagctgacctggaacgatctcattcgcctgtgcatcatggtgggcgccaatgctagcgaccggatgggcatggggaccacatatctggcccttatggcgacgtttaaaatgagacctatgttcgctgtcggactgctctttcgcagactgacctcccgggaggtgctcctgcttacaattggcctgtctctcgtggccagcgtcgaactgcccaactccctggaggaacttggggatggactggccatgggcatcatgatcctcaagctgctcaccgacttccagagccaccaactgtgggctacacttctgtctctcacctttattaagacgacattctccctgcattacgcctggaaaaccatggctatggttctgagcatcgtgtctctttttcccctgtgtctctccaccacaagccagaagaccacatggctgcctgtgctcctggggtctcttggatgcaaaccgctgacgatgttcctgattgccgagaataagatctggggccgcaaatcctggcccctcaacgaaggcattatggcggtcgggatcgtgagcatcctgctttccagcctgctcaagaacgatgttcctctggccggacccctcattgctggcgggatgctgatcgcctgttatgtgatttctggaagctccgctgacctttctctggagaaagccgccgaggtcagctgggaagaggaagctgagcactccggcgcgtctcataatatcctggtggaagttcaggatgacgggaccatgaagattaaggatgaggagagagacgatacactcaccatcctgcttaaagccacactgctcgctgtgagcggagtctaccctctgtccatccccgccaccctcttcgtgtggtatttttggcagaagaaaaagcaacggtctggcgtcctgtgggacacgcctagccctcccgaagtggagcgcgccgttcttgatgacggcatttacagaatcatgcagcgggggctgctgggacgctcccaggtgggcgtcggggtgttccaggaaaacgtttttcacaccatgtggcacgtgacaagaggagctgtcctcatgtatcaaggcaaacggctggagcccagctgggcctctgtgaagaaggaccttatttcctacgggggaggctggcgcctgcagggcagctggaataccggggaggaagtgcaggttatcgcggtcgagcccggcaagaaccctaagaatgtgcagacagctcccggcaccttcaaaacatctgaaggggaggtgggagccattgccctcgattttaagccgggcacgtccgggagccctatcgtcaacagagaaggaaaaattgtgggcctgtacggcaatggggttgtgaccacatccggaacctatgtctctgctatcgcccaagcgaaggctagccaggagggccccctccctgagatcgaagacgaggtgttccggaagagaaacctgaccattatggatcttcatcccgggtccggaaaaacacgccggtacctgcccgccatcgttagagaagccattaagcgcaaactgcggacgctcatcctggctcctaccagagtggtcgccagcgagatggctgaagcccttaagggcatgccgattcgctatcagacaaccgcggtgaaatctgagcacacagggaaggagatcgttgacctgatgtgccatgccacctttacgatgcggctcctgtcccccgtgagagtccctaattacaacatgatcattatggatgaagctcacttcacagaccccagctctatcgccgctcgcggctatattagcacccgggtgggaatgggcgaggccgccgctatctttatgaccgcgacacctcccgggtccgtggaagccttccctcaatctaatgctgtcattcaggatgaggaaagagacatcccggagcggagctggaactccggatacgagtggatcaccgattttcccggcaagacagtttggttcgtgccttctattaaaagcgggaatgacatcgccaactgtctgcgcaagaatggaaaaagagtgattcagctctcccggaagaccttcgatacggaatatcagaaaacaaagaacaacgactgggactacgtcgtgaccacagatatcagcgagatgggcgccaattttcgcgctgacagagttattgatccccggagatgccttaagcctgtgatcctgaaagacgggcccgaacgcgtcattctggccggcccgatgcctgtgaccgttgcgtctgctgcccaacggagaggacgcatcggccggaaccataataaggagggggatcagtacatctatatgggacagcccctcaacaatgacgaggatcacgcccactggacggaagctaaaatgctgcttgacaacattaatacccccgagggcatcattcctgccctgttcgaacccgagagagaaaagtccgcggccatcgatggggagtaccgcctccggggagaggctagaaaaacatttgtggaactgatgcgcagaggcgacctgcctgtctggctcagctataaggtggcctccgaggggttccagtactctgatcggcgctggtgctttgacggcgaaagaaacaatcaagtccttgaggaaaacatggatgtggagatttggaccaaagagggagaacggaagaagctgcgcccgagatggctggacgctcggacatatagcgaccccctcgccctgagagagttcaaagaatttgctgccggccgccggtccgtttctggggatcttatcctggagatcggaaagctccctcagcatctgacccagagagcgcagaatgccctggacaacctcgtgatgcttcacaatagcgaacaaggcgggcgcgcttaccggcatgccatggaggagctgcccgatacaattgaaaccctgatgctcctggctcttatcgccgtgctgacgggaggcgtcacactcttctttctgtccggcagagggctgggaaaaaccagcattggcctcctttgtgttatggcctcttccgctctgctgtggatggcgagcgtggagcctcactggatcgccgcttctattatcctcgagttctttctgatggtgcttctgatccccgagccggaccggcagcgcacccctcaggataaccagctcgcctatgtcgtgattgggctgctgttcatgatcctcacagttgccgctaatgagatgggacttctggaaaccacaaagaaagacctgggcattgggcacgtggccgtcgagaaccatcaccatgcggccatgctcgatgtggacctgcaccccgcttccgcctggacgctttacgctgtcgccaccacaatcattacccctatgatgagacatacaatcgaaaacaccacggcgaatattagcctgaccgccatcgctaaccaagccgctatcctcatgggactggataagggctggcccatttctaagatggacatcggcgtgcctctgctcgcccttgggtgctacagccaggttaatcccctgacactgaccgctgccgtgctcatgctggtcgcgcactatgccattatcggaccgggccttcaggctaaagccacacgggaggctcaaaagcgcaccgccgccgggattatgaaaaaccctacggtggatggaatcgttgcgatcgacctggatcccgtggtctacgacgctaagtttgaaaaacagctcggccagattatgctgctggtgctctgtacatcccagatccttctgatgagaaccacatgggccctgtgcgagtctattaccctcgctaccgggcccctgacaacgctttgggagggaagccctggcaagttctggaataccacaatcgccgtgtccatggccaacattttccggggcagctatctggctggggcctccctcgcgttttctctgatgaaaagcctgggaggcgggcgcagaggaaccggcgcccaaggggaaacactcggagagaaatggaagcggcagcttaatcagctgtccaaatctgagttcaacacctacaagcgcagcggcatcatggaggttgacagatccgaagctaaagagggcctgaagagaggggaaacgacaaagcacgccgtctctagaggaaccgctaaactccgctggtttgtggaacggaatctggtgaagccggagggcaaagtcatcgatcttgggtgtggaagaggcgggtggagctattactgcgccggactgaagaaagttaccgaagtgaagggctatacaaaaggcgggcccggacatgaggaacctattcccatggcgacctacggctggaacctcgtgaagctgcactccgggaaggacgtcttctttatccctcccgagaaatgtgatacactgctctgcgacattggagagagctctcctaatccgacgatcgaagagggccgcacccttcgggtgctgaagatggttgaaccctggctgagagggaaccagttctgtattaaaatcctcaatccttacatgccctccgtggtcgagacactggagcaaatgcagcgcaagcatggaggcatgcttgtgcggaaccctctgagcagaaattctacccacgaaatgtattgggtttcctgcggcacagggaacattgtgagcgccgtcaatatgacctctcgcatgctcctgaaccggtttacgatggctcacagaaaacccacctacgagcgcgatgtggacctgggagccggcacacggcatgtggctgtcgaaccggaggttgccaacctcgatatcatcgggcagagaattgaaaatatcaagcacgagcataagtccacctggcactatgacgaggataacccttacaaaacatgggcttatcatggaagctacgaagtgaagccctccggcagcgcctctagcatggtgaatggggtcgtgaaactgcttaccaagccctgggacgttattcctatggtgacacagatcgcgatgaccgatacgacacccttcggacaacagcgcgtctttaaagagaaggtggacaccagaacccctaaggccaaacggggcacagctcagattatggaagttacggccaagtggctgtggggcttcctctcccgcaacaaaaagccgagaatctgtacccgggaggaatttacaagaaaagtgcggtctaatgctgccatcggggccgtcttcgtggacgagaaccaatggaatagcgcgaaggaggctgttgaagatgagcgcttttgggacctggtgcacagagaacgggagcttcacaagcagggaaaatgcgcgacctgcgtctataacatgatgggcaagcgcgagaaaaagctgggggagttcggaaaagccaagggctccagagctatttggtacatgtggctcggggcccggttcctggagtttgaagctctgggcttcatgaatgaggatcattggttttctcgcgaaaacagcctctccggagtggagggcgaggggctgcacaaacttggatacatcctgagagacatttctaagatccccggcgggaatatgtatgccgatgacacagcgggatgggatacccggattacagaagacgatctccagaacgaggccaagatcaccgacatcatggaacctgagcatgctctgcttgccaaaagcattttcaagctgacgtaccagaataaagtcgtgcgcgttcaaagacccgctaagaacggcaccgtgatggatgtcatctcccggcgcgaccagagagggagcggccaggtgggaacatatggcctcaatacctttacaaacatggaagcccagctgattcggcaaatggagtctgaggaaatcttctcccctagcgagctggaaacccccaacctcgcggggcgcgtgctggattggcttgagaaacacggagttgaaagactgaagcggatggccatttctggcgacgactgtgtggtcaagccgatcgatgacagatttgctacggccctcacagctctgaatgatatggggaaagtgcgcaaggacatccctcagtgggagccctccaaaggatggaacgattggcagcaggttcctttctgcagccaccattttcaccaacttattatgaaggacggccgggagatcgtggtcccctgtagaaatcaggatgaactggtggggcgcgcccgggtctcccagggcgctggatggtctctcaaagagaccgcctgcctgggcaagagctacgcgcagatgtggcaactgatgtatttccatagacgcgacctccggctggccgctaacgccatttgttccgccgtgcctgttgattgggtgcccacaagcagaaccacgtggtctatccacgctcatcaccagtggatgaccacagaagacatgctttccgtctggaatcgcgtgtggattgaggaaaacccgtggatggaggataagacccacatcagctcttggggagacgttccttacctgggaaaacgggaggaccagtggtgcggcagcctcattgggctgacagccagagcgacctgggctacaaatatccaagtggccatcaaccaggtccgccggcttattggaaatgaaaactatctggattacatgacctccatgaagagatttaaaaatgagtctgaccccgaaggcgccctctggtga

SEQ ID NO: 19243 - RNA, 9879 nt, synthetic construct
  misc_feature 1..9879: note = derived and/or modified CDS sequence (opt5) from DENV-1__GU131820__SS-prME
  source 1..9879: mol_type = other RNA
tccgtgaccatgctgctcatgctgatgcccaccgcccttgctttccacctgacgaccagaggcggggaacctcatatgatcgtcacaaagcaggaacggggaaagtcccttctgtttaagacctctgccggcgttaatatgtgcacccttattgcgatggacctgggggaactctgtgaagataccatgacatacaagtgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggctcggagaggtcgactcctttagcctgggcctgctctgtatctccattatgatcgaagaggtgatgcggtctagatggagccgcaagatgctgatggctgggacacttgccgttttcctgctcctgattatgggacagctgacctggaacgatcttatccggctgtgcattatggtgggcgccaatgcttccgacagaatgggcatggggacaacctatctcgccctgatggcgacctttaaaatgcgccctatgttcgctgtcggactcctgtttagacggcttacatctcgcgaggtgctgctcctgacgatcggcctgagccttgtggcctccgtcgaactgcccaactctctcgaggaactgggggatggactcgccatgggcatcatgattctgaaacttctgaccgacttccaaagccaccagctctgggctacactgctgtcccttacctttatcaaaacaaccctgagcctccattacgcctggaagacgatggctatggttctgtctattgtgtccctcttccccctgtgtcttagcacaacctctcagaagaccacatggctgcctgtgctgctcgggtccctgggatgcaaaccgcttaccatgtttctgatcgccgagaataagatttggggcagaaaaagctggcccctcaacgaaggcatcatggcggtcggggtggtttctatcctgctctccagcctgcttaagaacgatgtgcctctggccggacccctgattgctggcgggatgctcatcgcctgttatgtcatttccggaagctctgctgacctgagccttgagaaagccgccgaggtgtcctgggaagaggaagctgagcactctggcgcgagccataatatcctggttgaagtgcaggatgacgggacaatgaagattaaagatgaggagcgggacgatacgctcaccatcctgctcaaggccacactgcttgctatctccggagtctaccctctgtctattcccgccaccctgttcgtgtggtatttttggcaaaagaaaaagcagcgcagcggcgtcctctgggacacacctagccctcccgaagtggagagagccgttctggatgacggcatctaccggattatgcagcgcgggcttctgggaagatctcaggtgggcgtcggggtgttccaagaaaacgttttccacaccatgtggcacgtgacgcggggagctgtcctcatgtatcagggcaaacgcctggagcccagctgggcctccgtgaagaaagacctcatcagctacgggggaggctggagactgcagggctcttggaataccggggaggaagtgcaggttattgcggtcgagcccggaaagaaccctaagaatgtgcaaacagctcccggcacctttaaaacaccggaaggggaggtgggagccatcgcccttgatttcaagcctggcacctccgggagccccattgtcaaccgggaaggaaaaatcgtgggcctgtacggcaatggggttgtgacaacgtctggaacctatgtctccgctatcgcccaggcgaaggctagccaggagggccctctgcccgagattgaagacgaggtgtttagaaaacgcaacctcacaatcatggatctgcatcccgggtccggaaagacccggagataccttcctgccattgttcgcgaagccatcaagcggaaactgagaaccctcattctggctccgacacgcgtggtcgcctctgagatggctgaagccctgaagggcatgcccatccggtatcaaacgaccgcggtgaaaagcgagcacacagggaaggagatcgttgacctcatgtgccatgccaccttcacaatgagacttctgtcccctgtgcgcgtccccaattacaacatgattatcatggatgaagctcactttaccgaccctagctctattgccgctcggggctatatctccacgagagtgggaatgggcgaggccgccgctattttcatgacagcgacaccccctgggagcgtggaagcctttccgcagtctaatgctgtcatccaggatgaggaacgggacatccccgagcgcagctggaactccggatacgagtggattaccgatttccctggcaaaacagtttggtttgtgccctctatcaagagcgggaatgacattgccaactgtctgagaaagaatggaaaacgggtgatccagctctcccgcaagaccttcgatacagaatatcagaagaccaagaacaacgactgggactacgtcgtgacgacagatatttctgagatgggcgccaattttagagctgaccgggttatcgatcctagacgctgcctgaaacccgtgattcttaaggacgggccggaacgggtcatcctggccggccctatgcccgtgaccgttgcgagcgctgcccagagacgcggacggatcggcagaaaccataataaggagggggatcagtacatttatatgggacagcccctcaacaatgacgaggatcacgcccactggacagaagctaaaatgctgctggacaacatcaatacccctgagggcattatccccgccctcttcgaacctgagcgcgaaaagtccgcggccattgatggggagtaccggcttagaggagaggctcgcaaaacgttcgtggaactgatgagacggggcgacctgccggtctggctcagctataaggtggcctctgaggggtttcaatactccgatcgcagatggtgcttcgacggcgaacggaacaatcaggtcctggaggaaaacatggatgtggagatctggaccaaagagggagaacgcaagaaacttagaccccggtggctggacgctagaacatatagcgaccctctcgccctgcgcgagtttaaggagttcgctgccggccggagatccgtttctggggatctgatcctcgagattggaaaacttccccagcatctgacccagcgcgcgcaaaatgccctggacaacctcgtgatgctgcacaatagcgaacagggcgggcgggcttacagacatgccatggaggagcttcctgatacaatcgaaaccctgatgctcctggctctgattgccgtgctcacaggaggcgtcaccctctttttcctgtccggccgggggctgggaaaaacgtctatcggcctcctgtgtgttatggccagctccgtgcttctgtggatggctagcgtggagccccactggattgcggcctctatcatcctcgaatttttcctgatggtcctgctcattccggagcctgaccgccagagaacaccccaggataaccaacttgcttatgtggttatcgggctgctgtttatgattctcaccgtggccgccaatgagatgggactgcttgaaaccacaaagaaagacctgggcatcgggcacgtcgctgtggagaaccatcaccatgccaccatgctcgatgtcgacctgcaccctgcgtccgcctggacactgtacgctgtggccacgaccattatcacacccatgatgcggcataccattgaaaacacaaccgctaatatcagcctcacggccatcgcgaaccaggccgctattcttatgggactggataagggctggcctatctctaaaatggacattggcgttcccctgctcgccctggggtgctactcccaggtgaatccgcttaccctgacagctgccgtcctcatgctggtggctcactatgccatcattggacctggcctgcaagcgaaggccacccgcgaggctcagaagagaacagccgctgggatcatgaaaaaccccaccgttgatggaatcgtggccattgacctcgatcccgtcgtgtacgacgccaagttcgaaaaacagcttggccagatcatgctgctgattctctgtacgagccaaatcctgcttatgcggacaacctgggcgctgtgcgagtctattacactcgctaccgggcctctgaccacactgtgggagggaagcccgggcaagttttggaatacgaccatcgccgtgtccatggctaacatcttccgcggctcttatctcgccggggccggacttgcttttagcctgatgaaatccctgggcgggggaagacggggcacaggggcccagggagaaaccctcggcgagaagtggaagcgccagctgaatcagcttagcaaatccgagttcaacatttacaagagatctggcatcatggaggttgaccggagcgaagcgaaagaggggctgaagagaggagagacaacccgccacgccgtctcccggggcacggctaaactcagatggttcgtggaacgcaatctggtgaagcccgaggggaaggtcattgatctgggatgtggcagagggggatggtcttattactgcgccggcctcaaaaaggttacagaagtgaaaggctataccaaagggggacctggccatgaggaacccatccctatggctacctacgggtggaaccttgtgaaactgcacagcggaaaggacgtctttttcacaccccctgagagatgtgataccctgctctgcgacattggcgagtcctctccgaatcccacaatcgaagaggggcgcacgctgcgggtgcttaaaatggttgaaccttggctgagaggaaaccaattttgtattaagatcctcaatccctacatgcctagcgtggtcgagaccctggagcagatgcagcgcaagcatggcggcatgctggtgcggaaccccctctccagaaatagcacacacgaaatgtattgggtttcttgcgggaccggaaacatcgtgtccgccgtcaatatgacaagccgcatgctgcttaaccggttcaccatggcgcacagaaaaccgacgtacgagcgcgatgtggacctgggcgccgggaccagacatgtggctgtcgaacctgaggttgccaacctcgatattatcggacagcggattgaaaatatcaagcacgagcataaatctacatggcactatgacgaggataacccctacaagacctgggcttatcatggctcctacgaagtgaaacccagcgggtctgcctccagcatggtgaatggagtcgtgaagctgcttacaaagccttgggacgttattcccatggtgacccaaatcgctatgacagataccacgccttttggccagcagcgcgtcttcaaagagaaggtggacacaagaaccccgaaagccaagcggggcaccgcgcaaatcatggaagttacagccagatggctgtgggggtttctctcccggaacaaaaagccccgcatttgtacgagagaggagttcacccggaaggtgcgcagcaatgctgccatcggagctgtctttgtggacgagaaccagtggaactctgccaaagaggccgttgaagatgagagattctgggacctggtgcagaaggaacgggagctgcacaaacagggcaagtgcgcgacatgcgtctataacatgatggggaaacgcgaaaagaagctcggagagtttggcaaagctaaggggagcagagccatttggtacatgtggctgggcgcccggttccttgagtttgaagctctgggattcatgaatgaggatcactggttctcccgcgaaaactctctcagcggcgtggagggggagggactgcataaacttggctacatcctgagagacatttccaagatccctgggggaaatatgtatgccgatgacaccgctggctgggatacacggatcaccgaagacgatctccaaaacgaggccaaaattacagacatcatggaacccgagcacgcgctgctggccacctctatttttaagctcacgtaccagaataaagtcgtgcgcgttcagagacctgctaagaacgggaccgtgatggatgtcatcagccggcgcgaccagagaggctccggacaagtgggcacatatgggctgaataccttcacaaacatggaagcccagcttattcggcagatggagtctgagggaatctttctgcccagcgaactcgagaccccgaacctggctgaaagagtgcttgattggctggagaagcatggcgttgaacgcctcaaacggatggccatctccggggacgactgtgtggtcaagcctattgatgacagattcgcgacggccctgacagctctgaatgatatgggaaaagtgcgcaaggacatcccccagtgggagcctagcaaaggctggaacgattggcaacaggttcccttttgctctcaccacttccatcagctcattatgaaggacgggcgggagatcgtggtcccttgtagaaatcaggatgaactggtgggccgcgcccgggtctcccaaggagctggctggagccttagagagaccgcctgcctggggaagtcttacgctcagatgtggcagctcatgtattttcaccgccgggacctgagacttgccgcgaacgccatttgttccgctgtgcccgttgattgggtgccgacaagccgcaccacgtggtccatccatgcccaccatcaatggatgaccacagaagacatgctgtctgtctggaatcgggtgtggattgaggaaaacccttggatggaggataaaacccacgttagctcctggggagacgtgccctacctcggcaagagagaggaccagtggtgcgggagcctgatcggactgacagcccgggctacctgggcctctaatatccaggtcgcgattaaccaggtgagacgcctcatcggcaatgaaaactatctggattacatgacatccatgaaacggttcaagaatgagggggaccccgaaggcgctctttggtga

SEQ ID NO: 19244 - RNA, 9879 nt, synthetic construct
  misc_feature 1..9879: note = derived and/or modified CDS sequence (opt5) from DENV-1__HM181970__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaagatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacttcacacagaccgcgggcccttggcatctggggaaacttgagctggatttcgacctctgcgaaggaacgaccgtggtcgtggatgagcactgcggcaaccggggccccagcctgagaacaaccacagttaccgggaagatcattcacgaatggtgttgccggtcctgtacgctgcctccccttcgctttagaggagaggacggctgctggtatgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctacctggccctcatggcgacattcaagatgagacctatgtttgctgttggcctcctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccatcagctgtgggctaccctcctgtccctgacattcattaagaccacgtttagccttcactatgcctggaaaacaatggctatggtgctgtctatcgtctccctcttccccctgtgtctcagcaccacctctcagaagacaacctggctgcctgttcttctgggatccctgggctgcaagccgctcacaatgtttctgattgccgagaataaaatctggggccggaagtcctggccccttaacgaagggatcatggcggtgggaattgtgtctatcctgctctccagcctgctcaaaaacgatgtccctctggccggcccccttattgctgggggaatgctgatcgcctgttacgtgatttccggcagctctgctgacctgagcctcgagaaggccgccgaggtttcctgggaagaggaagctgagcattctggggcgagccacaatatcctggtggaagtccaggatgacggaacgatgaaaatcaaggatgaggagcgcgacgatacccttacaattctgctcaaagccaccctgctcgctgtgtccggcgtttatcctctgtctatccccgccacacttttcgtgtggtacttctggcaaaagaagaaacagagaagcggcgtcctgtgggacacccctagccctcccgaagtggagcgggccgtcctggatgacgggatttatcgcatcatgcagagaggactcctgggccggtctcaggtgggggttggagtgtttcaagaagacgtcttccatacgatgtggcacgtgacccgcggcgctgttcttatgtaccaggggaagagactggagcccagctgggcctccgtgaaaaaggatctcattagctacggaggcggctggcggctgagagggtcttggaacacaggagaggaagtccaggtgatcgcggtggagcccggcaaaaatcctaagaacgttcagaccgctcccgggacatttaagaccccggaaggagaggtcggcgccattgccctcgacttcaaacctgggacatccggaagccccatcgtgaatcgcgaaggcaagatcgtgggcctgtatgggaacggagtcgtgacgacctctggcacatacgtttccgctattgcccaagcgaaagctagccaggaggggcctcttcccgagatcgaagatgaggtgtttcggaagagaaatctgaccattatggacctgcaccccggatccggcaaaacccgccggtatctccctgccatcgtcagagaagccattaagcgcaagctgcggacacttatcctggctccgacgagagtggttgcctctgagatggctgaagccctcaaagggatgcccatccgctaccagaccacagcggtcaagagcgagcataccggcaaagagattgtcgatctgatgtgccacgccacattcaccatgcggctgctctcccctgtgagagttcccaactataatatgatcattatggacgaagctcattttacggatcctagctctatcgccgctcggggatacatttccacacgcgtgggcatgggggaggccgccgctatcttcatgaccgcgacaccccctggaagcgtcgaagcctttccgcaatctaacgctgtgatccaggacgaggaaagagatattcccgagcggagctggaactccggccacgagtggatcacagacttccctgggaagaccgtgtggtttgtcccctctattaaaagcggaaacgatatcgccaattgtcttcgcaagaacggcaagagagttattcagctgtcccggaaaacattcgacaccgaatatcagaagacgaaaaataacgactgggattacgtggtgacaaccgacatctctgagatgggggccaacttcagagctgatcgcgtcattgaccctcggagatgcctgaagcccgtgatcctcaaagatggcccggaacgcgttatcctggccggacctatgcccgtgacagtcgcgagcgctgcccaacggagaggccgcattgggcggaatcataacaaggagggagaccagtacatctatatgggccagccccttaataacgatgaggaccacgcccactggaccgaagctaagatgctgctcgataatattaacacgcctgaggggatcattcccgccctgtttgaacctgagagagaaaaatccgcggccgtggacggagagtaccgcctgagaggcgaggctcggaagaccttcgttgaactcatgcgcagaggggatcttccggtgtggctgagctataaagtcgcctctgagggctttcagtactccgaccggcgctggtgcttcgatggagaaagaaataaccaagtgctggaggaaaatatggacgtcgagatctggacaaaggagggcgaacggaaaaagctcagaccccgctggctggacgctcggacctatagcgatcctcttgccctgagagagtttaaagagttcgctgccgggcgccggtccgtgtctggagacctcatcctggagattggcaagctgccccagcatctcacacagagagcgcagaacgcccttgataatctggttatgctgcacaacagcgaacaagggggacgggcttaccgccatgccatggaggagctccctgacaccatcgaaacactgatgcttctggctctcattgccgtgctgaccggcggcgtgacgctgtttttcctctccgggagaggacttggcaagacatctatcgggctgctgtgtgtcatggccagctccgttctcctgtggatggctagcgtggagccccactggattgcggcctctatcatccttgaatttttcctgatggtgctcctgattccggagcctgatcggcagcgcacaccccaggacaatcagctggcttatgtcgtgatcggactcctttttatgattctgaccgttgccgccaacgagatgggcctgctcgaaacaaccaaaaaggatctggggatcggacacgtggctgtcgagaatcatcaccatgccgcgatgcttgacgtggatctgcaccctgcctccgcttggacactctacgccgtcgctacgaccattatcacacccatgatgagacataccattgaaaacacaaccgccaacatcagcctgacggcgatcgccaatcaagctgccattctgatgggcctcgacaaaggctggcctatctctaagatggatattggggtgccccttctggctctgggatgctactcccaggttaacccgctcaccctgacagccgctgtgcttatgctggtcgcccactatgcgatcattggccctgggctccaggccaaagctacccgggaggcccaaaagcgcacagctgccggaatcatgaagaatcccaccgtggacggcatcgttgccattgatctggaccccgtggtctacgacgcgaaattcgaaaagcagctggggcagatcatgctccttattctgtgtacgagccagatcctgctcatgagaacaacctgggctctgtgcgagtctattacacttgccaccggacctctgaccacactctgggagggcagcccgggcaaattttggaacacgaccatcgctgtgtccatggccaatatcttccgggggtcttatctggccggagctggcctggccttcagcctcatgaagtcccttgggggaggccgcagagggacaggagcgcaaggcgaaaccctgggcgagaaatggaagcggcagctgaaccagctcagcaagtccgaatttaatacatacaaaagatctgggattatggaggtggatcgcagcgaagccaaggagggactgaaacggggcgagaccacgaagcacgctgtttccagagggacagccaaacttcgctggttcgtcgaacggaacctggtgaagcccgagggaaaggtgatcgacctcggctgtgggagaggaggctggtcttattactgcgctggcctgaaaaaggtcaccgaagttaaagggtataccaagggaggccctgggcatgaggaacccattcctatggccacatacggatggaatctggtgaaactccacagcggcaaggatgtgtttttcattccccctgagaaatgtgacacccttctgtgcgatatcggggagtcctctccgaaccccacaatcgaagagggacgcacgctgcgggtcctcaagatggtggaaccttggctgagaggcaatcagttttgtattaagatccttaacccctacatgcctagcgttgtggagaccctggagcaaatgcagcgcaaacatggcgggatgctcgtccggaatcccctgtccagaaacagcacacacgaaatgtattgggtgtcttgcggaaccggcaatatcgtttccgcggtgaacatgacaagccgcatgctgctcaatcggttcaccatggcccacagaaagccgacgtacgagcgcgacgtcgatctggggaccggaacaagacatgtggctgtggaacctgaggtcgccaaccttgacattatcggccagcggattgaaaacatcaaacacgagcataagtctacctggcactatgatgaggacaatccctacaaaacatgggcttatcatgggtcctacgaagttaagcccagcggatctgcctccagcatggtgaacggcgtggtcaagctgctcaccaaaccttgggatgtgattcccatggttacacagatcgctatgaccgacacgacaccttttggccaacagcgcgtgttcaaggagaaagtcgacaccagaaccccgaaggccaaacgggggacagcgcagatcatggaagtgacggccagatggctgtggggatttctttcccggaataagaagccccgcatttgtaccagagaggagttcacacggaaagttcgcagcaacgctgccatcggcgctgtgtttgtcgatgagaatcaatggaactctgccaaggaggccgtggaagacgagagattctgggatctggttcaccgggaacgcgagctccacaaacaggggaagtgcgcgacctgcgtgtataatatgatgggaaaaagagaaaagaagctgggcgagtttgggaaagctaagggcagccgggccatttggtacatgtggctgggagcccgcttcctcgagttcgaagctctgggctttatgaacgaggaccattggttctccagagaaaattctcttagcggggtcgagggagagggcctgcacaaactcgggtacatcctgcgggatatttccaagatccctggaggcaacatgtatgccgacgatacagctgggtgggacacccgcatcacagaagatgaccttcagaatgaggccaaaattaccgatatcatggaacccgagcatgcgctgctcgccaaggctatttttaaactgacgtaccagaacaaggtggtcagagtgcaacggcctgccaagaatggcaccgttatggacgtgatctctcgcagagatcagcggggaagcggccaggtcgggacatatggactgaacaccttcacaaatatggaagctcagctcattagacaaatggagtccgagggcatcttttctcccagcgaactggagaccccgaaccttgccgaacgcgcgctggactggctcgagaaatacggggtggaacggctgaagagaatggccatctccggagacgattgtgtggttaaacctattgacgatcgcttcgctacggcccttacagctctgaacgacatgggcaaggtgcggaaagatatcccccagtgggagcctagcaaggggtggaatgactggcagcaggtccccttttgctctcaccacttccatcaactcattatgaaggatggcagagagatcgtggttccttgtcgcaaccaggacgaactggtgggacgggccagagtctcccagggcgctgggtggagcctgcgcgagaccgcctgcctcggaaaatcttatgcgcagatgtggcaactgatgtactttcaccggagagatcttcgcctggccgctaatgccatttgttccgccgtgcccgtcgactgggtgccgacaagccggaccacgtggtccatccatgctcaccatcagtggatgaccacagaagatatgctctctgtttggaacagagtgtggattgaggaaaatccttggatggaggacaagacccacatcagctcctgggaggacgtcccctatctgggcaaacgggaagatcagtggtgcgggagccttatcggactgacagccagagcgacctgggctacaaacattcaagtggccatcaatcaggttcgccggctcattggcaacgagaattacctggactacatgacctctatgaagagattcaaaaacgaatccgatcccgagggggccctgtggtga

SEQ ID NO: 19245 - RNA, 9879 nt, synthetic construct
  misc_feature 1..9879: note = derived and/or modified CDS sequence (opt5) from DENV-1__GU131821__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacgctaactttgtgtgcagacggacattcgtcgatcgcggctggggcaatgggtgtggactgtttggcaaggggtctctcattacctgcgccaagttcaaatgcgtgacaaagctggagggaaaaacggttcagcacgaaaaccttaagtactccgtgatcgtcaccgtgcatacaggcgaccagcaccaagttgggaatgagagcaccgaacatggaacaaccgctacgatcacaccccaggccccttctacagagattcagctgaccgactatggcgccctcacactggattgttcccccagaaccggcctggactttaacgaaatggtgctcctgacgatgaaagaaaagagctggcttgtccacaaacagtggttcctggatctccctctgccctggacatccggggcttctaccagccaagagacatggaatcggaaggaccttctggtgacctttaagaccgcgcacgccaaaaagcaggaagtcgtggttctcggatcccaggagggcgctatgcatacagccctgacgggggccaccgaaatccaaacaagcggaaccacaaccattttcgctggccacctgaaatgccgcctcaagatggataaactgacgcttaaggggatgtcttacgtgatgtgtacaggctccttcaagctggagaaagaagtcgccgagacccagcatggaaccgtgctcgttcagatcaagtatgagggcacagacgcgccgtgcaaaattccttttagcacccaggatgaaaagggggtgacacaaaacggaagactgatcacggctaatcccatcgtcaccgacaaagagaagcctgtgaacattgaagccgagccgcccttcggcgagtcttacatcgtgattggggccggagaaaaggctctgaaacttagctggtttaagaaaggctcctctatcgggaagatgttcgaggccacagctcggggcgccagacgcatggcgattctcggagataccgcctgggactttggcagcatcgggggagttttcacatccgtcggcaaactggtgcaccagatctttgggaccgcttatggagtgctgttcagcggcgtctcttggacgatgaagattgggatcggcgtgctcctgacctggcttggactcaattcccggagcacatctctctccatgacctgtattgccgttggcctggtgacactgtaccttggggtcatggtgcaggctgatagcggatgcgttatcaactggaagggcagagaactcaaatgtgggtccggaatttttgtgaccaatgaggtccatacatggaccgaacagtacaagttccaagccgactctcctaaacgcctgagcgcggccatcggcaaggcttgggaggagggggtgtgcggcattcggtccgccacgagactggaaaacatcatgtggaaacagatctctaacgagctcaatcacattctgcttgaaaacgacatgaagtttacagttgtggtcggagatgtggctggcatcctggcccaggggaaaaagatgattcgcccgcagcccatggagtataagtacagctggaaatcctggggaaaggccaaaatcattggcgctgacgtgcaaaataccaccttcatcatcgatgggcctaacacacccgaatgtcctgacgatcagcgggcgtggaatatttgggaggtcgaggactatggatttggcatcttcaccacgaacatttggctcaagctgagagatagctacacacaggtttgcgaccaccgcctgatgtctgccgctatcaaagattccaaggccgtgcatgccgacatgggctattggattgaaagcgagaagaatgaaacctggaaacttgctcgggcctctttcatcgaggtgaagacatgtatctggcccaaatcccacaccctctggagcaacggggtcctggaatctgagatgattatcccgaagatttacggaggccctatcagccagcataattatagacccgggtactttacacaaaccgcgggaccttggcacctgggcaaactcgagctggatttcgacctttgcgaagggacgaccgtggttgtggatgagcactgcggaaaccgcggcccctccctgcggacaaccacagtcaccggcaagattatccatgaatggtgttgcagaagctgtacgctccctcccctgcggtttaagggggaggacggatgctggtacggcatggagatccgcccggtgaaagaaaaggaggaaaatctggttaaatctatggtgtccgctgggagcggagaggtcgactccttctctcttggcctcctgtgtattagcatcatgattgaagaggtgatgagatcccggtggtctagaaagatgctgatgacagggaccctcgccgtctttttcctgcttatcatgggacagctgacatggaacgatctcattcgcctgtgcatcatggtgggcgccaatgctagcgaccggatgggcatggggaccacctatctggcccttatggcgacatttaaaatgagacctatgttcgctgtcggactgctctttcgcagactgacgtcccgggaggtgctcctgcttaccattggcctgtctctcgtggccagcgtcgaactgcccaactccctggaggaacttggggatggactggccatgggcatcatgatcctcaagctgctcacagacttccagagccaccaactgtgggctacccttctgtctctcacatttattaagaccacgttctccctgcattacgcctggaaaacaatggctatggttctgagcatcgtgtctctttttcccctgtgtctctccaccaccagccagaagacaacctggctgcctgtgctcctggggtctcttggatgcaaaccgctgacaatgttcctgattgccgagaataagatctggggccgcaaatcctggcccctcaacgaaggcattatggcggtcgggatcgtgagcatcctgctttccagcctgctcaagaacgatgttcctctggccggacccctcattgctggcgggatgctgatcgcctgttatgtgatttctggaagctccgctgacctttctctggagaaagccgccgaggtcagctgggaagaggaagctgagcactccggcgcgtctcataatatcctggtggaagttcaggatgacgggacgatgaagattaaggatgaggagagagacgataccctcacaatcctgcttaaagccaccctgctcgctgtgagcggagtctaccctctgtccatccccgccacactcttcgtgtggtatttttggcagaagaaaaagcaacggtctggcgtcctgtgggacacccctagccctcccgaagtggagcgcgccgttcttgatgacggcatttacagaatcatgcagcgggggctgctgggacgctcccaggtgggcgtcggggtgttccaggaaaacgtttttcacacgatgtggcacgtgaccagaggagctgtcctcatgtatcaaggcaaacggctggagcccagctgggcctctgtgaagaaggaccttatttcctacgggggaggctggcgcctgcagggcagctggaatacaggggaggaagtgcaggttatcgcggtcgagcccggcaaaaatcctaagaatgtgcagaccgctcccggcacattcaaaacctctgaaggggaggtgggagccattgccctcgattttaagccgggcacatccgggagccctatcgtcaacagagaaggaaaaattgtgggcctgtacggcaatggggttgtgacgacctccggaacatatgtctctgctatcgcccaagcgaaggctagccaggagggccccctccctgagatcgaagacgaggtgttccggaagagaaacctgaccattatggatcttcatcccgggtccggaaaaacccgccggtacctgcccgccatcgttagagaagccattaagcgcaaactgcggacactcatcctggctcctacgagagtggtcgccagcgagatggctgaagcccttaagggcatgccgattcgctatcagaccacagcggtgaaatctgagcacaccgggaaggagatcgttgacctgatgtgccatgccacatttaccatgcggctcctgtcccccgtgagagtccctaattacaacatgatcattatggatgaagctcacttcacggaccccagctctatcgccgctcgcggctatattagcacacgggtgggaatgggcgaggccgccgctatctttatgaccgcgacccctcccgggtccgtggaagccttccctcaatctaatgctgtcattcaggatgaggaaagagacatcccggagcggagctggaactccggatacgagtggatcacagattttcccggcaagaccgtttggttcgtgccttctattaaaagcgggaatgacatcgccaactgtctgcgcaagaatggaaaaagagtgattcagctctcccggaagacattcgataccgaatatcagaaaacgaagaacaacgactgggactacgtcgtgacaaccgatatcagcgagatgggcgccaattttcgcgctgacagagttattgatccccggagatgccttaagcctgtgatcctgaaagacgggcccgaacgcgtcattctggccggcccgatgcctgtgacagttgcgtctgctgcccaacggagaggacgcatcggccggaaccataataaggagggggatcagtacatctatatgggacagcccctcaacaatgacgaggatcacgcccactggaccgaagctaaaatgctgcttgacaacattaatacgcccgagggcatcattcctgccctgttcgaacccgagagagaaaagtccgcggccatcgatggggagtaccgcctccggggagaggctagaaaaacctttgtggaactgatgcgcagaggcgacctgcctgtctggctcagctataaggtggcctccgaggggttccagtactctgatcggcgctggtgctttgacggcgaaagaaacaatcaagtccttgaggaaaacatggatgtggagatttggacaaaagagggagaacggaagaagctgcgcccgagatggctggacgctcggacctatagcgaccccctcgccctgagagagttcaaagaatttgctgccggccgccggtccgtttctggggatcttatcctggagatcggaaagctccctcagcatctgacacagagagcgcagaatgccctggacaacctcgtgatgcttcacaatagcgaacaaggcgggcgcgcttaccggcatgccatggaggagctgcccgataccattgaaacactgatgctcctggctcttatcgccgtgctgaccggaggcgtcacgctgttctttctgtccggcagagggctgggaaaaacaagcattggcctcctttgtgttatggcctcttccgctctgctgtggatggcgagcgtggagcctcactggatcgccgcttctattatcctcgagttctttctgatggtgcttctgatccccgagccggaccggcagcgcacccctcaggataaccagctcgcctatgtcgtgattgggctgctgttcatgatcctcaccgttgccgctaatgagatgggacttctggaaacaaccaagaaagacctgggcattgggcacgtggccgtcgagaaccatcaccatgcgacaatgctcgatgtggacctgcaccccgcctccgcttggacgctttacgccgtcgctaccacaatcattacccctatgatgagacatacaatcgaaaacaccacggccaatattagcctgaccgcgatcgccaaccaagctgccatcctcatgggactggataagggctggcccatttctaagatggacatcggcgtgcctctgctcgctcttgggtgctacagccaggttaatcccctgacactgaccgccgctgtgctcatgctggtcgcccactatgcgattatcggaccgggccttcaggccaaagctacacgggaggcccaaaagcgcaccgctgccgggattatgaaaaaccctacggtggatggaatcgttgccatcgacctggatcccgtggtctacgacgcgaagtttgaaaaacagctcggccagattatgctgctgatcctctgtacatcccagattcttctgatgagaaccacatgggctctgtgcgagtctatcaccctcgccaccgggcccctgacaacgctttgggagggaagccctggcaagttctggaataccacaattgctgtgtccatggccaacatcttccggggcagctatctggccggggctggactcgccttttccctgatgaagtctctgggcgggggacgcagaggcaccggggcgcaaggagaaacactcggcgagaaatggaagcggcagcttaatcagctgagcaaatccgagttcaacacctacaagcgctctggcatcatggaggtggacagaagcgaagccaaagaggggctgaagcggggagagacgacaaagcacgctgtttccagaggcaccgccaaactccgctggtttgtcgaacggaatctggtgaagccggaggggaaagtgattgatcttggatgtggcagagggggatggtcttattactgcgctggcctgaagaaagtcaccgaagttaagggctatacaaaagggggacccggccatgaggaacctatccccatggccacctacgggtggaacctcgtgaagctgcacagcggaaaggacgtgttctttattcctcccgagaaatgtgatacactgctctgcgacatcggcgagtccagccctaatccgacgattgaagaggggcgcacccttcgggtcctgaagatggtggaaccctggctgagaggaaaccagttctgtatcaaaattctcaatccttacatgccctctgttgtggagacactggagcaaatgcagcgcaagcatggcggcatgcttgtccggaaccctctgtccagaaatagcacccacgaaatgtattgggtgtcttgcgggacaggaaacatcgtttccgcggtgaatatgaccagccgcatgctcctgaaccggtttacgatggcccacagaaaacccacctacgagcgcgatgtcgacctgggcgctgggacacggcatgtggccgtggaaccggaggtcgctaacctcgatatcattggacagagaatcgaaaatattaagcacgagcataagtctacctggcactatgacgaggataacccttacaaaacatgggcctatcatggctcctacgaagttaagcccagcgggtccgctagctctatggtgaatggagtggtcaaactgcttaccaagccctgggacgtgatccctatggttacacagattgccatgaccgatacgacacccttcggccaacagcgcgtgtttaaagagaaggtcgacaccagaacccctaaggcgaaacggggcacagcccagatcatggaagtgacggctaagtggctgtgggggttcctcagccgcaacaaaaagccgagaatctgtacccgggaggaatttacaagaaaagttcggtccaatgccgctattggagccgtgttcgtcgacgagaaccaatggaactctgccaaggaggcggtggaagatgagcgcttttgggacctggttcacagagaacgggagcttcacaagcagggcaaatgcgctacctgcgtgtataacatgatggggaagcgcgagaaaaagctgggagagttcggcaaagccaaggggagcagagccatctggtacatgtggctcggcgctcggttcctggagtttgaagccctgggattcatgaatgaggatcattggttttcccgcgaaaactctctcagcggcgtcgagggggagggactgcacaaacttggctacattctgagagacatctccaagattcccgggggaaatatgtatgctgatgacacagccggctgggatacccggatcacagaagacgatctccagaacgaggcgaagatcaccgacattatggaacctgagcatgccctgcttgctaaatctatcttcaagctgacgtaccagaataaagtggtccgcgtgcaaagacccgccaagaacgggaccgttatggatgtgattagccggcgcgaccagagaggctccggacaggtcggcacatatgggctcaatacctttacaaacatggaagctcagctgatccggcaaatggagagcgagggaattttctctccttccgaactggagacccccaacctcgccggccgcgtgctggattggcttgaaaaacacggggtggagagactgaagcggatggcgatcagcggagacgactgtgttgtgaagccgatcgatgacagatttgccacggctctcacagccctgaatgatatgggcaaagtccgcaaggacattcctcagtgggaaccctctaaagggtggaacgattggcaacaggtgcctttctgctcccaccattttcaccaacttatcatgaaggacggccgggagattgttgtgccctgtagaaatcaggatgagctggtcggacgcgctcgggtgagccagggcgccgggtggtccctcagagaaaccgcttgcctgggaaaatcttacgcccagatgtggcaactgatgtatttccatcgccgggacctcagactggcggccaacgctatctgtagcgccgtccctgtggagtgggttcccacatcccgcaccacgtggagcattcacgcccatcaccagtggatgaccacagaagatatgctttctgtgtggaatcgggtctggatcgaggaaaacccgtggatggaggacaagacccacatttccagctggggcgatgtgccttacctggggaagagagaggaccagtggtgcggatctctcatcggcctgacagctcgcgccacctgggcgacaaatatccaagttgctattaaccaggtgcggagacttatcgggaatgaaaactatctggactacatgaccagcatgaaacggtttaagaatgagtccgatcccgaaggcgccctctggtga

SEQ ID NO: 19246 - RNA, 9879 nt, synthetic construct
  misc_feature 1..9879: note = derived and/or modified CDS sequence (opt5) from DENV-1__JF937617__SS-prME
  source 1..9879: mol_type = other RNA
agcgtgaccatgctgctgatgctgatgcccacagcccttgctttccacctgacgaccagaggcggggagcctcatatggtggtttccaagcaggaacggggaaagtctctcctgtttaagaccagcgccggcgtgaacatgtgcacccttatcgcgatggacctgggggagctctgtgaagatacaatgacctacaaatgcccccgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggctgggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacgttatgtggaaacagatctccaacgagcttaatcatatcctgctcgaaaacgacatgaagttcacagtggtcgtgggagatgtggctggcattctggcccaggggaaaaagatgatccggccgcaacccatggagtacaaatattcttggaaaagctggggaaaggccaagattatgggcgctgacgtccagaataccacctttatcattgatgggcctaacacacccgaatgtcctgacgatcagagagcgtggaatatctgggaggttgaggactacggattcggcatctttaccacgaacatttggctgaaacttcgcgattcctatacacaggtgtgcgaccaccggctcatgagcgccgctatcaaagattctaaggccgtgcacgccgacatgggctactggattgaatccgagaaaaatgaaacctggaagctggctagagccagcttcatcgaggtcaagacatgtatttggcccaaatctcataccctgtggtccaacggggtgctcgaaagcgagatgatcatcccgaagatttatggaggccctatctctcaacacaattaccgccccgggtacttcacacagaccgcgggaccttggcatctgggcaaacttgagctggattttgacctctgcgaagggacgaccgttgtggtcgatgagcactgcggaaaccggggccccagcctgagaacaaccacagtgaccggcaagattatccacgaatggtgttgccggtcctgtacgctgcctccccttcgcttcagaggggaggacggatgctggtatggcatggagattcggccggttaaagaaaaggaggaaaatctcgtcaagagcatggtctctgctgggtccggagaggtggacagcttttccctgggcctgctctgtatctctatcatgattgaagaggttatgagaagccgctggtcccggaaaatgctgatgacagggacccttgtggtcttcctgctcctgatcatgggacagctgacatggaacgatcttattagactgtgcatcatggtgggcgccaatgcctctgaccgcatgggcatggggaccacctacctcgctctgatggccacatttaagatgagacctatgttcgcggtgggactcctgtttcggcgccttacgagcagagaggtcctgctcctgaccattggcctgtcccttgttgcttctgtggaactgcccaacagcctcgaggaactgggggatggactcgccatgggcatcatgattctgaaacttctgacagacttccaatcccatcagctctgggccaccctgctgagccttacatttatcaagaccacgttctctctgcactatgcttggaaaacaatggccatggtgctctccatcgtcagcctgtttcccctctgtctgtctaccacctcccagaagacaacctggcttcctgtgctgctggggagcctcggatgcaagccgctgacaatgttccttattgctgagaataaaatctggggccggcgctcttggcccctgaacgaaggcattatggccgttgggatcgtgtccattctcctgagctccctcctgaagaacgatgtccctcttgcgggacccctgatcgccggcgggatgctgatcgcttgttacgtgattagcggatctagcgccgacctctccctggagaaagctgccgaggtttcttgggaagaggaagccgagcatagcggcgcttcccacaatatccttgtggaagtccaggatgacgggacgatgaagattaaagatgaggagagagacgataccctgacaatcctcctgaaggcgaccctcctggccgtgtctggagtctatcctcttagcattcccgctacactgtttgtgtggtacttctggcagaagaagaagcagcggtccggcgttctgtgggacaccccttctcccccggaagtggagcgcgccgtcctcgatgacggcatctatagaatcatgcagcgggggctgcttggacgcagccaggtgggcgttggggtgttccaagaaaacgtctttcatacgatgtggcacgtgaccagaggagccgtgctgatgtaccagggcaaacggctcgagccttcctgggctagcgttaagaaagacctgatttcttacgggggaggctggagactccagggctcctggaatacaggggaggaagtccaggtgatcgccgtggagcccggaaagaaccctaaaaatgtccaaaccgcgcccggcacattcaagaccccggaaggggagattggagctatcgccctggattttaagcctggcacaagcgggtctcccattgtgaaccgcgaaggaaaaatcgttggcctttatggcaatggggtggtcacgacctccggaacatacgtgagcgccattgctcaggccaaggcgtcccaggagggccctctgcccgagatcgaagacgaggttttccggaaaagaaacctgaccatcatggatctccaccccgggtctggaaagacccgccggtatctgcctgctattgtgagagaagccatcaaacgcaaacttcggacactgattctcgccccgacgagagtcgtggctagcgagatggccgaagctctgaagggcatgcccatccgctaccaaaccacagccgttaaatccgagcataccgggaaggagattgtggacctgatgtgccacgcgacatttaccatgcggctccttagccctgtcagagtgcccaattataacatgatcatcatggatgaagcccatttcacggacccttcttccattgctgcccggggctacatcagcacacgcgtgggaatgggcgaggctgccgccatttttatgaccgctacaccccctgggtctgtcgaagcgttcccgcagagcaatgccgttatccaggatgaggaaagagacattcccgagcggtcctggaactctggatatgagtggatcacagattttcctggcaaaaccgtgtggttcgtgcccagcatcaagtccgggaatgacattgctaactgtctgcgcaaaaatggaaagagagtcatccagctgtctcggaagacatttgataccgaataccagaagacgaagaacaacgactgggactacgtggttacaaccgatattagcgagatgggcgccaatttcagagccgaccgcgtgatcgatcctcggagatgcctcaaacccgtcattctgaaggacgggccggaacgcgtgatccttgctggccctatgcccgttacagtggcctccgcggctcagcggagaggacgcattggccggaaccacaataaagagggggatcagtatatctacatgggacagcccctgaacaatgacgaggatcatgcccactggaccgaagccaagatgctcctggacaacatcaatacgcctgagggcattatccccgctctgttcgaacctgagagagaaaagagcgccgcgattgatggggagtatcgcctcagaggagaggcccggaaaacctttgtcgaacttatgcgcagaggcgacctgccggtgtggctgtcttacaaggtcgcttccgaggggttccaatatagcgatcggcgctggtgctttgacggcgaaagaaacaatcaggtgctcgaggaaaacatggatgttgagatctggacaaaagagggagaacggaagaaactgagaccccgctggcttgacgcccggacctactccgaccctctggctctcagagagttcaaggaatttgccgctggccgccggtctgtgagcggggatctgattctggagatcggaaaactcccccagcaccttacacagagagcccaaaatgcgctggacaacctggtgatgctccataattccgaacagggcgggcgggcctatcgccacgctatggaggagctgcctgataccatcgaaacacttatgctgctcgccctgattgctgtcctgaccggaggcgttacgctgttctttctttctggcagagggctgggaaagacaagcatcggcctgctctgtgtgatggcctccagcgtgctgctttggatggcctctgtcgagccccattggattgctgcgtccatcattctggagttctttctcatggtgctgctgatcccggagcctgaccggcagcgcacaccccaagataaccaactcgcctacgttgtgatcgggcttctgttcatgattctgaccgtcgctgccaatgagatgggactcctggaaaccaccaagaaagaccttggcatcgggcacgccgctgtgggaaaccaccatcacgccgcgatgctggatgtcgacctccatcctgccagcgcttggacactgtacgccgtggctacgaccattatcacacccatgatgagacacaccattgagaacacaaccgccaatatctctctgacggcgattgccaaccaggctgccatcctcatgggccttgataagggctggcctatctccaaaatggacattggggttcccctgctggctctcggatgctatagccaggtgaatccgctgacccttacagccgctgtcctgatgctcgtggcccattacgcgatcattggccctgggctgcaagccaaggctacccgggaagcccagaaacgcacagctgccggaatcatgaagaaccccaccgttgatggcattgtggccatcgacctggatcccgtcgtgtatgacgcgaagtttgagaaacagctcgggcagatcatgcttctgattctgtgtacgtctcaaatcctcctgatgagaacaacctgggctctttgcgaaagcattacactggccaccggacctctcaccacactgtgggagggctccccgggcaagttctggaatacgaccatcgctgtgtctatggccaacatttttcgggggagctacctggccggagctggcctcgccttctcccttatgaaaagcctcgggggaggccgcagagggacaggagcgcagggcgagaccctgggcgaaaagtggaaacggcagctcaatcagctgtccaagtctgagttcaacacatataagagaagcgggatcatggaagttgaccgctccgaggccaaagaaggacttaagcggggcgagaccacgaaacacgctgtctctagagggacagccaagctgcgctggtttgtggagcggaatctcgtgaaacccgaaggaaaggtcatcgatctgggctgtgggagaggaggctggagctactattgcgctggcctgaagaaagttaccgaggtgaaggggtacaccaaaggaggccctgggcacgaagaacccattcctatggccacatacggatggaacctcgtgaaacttcattccggcaaagacgtcttctttattccccctgaaaagtgtgataccctgctgtgcgacatcggggagtctagcccgaatcccacaatcgaggaaggacgcacgctccgggtgctgaaaatggttgagccttggcttagaggcaaccaattctgtattaagatcctgaatccctatatgccttccgtggtcgaaaccctcgagcagatgcagcgcaagcacggcgggatgctggtgcggaaccccctgagcagaaattctacacatgagatgtactgggtttcctgcggaaccggcaacattgtgagcgcggtcaatatgacatctcgcatgctcctgaaccggtttaccatggcccacagaaaaccgacgtatgaacgcgatgtggaccttggggctggaaccagacacgtggccgtcgagcctgaagttgctaacctggatatcatcggccagcggattgagaatatcaagcatgaacacaaatccacatggcattacgacgaggataacccctataagacctgggcctaccacgggagctatgaggtgaaaccctctggatccgctagctccatggtgaatggcgtcgtgaagctcctgacaaagccttgggacgttattcccatggtgacccaaatcgccatgacagataccacgcctttcggccagcagcgcgtctttaaagaaaaggtggacacaagaaccccgaaagcgaagcgggggaccgcccaaattatggaggttacagctaaatggctttggggattcctgagcagaaacaagaagccccggatctgtacgcgcgaagagtttaccagaaaagtgcggtctaatgccgctatcggcgccgtcttcgtggacgaaaaccagtggaatagcgccaaggaggcggttgaggatgaacgcttttgggacctcgtgcatagagagcgggaactgcacaaacaggggaagtgcgctacatgcgtctacaacatgatgggaaaacgcgagaagaagctgggcgagttcgggaaagccaagggctccagagccatttggtacatgtggctcggagctcggtttctggagttcgaggcccttggcttcatgaatgaagatcactggttttctcgcgagaacagcctgtccggggtggaaggagagggcctccataaactggggtatatccttagagacatttctaagatccctggaggcaatatgtacgctgatgacaccgccgggtgggatacacggattaccgaggacgatctgcagaacgaagcgcgcatcacagacatcatggagcccgaacacgccctcctggctaaaagcattttcaagctgacctatcaaaataaagtcgtgagagttcagcggcctgccaagaacggcacggtgatggatgtcatctcccgcagagaccagcggggatctggccaggtggggacctacggactcaatacatttaccaacatggaggctcaactgattagacagatggaaagcgagggcatcttctcccccagcgagcttgaaacaccgaacctggccgagcgcgtgctcgattggctggaaaagtatggggttgagcggcttaaaagaatggcgatttctggagacgactgtgtggtcaagcctatcgatgaccgctttgccaccgctctgacggccctcaatgatatgggcaaagtgcggaaggacatcccccagtgggaaccttccaaagggtggaacgattggcagcaagttcccttctgcagccatcactttcaccagctgattatgaaggacggcagagagatcgtggtcccttgtcgcaatcaggatgagctggtgggacgggctagagtctctcagggcgccgggtggtccctccgcgaaacagcttgcctgggaaagagctacgcccaaatgtggcagcttatgtatttccatcggagagacctgcgcctcgcggccaacgctatttgttccgccgtgcccgttgattggatcccgacctctcggacaacctggagcattcacgcccatcaccagtggatgacgaccgaggacatgctgtccgtgtggaatagagtctggatcgaagagaacccttggatggaagataaaacacatattagctcttggggcgacgtgccctaccttgggaagcgggaggaccaatggtgcggatccctgatcggcctcaccgctagagccacatgggcgaccaatatccaggttgctattaaccaggtgcgccggctgatcgggaatgagaactacctggattatatgacaagcatgaaaagatttaagaatgaatctgaccccgagggcgccctctggtga

SEQ ID NO: 19247 - RNA, 9879 nt, synthetic construct
  misc_feature 1..9879: note = derived and/or modified CDS sequence (opt5) from DENV-1__JF937618__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggagctctgtgaagatacaatgacctacaaatgccccagaatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaggacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccgtttctggagtgtatcctctgagcatccccgctaccctttttgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtcttccaagaaaacgtgtttcataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctcgcaatgtccaaacaacccccggcacattcaaaacgccggaaggggaggtgggagcgattgctctcgattttaagcctggcaccagcgggtctcccatcgtgaaccgggaaggaaagatcgtcggcctgtatggcaatggggtggttacaacctccggaacctacgtgagcgccattgcccaggctaaagcctcccaggagggccctcttcccgagatcgaagacgaggtcttcagaaagcgcaacctgacaattatggatctgcaccccgggtctggaaaaacgcggagatatctccctgcgatcgtgcgcgaagctattaagcggaaactgagaacccttatcctggccccgacacgcgttgtggccagcgagatggctgaagccctcaagggcatgcccatccggtaccaaaccacagctgtcaagtccgagcataccgggaaagagattgtggacctgatgtgccacgccacgtttacaatgagactgctcagccctgttcgggtgcccaattataacatgatcattatggatgaagcgcatttcaccgacccttcttccatcgccgctcgcggctacattagcaccagagtcggaatgggcgaggccgctgccatctttatgacagccacaccccctgggtctgtggaggctttcccgcagagcaatgcggtgatccaggatgaggaacgggacattcccgagcgctcctggaactctggatatgagtggatcacagattttcctggcaagaccgtctggttcgttcccagcattaaatccgggaatgacatcgccaactgtcttagaaagaatggaaaacgggtgattcagctgtctagaaagacgtttgatacagaataccaaaagaccaaaaacaacgactgggactacgtggtcacaaccgatatcagcgagatgggcgctaatttccgcgccgaccgggtgattgatcctagacgctgcctgaagcccgttatcctcaaagacgggccggaacgggtgatcctggccggccctatgcccgtcacggtggcttccgccgcgcagagacgcggacggattggcagaaaccacaataaggagggggatcagtatatctacatgggacagccccttaacaatgacgaggatcatgctcactggaccgaagccaaaatgctgctcgacaacattaatacacctgagggcatcattcccgccctgttcgaacctgagcgcgaaaagagcgctgccatcgatggggagtatagactgcggggagaggcgcgcaagacctttgttgaactcatgagacggggcgaccttccggtgtggctgtcttacaaagtcgcctccgaggggttccaatatagcgatcgcagatggtgctttgacggcgaacggaacaatcaggtgctggaggaaaacatggatgtcgagatctggacaaaggagggagaacgcaaaaagctccgcccccggtggctggacgctagaacctactccgaccctcttgccctgcgcgagttcaaagaatttgctgccggccggagatctgtgagcggggatctcattctggagatcggaaagctgccccagcacctcacacagcgggctcaaaatgcccttgacaacctggttatgctgcataattccgaacagggcgggcgcgcgtatagacacgccatggaggagctccctgataccattgaaacgctgatgcttctggctctcatcgccgtgctgacaggaggcgtgaccctgttctttctctctggccgggggcttggaaaaaccagcattggcctgctgtgtgtcatggcttccagcgttctcctgtggacagcctctgtggagccccattggatcgccgcttccatcattcttgagttctttctgatggtgctcctgatcccggagcctgaccgccagagaacaccccaggataaccaactggcgtacgtcgtgattgggctccttttcatgatcctgacagttgccgctaatgagatgggactgctcgaaacgaccaagaaggacctgggcattgggcacgtggccgtcggaaaccaccatcacgccgctatgcttgatgtggacctgcatcctgccagcgcgtggacactctacgccgtcgctaccacaatcattacccccatgatgcggcacacgatcgagaacaccacagccaatatctctctgaccgctattgccaaccaggcggccatcctgatgggcctcgataaaggctggcctatttccaagatggacatcggggtgccccttctggctctgggatgctatagccaggttaatccgctcacactgaccgccgctgtgcttatgctggtcgcccattacgctattatcggccctgggctccaagccaaagcgacgcgcgaagcccagaagagaacagctgccggaatcatgaaaaaccccaccgtggatggcattgttgctatcgacctggatcccgtggtctatgacgccaagtttgagaagcagctggggcagattatgctccttatcctgtgtacatctcaaattctgctcatgcggaccacctgggccctgtgcgaaagcatcacacttgcgacgggacctctgaccacactctgggagggctccccgggcaaattctggaataccacaatcgctgtgtctatggccaacatttttcgcgggagctacctggctggagccggcctggccttctccctcatgaaaagccttgggggaggcagacgggggaccggagctcagggcgagacgctgggcgaaaaatggaagagacagctgaatcagctctccaaatctgagttcaacacatataagcgcagcgggatcatggaagtggaccggtccgaggccaaggaaggactgaaaagaggcgagaccaccaagcacgcggtttctcgcgggacagccaaacttcggtggtttgtcgagagaaatctggtgaagcccgaaggaaaagtgattgatctcggctgtgggcgcggaggctggagctactattgcgctggcctgaagaaggtcaccgaggttaaagggtacacaaagggaggccctgggcacgaagaacccatccctatggccacgtacggatggaacctggtgaaactccattccggcaaggacgtgttctttattccccctgaaaaatgtgatacccttctgtgcgacatcggggagtctagcccgaatcccacaattgaggaaggacggaccctgagagtcctcaagatggtggagccttggctgcgcggcaaccaattctgtatcaaaatccttaatccctatatgccttccgttgtggaaacactggagcagatgcagcggaagcacggcgggatgctcgtcagaaaccccctgagccgcaattctacccatgagatgtactgggtgtcctgcggaacgggcaacattgttagcgctgtgaatatgacctctcggatgctgctcaacagatttacaatggcccaccgcaagccgacctatgaaagagatgtcgacctgggggcgggaacacggcacgtggccgtggagcctgaagtcgctaaccttgatatcattggccagcgcatcgagaatattaaacatgaacacaagtccacctggcattacgacgaggataacccctataaaacatgggcctaccacgggagctatgaggttaagccctctggatccgctagctccatggtgaatggcgtggtcaaactgctcaccaagccttgggacgtgatccccatggttacgcaaatcgccatgacagataccacccctttcggccagcagagagtgtttaaggaaaaagtcgacacacggacgccgaaggctaaaagagggaccgcccaaattatggaggtgacagcgaagtggctgtggggattccttagccggaacaaaaagccccgcatctgtaccagagaagagtttacacggaaggttcgctctaatgccgctattggcgccgtgttcgtcgacgaaaaccagtggaatagcgctaaagaggccgtggaggatgaaagattttgggacctggttcatcgggagcgcgaactccacaagcaggggaaatgcgcgacctgcgtgtacaacatgatgggaaagagagagaaaaagctgggcgagttcgggaaggcgaaaggctcccgggctatctggtacatgtggctgggagcccgctttctcgagttcgaggccctgggcttcatgaatgaagatcactggttttctagagagaacagcctttccggggtcgaaggagagggcctgcataagctcgggtatattctgcgggacatctctaaaatccctggaggcaatatgtacgctgatgacacagccgggtgggatacccgcattacggaggacgatcttcagaacgaagctagaatcaccgacattatggagcccgaacacgccctgctcgccaagagcatcttcaaactgacatatcaaaataaggtggtccgggtgcagcgccctgccaaaaacggcaccgttatggatgtgatttccagacgggaccagagaggatctggccaggtcgggacatacggactgaatacctttacgaacatggaggctcaactcatccgccagatggaaagcgagggcatcttctcccccagcgagctggaaacaccgaaccttgccgagcgggtgctggattggctcgaaaagtatggggtggagagactgaagcgcatggctatttctggagacgactgtgttgtgaaacctatcgatgaccggtttgccaccgcgcttacagccctgaatgatatgggcaaggtcagaaaagacattccccagtgggaaccttccaaggggtggaacgattggcagcaagtgcccttctgcagccatcactttcaccagctcatcatgaaagacggccgcgagattgttgtgccttgtcggaatcaggatgagctggtcggcagagctcgcgtgtctcagggcgccgggtggtccctgcgggaaaccgcttgcctcggaaagagctacgcccaaatgtggcagctgatgtatttccatagacgcgaccttcggctggctgccaacgcgatctgttccgccgtccccgtggattggattccgacgtctagaaccacatggagcatccacgctcatcaccagtggatgaccacagaggacatgctctccgtttggaatcgggtgtggatcgaagagaacccttggatggaagataagacccatattagctcttggggcgacgtcccctacctggggaaaagagaggaccaatggtgcggatcccttatcggcctgacagcccgcgccacctgggctacgaatattcaggtggccatcaaccaggttcggagactcattgggaatgagaactacctggattatatgacaagcatgaagcgctttaaaaatgaatctgaccccgagggcgcgctgtggtga

SEQ ID NO: 19248 - RNA, 9879 nt, synthetic construct
  misc_feature 1..9879: note = derived and/or modified CDS sequence (opt5) from DENV-1__JF937619__SS-prME
  source 1..9879: mol_type = other RNA
agcgtgaccatgctgctcatgctgatgcccacggcccttgctttccacctgacgaccagaggaggggagcctcatatgatcgtgtccaagcaggaacggggaaagtctctcctgtttaagaccagcgccggcgttaacatgtgcacccttattgcgatggacctgggggagctctgtgaagatacaatgacctacaagtgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgactccggatgcgttatcaactggaaaggccgcgagctgaagtgtgggagcggaattttcgtgaccaatgaagtccacacatggaccgagcaatataagtttcaggccgattcccctaaacggctctctgcggccatcggcaaggcttgggaggaaggggtgtgcggcattagaagcgccacgcgcctggagaacatcatgtggaaacagatctccaacgaacttaatcatattctgctcgagaacgacatgaagttcacagttgtggtcggagacgtggctggcatcctggtgcaggggaaaaagatgattcggccgcaacccatggaatacaaatattcttggaaaagctggggaaaggccaaaatcattggcgccgatgtccaaaattccacctttatcatcgacgggcctaacacccccgagtgtcctgatgaccagagagcttggaatatttgggaggttgaagattacggattcggcatctttacaaccaacatttggctgaaacttcgcgacagctatacacaggtgtgcgatcaccggctcatgtctgcggccatcaaagactccaaggctgtgcacgccgatatgggctactggattgagagcgagaagaatgagacatggaagctggccagagcttctttcatcgaagtcaagacctgtatctggcccaaatcccatacactgtggagcaacggggtgctcgagtctgagatgattatcccgaagattcacggaggccctatcagccaacataattatcgccccgggtacttcacccagacagccggaccttggcacctgggcaaacttgaactggactttgatctctgcgaggggaccacggttgtggtcgacgaacactgcggaaaccggggcccctccctgagaaccacaaccgtgacaggcaagattatccatgagtggtgttgccggagctgtaccctgcctccccttcgcttcagaggggaggatggatgctggtacggcatggaaatccggccggttaaagagaaggaagagaatctcgtgaagtctatggtctccgcggggagcggagaagtggactccttttctctgggcctgctctgtattagcatcatgattgaggaggttatgagatcccgctggtctcggaaaatgctgatgacggggacacttgctgtgttctttctgctcatcatgggacagctgacctggaacgacctgattagactttgcatcatggtcggcgccaatgccagcgatcgcatgggcatggggacaacctatctggctctcatggtgaccttcaagatgagacctatgtttgccgtgggactgctgttccggcgcctgacatccagagaagtccttctgctcacgattggcctgtctctggttgcgagcgtggagcttcccaactccctggaagaactgggggacggactggctatgggcatcatgatcctcaaactgcttaccgattttcaaagctaccagctgtgggccacactcctgtctctgaccttcattaagacaaccttttcccttcactatgcctggaaaacgatggctatggtgctgagcatcgtctctctcttccccctgtgtctctccacaaccagccagaagaccacatggctgcctgtgcttctggggtctctgggatgcaagccgctcaccatgtttctgattgccgaaaataaaatctggggccggaagtcctggccccttaacgagggcattatggctgttgggatcgtgagcatcctgctctccagcctgctcaaaaacgacgtccctctggccggaccccttattgcgggcgggatgctgatcgcctgttacgtgatttctggaagctccgctgatctgtctctcgagaaggccgctgaagttagctgggaggaagaggccgaacattccggcgcctctcacaatatcctggtggaggtccaggacgatgggacaatgaaaattaaggacgaggaacgcgatgacacgcttaccatcctgctcaaagctacactgctcgcggtgagcggagtctatcctctgtccatccccgccacccttttcgtgtggcatttctggcaaaagaagaaacagagatctggcgttctgtgggatacacctagccctcccgaggtggaacgggctgtcctggacgatggcatttaccgcatcatgcagagagggctcctgggacggtcccaggtgggcgttggggtgtttcaagagaacgtcttccacaccatgtggcacgtgacgcgcggagccgtgcttatgtatcagggcaagagactggagcccagctgggcctctgttaaaaaggacctcatttcctacgggggaggctggcggtttcagggcagctggaataccggggaagaggtccaggtgatcgctgtggaacccggcaagaaccctaagaatgtccaaacagcccccggcaccttcaagacaccggagggggaagtgggagcgattgctctggactttaaacctggcacctctgggtcccccatcgttaacagagagggaaagattgtgggcctctacggcaatggggtcgtgacaacgagcggaacctatgtttccgccatcgcccaggctaaagcctctcaggagggccctctgcccgaaatcgaggatgaagtgttccgcaagcggaaccttacaattatggacctgcatcccgggagcggaaaaaccagacgctacctgcctgcgatcgtccgggaggctattaagagaaagctccgcaccctgatccttgccccgacacgggtggttgcctccgaaatggctgaggccctgaaaggcatgcccattagatatcaaacgaccgctgtcaagagcgagcacacagggaaagaaatcgtcgatctcatgtgccatgccacctttacaatgcgcctgctgtctcctgtgcgggtgcccaattacaacatgatcattatggacgaggcgcacttcaccgatccttccagcatcgccgctagaggctatatttctacgcgggtcggaatgggcgaagccgctgccatctttatgacagccacaccccctgggagcatggaggctttcccgcagtccaatgcggttattcaggacgaagaacgcgatatccccgagagatcttggaacagcggatacgaatggatcaccgactttcctggcaagacagtgtggttcgtgccctccattaaagccgggaatgatatcgctaactgtctccggaagaatggaaagcgcgtcattcagctttctagaaaaaccttcgacacagagtatcaaaagaaaaagaacaacgattgggactacgtggttaccacggacatcagcgaaatgggcgccaattttcgggccgatagagtgattgaccctcgccggtgcctgaaacccgtcatcctgaaggatgggccggagagagtgattctcgctggccctatgcccgttacagtggcctccgcggctcagcgccggggaagaatcggccgcaaccataataaggagggggaccagtacatctatatgggacagcccctgaacaatgatgaagaccacgcccactggaccgaggccaaaatgcttctggataacattaatacacctgaaggcatcattcccgctctcttcgagcctgaacgggaaaagagcgccgcgatcgacggggagtacagactgcgcggagaagccagaaaaacctttgtcgagctgatgcggcgcggcgatctcccggtgtggctttcttataaggtcgcttccgaagggttccaatacagcgacagacggtggtgctttgatggcgagcgcaacaatcaggtgctggaagagaacatggacgttgagatttggacgaaagaaggagagagaaagaaactgcggcccagatggctcgatgcccgcacctattccgaccctctggcccttcgggagttcaaggagtttgccgctggcagacgctctgtgagcggggacctgatcctcgaaatcggaaagctgccccagcatctgacacagcgggcccaaaatgcgctcgataaccttgtgatgctgcacaattccgagcagggcgggagagcctaccggcatgctatggaggaactgcctgacaccattgagacactcatgctgcttgccctgatcgctgtcctcaccggaggcgttacactgttctttctgtctggcaaagggctcggaaagaccagcattggccttctgtgtgtgatggcctccagcgtgctgctctggatggcctctgtcgaaccccactggatcgctgcgtccattatcctggagttctttcttatggtgctgctcatcccggagcctgatcgccagagaacgccccaggacaaccaactggcctatgttgtgattgggctcctcttcatgatccttacagtcgctgccaatgaaatgggactgctggagaccaccaaaaaggatctcggcattgggcacgtggccgtcgaaaaccatcaccatgctgccatgctggacgtggatcttcaccctgcgagcgcctggacactgtacgctgttgccaccacaatcattacgcccatgatgcggcataccatcgagaacacaaccgctaatatttctctcacagccatcgcgaaccaggccgctatcctgatgggactggacaaaggctggcctatttccaagatggatatcggcgtgcccctccttgccctggggtgctacagccaggtcaatccgctgaccctcacggctgccgtgctgatgcttgttgctcactatgccattatcggacctggcctgcaagcgaaggccacccgcgaagctcagaaaagaacagccgctgggattatgaagaaccccaccatcgacggaatcgtggccattgatctcgaccccgtcatctacgatgccaaatttgagaagcagctgggccagattatgctgctcatcctttgtacatctcaaattctgctgatgcggaccacgtgggcgctctgcgagagcatcacactggctaccgggcctcttacaaccctgtgggaaggatccccgggcaaattctggaataccacaatcgccgtgtctatggctaacattttccgcggcagctatctcgccggggccggactggctttttccctgatgaaaagcctcggcgggggaagacggggcacgggggcccagggagagacccttggcgaaaagtggaaacgccagctgaatcagctgtccaagtctgagttcaacacatacaaaagaagcggcatcatggaagtggaccggtccgaggcgaaggaggggctcaaaagaggagaaaccacaaagcacgccgtttctcgcggcaccgctaagctgcggtggtttgtcgagagaaatcttgtgaaacccgaagggaaggtgattgacctgggatgtggccgcgggggatggagctattactgcgccggcctcaaaaaggtcacggaggttaaaggctatacaaaagggggacctggccatgaggaacccatccctatggctacctacgggtggaacctggtgaaactgcactccggaaaggatgtgttctttattccccctgagaagtgtgacaccctcctttgcgatatcggcgaatctagcccgaatcccacaattgaggaagggcggaccctgagagtcctgaaaatggtggagccttggctccgcggaaaccaattctgtatcaagatcctgaatccctacatgccttccgttgtggagacacttgaacagatgcagcggaaacatggcggcatgctggtcagaaaccccctcagccgcaattctacgcacgagatgtattgggtgtcctgcgggaccggaaacattgttagcgccgtgaatatgacatctcggatgctgctgaacagatttaccatggcgcaccgcaagccgacatacgaacgggacgtcgatctcggcgccgggaccagacatgtggctgtggagcctgaagtcgccaacctggacatcattggacagcgcatcgagaatattaaacacgagcataagtccacgtggcactatgatgaagacaacccctacaagacctgggcttatcatggcagctacgaggttaaaccctctgggtccgccagctccatggtgaatggagtggtcaaacttctgacaaaaccttgggatgtgatccccatggttacccaaatcgctatgacagacaccacacctttcggccagcagagagtgtttaaggaaaaagtcgatacccggacgccgaaggccaagcgcggcacagcgcaaattatggaggtgaccgccagatggctctgggggttcctgagccggaacaaaaagcccagaatctgtacccgggaagagtttacacgcaaagttagatctaatgctgccattggagctgtgttcgtcgacgagaaccagtggaatagcgccaaggaagccgtggaggacgatcggttttgggaccttgttcaccgcgaaagagagctgcacaaacagggcaagtgcgcgacgtgcgtgtataacatgatggggaagcgggagaagaagctcggagagttcggcaaagctaaggggtcccgcgccatctggtacatgtggctgggcgccagattcctggagtttgaagctctcggattcatgaatgaggatcattggttttctcgggaaaacagcctgtccggcgtcgagggggagggacttcacaaactgggctacattctccgcgacatctctaagatccctgggggaaatatgtatgccgatgacaccgctggctgggatacaagaattaccgaagacgatctgcagaacgaggccaaaatcacagacattatggaacccgagcatgcgcttctggccaagagcatcttcaagctcacctaccaaaataaagtggtccgggtgcagcgccctgctaagaacgggacagttatggatgtgatttccagacgggaccagcgcggctctggacaggtcggcacctatgggctgaatacgtttaccaacatggaagcccaactgatcagacagatggagagcgagggaatcttcctccccaacgaactggagacaccgaatcttgctggccgggtgctggattggctcgaaaaatacggggtggagagactgaagcgcatggccatttccggagacgactgtgttgtgaaacctatcgatgaccggtttgcgaccgcccttacagctctgaacgatatgggcaaggtcagaaaggacattccccagtgggaacctagcaaagggtggaatgattggcagcaagtgcccttctgctctcaccactttcatcagctcatcatgaaggacggccgcgagattgttgtgccttgtcggaaccaggatgagctggtcggcagagctcgcgtgtcccagggagctgggtggagcctgcgggaaaccgcctgcctcggaaaatcttatgctcaaatgtggcagctgatgtacttccacagacgcgaccttcggctggccgcgaatgccatctgttccgctgtccccgtggattgggttccgacgagcagaacaacctggtccattcatgcccaccatcagtggatgacaaccgaggacatgctctctgtgtggaaccgcgtctggatcgaagagaatccttggatggaagataagacgcggatcagctcctgggaggacgtgccctatctgggcaaaagagaggaccaatggtgcgggagccttattggactgaccgcccgggctacatgggccaccaacatccaggttgcgattaatcaggtgagacgcctcatcggcaacgaaaattactctgattacatgacatccatgaagcggtttaagaacgagagcgaacccgagggggctctgtggtga

SEQ ID NO: 19249 - RNA, 9879 nt, synthetic construct
  misc_feature 1..9879: note = derived and/or modified CDS sequence (opt5) from DENV-1__GU131827__SS-prME
  source 1..9879: mol_type = other RNA
agcgtgaccatgctgctcatgctgatgcccaccgcccttgctttccacctgacgaccagaggaggggaacctcatatgattgtgtccaagcaggaacggggaaaatctctcctgtttaagacaagcgccggcgttaacatgtgcacccttattgcgatggacctgggggagctctgtgaagatacaatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcagaaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgctattaactggaagggccgggaactgaaatgtgggagcggaatcttcgttacaaatgaggtgcacacctggacggaacaatataagtttcaggccgactcccctaagagactgtctgcggccattggcaaggcttgggaggagggggtctgcggcatccgcagcgccacacggctcgaaaacatcatgtggaagcagatttccaacgagctgaatcatatccttctggaaaacgacatgaaattcaccgtggttgtgggagatgtcgctggcattctcgcccaggggaagaaaatgatcagaccgcaacccatggagtacaagtattcttggaaaagctggggaaaggccaagattatcggcgctgacgtgcagaataccacatttatcattgatgggcctaacacccccgaatgtcctgacgatcagcgcgcgtggaatatctgggaggtggaggactacggattcggcatttttacgacaaacatctggctgaaactgcgggattcctatacccaggtctgcgaccacagacttatgagcgccgctattaaggattctaaagccgttcacgccgacatgggctactggatcgaatccgagaagaatgaaacatggaaactcgctcgcgccagcttcatcgaggtgaagacctgtatttggcccaagtctcatacactgtggtccaacggggtgctggaaagcgagatgatcattccgaaaatctatggaggccctatttctcaacacaattaccggcccgggtacttcacccagacggcgggaccttggcatctcggcaagctggagcttgattttgacctgtgcgaagggaccacagtcgtggttgatgagcactgcggaaacagaggccccagcctccggaccacaaccgtgacgggcaaaatcatccacgaatggtgttgccgctcctgtacactgcctcccctgagattcagaggggaagacggatgctggtatggcatggagattcggccggtcaaggaaaaagaggaaaatcttgtgaaaagcatggtttctgctgggtccggagaggtggacagcttttccctcggcctgctgtgtatctctattatgatcgaagaggtcatgcgcagccggtggtccagaaagatgctcatgaccgggacactggccgtgttctttcttctgattatgggacagctcacctggaacgatctgatccgcctgtgcattatggttggcgccaatgcttctgacagaatgggcatggggaccacataccttgccctgatggcgacgttcaaaatgcggcctatgtttgctgtgggactcctgttccgcagactcaccagccgggaggtcctgcttctgacaatcggcctctccctggtggcctctgtggaactgcccaacagccttgaggaactgggggatggactcgccatgggcatcatgattctgaagctcctgaccgactttcaatcccatcagctttgggctacactgctcagcctgaccttcatcaaaacgacattttctctgcactatgcctggaagaccatggctatggtcctttccattgttagcctgttccccctctgtctgtctaccacatcccagaaaaccacatggctccctgtgctgcttgggagcctgggatgcaagccgctgacgatgtttctcatcgccgagaataagatttggggccgcagatcttggcccctgaacgaaggcatcatggcggtggggatcgtctccattcttctgagctccctcctgaaaaacgatgtgcctctcgccggacccctgatcgctggcgggatgcttattgcctgttacgttatcagcggatctagcgctgacctgtccctggagaaggccgccgaggtgtcttgggaagaggaagctgagcatagcggcgcgtcccacaatattctcgtcgaagtgcaggatgacgggaccatgaaaatcaaggatgaggagcgggacgatacactgaccatccttctgaaagccacactcctggctgtttctggagtgtatcctctcagcattcccgccaccctgttcgtctggtacttctggcaaaagaaaaagcagcgctccggcgtgctttgggacacgccttctcccccggaagtcgagagagccgtgctggatgacggcatctatcggattatgcagcgcgggctgctcggaagaagccaggttggcgtgggggtctttcaagaaaacgtgttccataccatgtggcacgttacacggggagctgtgctgatgtaccagggcaagagacttgagccttcctgggccagcgtcaaaaaggacctgatctcttacgggggaggctggcgcctccagggctcctggaataccggggaggaagtccaggtgattgcggttgagcccggcaagaaccctaagaatgtccaaacagctcccggcacctttaaaacaccggaaggggaggtgggagccatcgccctggatttcaagcctggcacgagcgggtctcccattgtgaaccgggaaggaaagatcgtcggcctctatggcaatggggtggttaccacatccggaacctacgtgagcgctatcgcccaggcgaaggcttcccaggagggccctctgcccgagattgaagacgaggtctttagaaagcgcaaccttaccatcatggatctgcaccccgggtctggaaaaacacggagatatctgcctgccattgtgcgcgaagccatcaagcggaaactcagaacgctgattcttgctccgacccgcgttgtggccagcgagatggctgaagccctgaagggcatgcccatccggtaccaaacaaccgcggtcaagtccgagcatacagggaaagagatcgtggacctcatgtgccacgccaccttcacgatgagactgctgagccctgttcgggtgcccaattataacatgattatcatggatgaagctcattttacagacccttcttccattgccgctcgcggctacatcagcaccagagtcggaatgggcgaggccgccgctattttcatgaccgcgacaccccctgggtctgtggaagcctttccgcagagcaatgctgtgatccaggatgaggaacgggacatccccgagcgctcctggaactctggatatgagtggattaccgatttccctggcaagacagtctggtttgttcccagcatcaaatccgggaatgacattgccaactgtctcagaaagaatggaaaacgggtgatccagctttctagaaagaccttcgatacggaataccaaaagaccaaaaacaacgactgggactacgtggtcaccacagatattagcgagatgggcgccaatttccgcgctgaccgggtgatcgatcctagacgctgcctgaagcccgttattctgaaagacgggccggaacgggtgatcctcgccggccctatgcccgtcaccgtggcgtccgctgcccagagacgcggacggatcggcagaaaccacaataaggagggggatcagtatatttacatgggacagcccctgaacaatgacgaggatcatgcccactggacggaagctaaaatgcttctggacaacatcaatacccctgagggcattgttcccgccctctttgaacctgagcgcgaaaagagcgcggccatcgatggggagtatagactgcggggagaggctcgcaagacattcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatttggaccaaggagggagaacgcaaaaagctgcgcccccggtggctcgacgctagaacatactccgaccctctggcccttcgcgagtttaaagagttcgctgccggccggagatctgttagcggggatctgatcctcgagatcggaaagctgccccagcacctgacccagcgggcgcaaaatgccctcgacaaccttgtgatgctgcataattccgaacagggcgggcgcgcttatagacacgccatggaggagctgcctgatacaattgaaaccctcatgctgcttgctctgatcgccgtgctcacgggaggcgtcacactgtttttcctgtctggccgggggctcggaaaaaccagcattggccttctgtgtgttatggcctccagcgtgctgctctggatggcttctgtggagccccattggatcgcggcctccattatcctggaatttttccttatggtcctgctcatcccggagcctgaccgccagagaacaccccaggataaccaactggcttacgtggttattgggctgctctttatgatccttacagtggccgccaatgagatgggactgctggaaaccacaaagaaggacctcggcattgggcacgtcgctgtggagaaccaccatcacgccgcgatgctggatgtcgaccttcatcctgccagcgcttggacgctgtacgccgtggctaccacaatcattacccccatgatgcggcacacaatcgaaaacaccacggccaatatttctctcaccgcgatcgccaaccaggctgccatcctgatgggactggataaaggctggcctatttccaagatggacatcggcgttcccctccttgctctggggtgctatagccaggtgaatccgctgacactcaccgccgctgtcctgatgcttgtggcccattacgcgattatcggacctggcctgcaagccaaagctacacgcgaggcccagaagagaaccgctgccgggattatgaaaaaccccacggttgatggaatcgtggccatcgacctcgatcccgtcgtgtatgacgcgaagttcgaaaagcagctgggccagattatgctgctcatcctttgtacatctcaaattctgctgatgcggaccacatgggctctctgcgagagcatcaccctggccaccgggcctcttacaacgctgtgggagggatccccgggcaaattttggaataccacaattgctgtgtctatggccaacatcttccgcggcagctacctcgccggggctggactggccttctccctgatgaaaagcctcggcgggggaagacggggcaccggggcgcagggagaaacacttggcgagaaatggaagagacagctgaatcagctgtccaaatctgaatttaacacctataagcgcagcggcatcatggaggttgaccggtccgaagccaaggaggggctcaaaagaggagagacgacaaagcacgctgtctctcgcggcaccgccaaactgcggtggttcgtggaaagaaatcttgtgaagcccgaggggaaagtcattgatctgggatgtggccgcgggggatggagctactattgcgctggcctcaagaaggttaccgaagtgaaaggctacacaaaaggcgggcctgggcacgaggaacccatccctatggccacctacgggtggaacctggtgaaactgcattccggaaaggacgtctttttcattccccctgagaaatgtgatacactcctttgcgacatcggcgagtctagcccgaatcccacgattgaagaggggcggaccctgagagtgctgaagatggttgaaccttggctccgcggaaaccaattttgtatcaaaattctgaatccctatatgccttccgtggtcgagacacttgagcagatgcagcggaagcacggcggcatgctggtgagaaaccccctcagccgcaattctacccatgaaatgtactgggtttcctgcgggacaggaaacatcgtgagcgcggtcaatatgacctctcggatgctgctgaacagattcacgatggcccaccgcaagccgacctatgagagagatgtggacctcggcgctgggacacggcacgtggccgtcgaacctgaggttgctaacctggatatcattggacagcgcatcgaaaatattaaacatgagcacaagtccacctggcattacgacgaggataacccctataaaacatgggcctaccacggcagctatgaagtgaagccctctgggtccgctagctccatggtgaatggagtcgtgaaacttctgaccaagccttgggacgttatccccatggtgacacaaattgccatgaccgatacgacaccttttggccagcagagagtcttcaaggagaaagtggacacccggaccccgaaggcgaaaagaggcacagcccaaatcatggaagttacggctaagtggctctgggggtttctgagccggaacaaaaagccccgcatctgtaccagagaggagttcacacggaaggtgcgctctaatgccgctattggagccgtctttgtggacgagaaccagtggaatagcgccaaagaggcggttgaagatgagagattctgggaccttgtgcatcgggaacgcgagctgcacaagcagggcaaatgcgctacctgcgtctacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtggagggggagggacttcataagctgggctatattctccgggacatctctaaaattcctgggggaaatatgtacgctgatgacacagccggctgggatacccgcatcacagaagacgatctgcagaacgaggcgagaatcaccgacattatggaacccgagcacgcccttctggctaagagcatctttaaactcacgtatcaaaataaggtcgtgcgggttcagcgccctgccaaaaacgggaccgtgatggatgtcatttccagacgggaccagagaggctctggacaggtgggcacatacgggctgaataccttcacaaacatggaagctcaactgatccgccagatggagagcgagggaatcttttcccccagcgaactcgagaccccgaacctggccgaacgggtgcttgattggctggagaagtatggcgttgaaagactcaagcgcatggcgatctctggggacgactgtgtggtcaaacctatcgatgaccggttcgccacggctctgacagcccttaatgatatgggaaaggtgagaaaagacattccccagtgggagccttccaagggctggaacgattggcagcaagttcccttttgcagccatcacttccaccagctgatcatgaaagacgggcgcgagattgtggtcccttgtcggaatcaggatgaactcgtgggcagagctcgcgtctctcagggagccggctggtccctgcgggagaccgcttgcctgggaaagagctacgcccaaatgtggcagctcatgtattttcatagacgcgacctgcggcttgcggccaacgctatctgttccgccgtgcccgttgattggattccgacatctagaaccacgtggagcatccacgcccatcaccagtggatgaccacagaagacatgctgtccgtgtggaatcgggtctggattgaggaaaacccttggatggaggataagacccatatcagctcttggggagacgtgccctacctcggcaaaagagaggaccaatggtgcgggtccctgatcggacttacagctcgcgccacctgggcgacaaatattcaggttgctatcaaccaggtgcggagactgattggcaatgaaaactacctcgattatatgaccagcatgaagcgcttcaaaaatgagtctgaccccgaaggggccctgtggtga

SEQ ID NO: 19250 - RNA, 9879 nt, synthetic construct
  misc_feature 1..9879: note = derived and/or modified CDS sequence (opt5) from DENV-1__GU131831__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggattagctatgtgatgtgtaccggctctttcaaactcgagaaggaactggctgagacccagcacggaacagtcctggtgcagatcaagtacgagggcaccgacgccccgtgcaaaatccctttctccacacaagatgaaaagggggttacgcagaacggacggcttattaccgcgaatcccatcgtgacagacaaagagaagcctgtcaacattgaagctgagccgccctttggcgagagctatatcgtgattggggccggagaaaaagccctcaagctgtcttggttcaagaaaggcagctccatcgggaagatgtttgaggctaccgccagaggcgctcgccggatggccatcctgggagatacagcgtgggacttcggctctattgggggagtgtttaccagcgttggcaaactcgtccatcagatcttcgggacggcctacggagtgctgttttccggcgtgagctggaccatgaagattgggatcggcgtccttctgacatggctcggactcaattctagatccaccagcctgtctatgacatgtattgctgtgggccttgttaccctctacctgggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctctctgccgcgatcggcaaggcctgggaggagggggtctgcggcatcagaagcgctacacgcctggaaaacattatgtggaaacagatctccaacgagcttaatcatattctgctcgaaaacgacatgaagttcaccgtggttgtgggagatgtcgccggcatcctggctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgattcctatacccaggtctgcgaccaccggctcatgagcgcggccatcaaagattctaaggctgttcacgccgacatgggctactggatcgaatccgagaaaaatgaaacatggaagctggccagagctagcttcattgaggtgaagacctgtatctggcccaaatctcatacactgtggtccaacggggtgctcgaaagcgagatgattatcccgaagatttatggaggccctatctctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcattcacgaatggtgttgccggtcctgtacactgcctccccttcgcttcagaggggaggacggatgctggtatggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgaccgggacacttgctgtgttctttctgctcatcatgggacagctgacctggaacgatctgattagactttgcatcatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcattatgatcctcaaactgcttaccgactttcaatcccatcagctgtgggccacactcctgagcctgaccttcattaagacgacattttctcttcactatgcttggaaaaccatggccatgatcctgtccattgtcagcctcttccccctgtgtctctctaccacatcccagaagaccacatggctgcctgttcttctggggagcctgggatgcaagccgctcacgatgtttctgatcgctgagaataaaatctggggccggcgctcttggccccttaacgaaggcattatggccgtggggatcgtgtccattctgctcagctccctgctcaagaacgatgtccctctggcgggaccccttatcgccggcgggatgctgattgcttgttacgtgatcagcggatctagcgccgacctgtccctcgagaaagctgccgaggtttcttgggaagaggaagccgagcatagcggcgcttcccacaatatcctggtggaagtccaggatgacgggaccatgaagattaaagatgaggagagagacgatacacttaccatcctgctcaaggcgacactgctcgccgtgtctggagtttatcctctgagcattcccgctacccttttcgtgtggtacttctggcagaagaagaagcagcggtccggcgtcctgtgggacacgccttctcccccggaagtggagcgcgccgtcctggatgacggcatctatagaattatgcagcgggggctcctgggacgcagccaggtgggcgttggggtgtttcaagaaaacgtcttccataccatgtggcacgtgacaagaggagccgttcttatgtaccagggcaaacggctggagccttcctgggctagcgtgaagaaagacctcatctcttacgggggaggctggagactgcagggctcctggaataccggggaggaagtccaggtgattgccgtggagcccggaaagaaccctaaaaatgttcaaacagcgcccggcacctttaagacaccggaaggggaggtcggagctatcgccctcgatttcaagcctggcacgagcgggtctcccatcgtgaaccgcgaaggaaaaattgtgggcctgtatggcaatggggtcgtgaccacatccggaacctacgttagcgccatcgctcaggccaaggcgtcccaggagggccctcttcccgagattgaagacgaggtgtttcggaaaagaaacctgaccatcatggatctgcaccccgggtctggaaagacacgccggtatctccctgctattgtcagagaagccatcaaacgcaagctgcggacgcttatcctggccccgaccagagtggttgctagcgagatggccgaagctctcaagggcatgcccattcgctaccaaacaaccgccgtgaaatccgagcatacagggaaggagatcgtcgacctgatgtgccacgcgaccttcacgatgcggctgctcagccctgtgagagttcccaattataacatgattatcatggatgaagcccattttacagacccttcttccattgctgcccggggctacatcagcacccgcgtgggaatgggcgaggctgccgccatcttcatgaccgctacaccccctgggtctgtcgaagcgtttccgcagagcaatgccgtgattcaggatgaggaaagagacatccccgagcggtcctggaactctggatatgagtggattaccgatttccctggcaaaacagtgtggtttgtccccagcatcaagtccgggaatgacattgctaactgtcttcgcaaaaatggaaagagagttatccagctgtctcggaagaccttcgatacggaataccagaagaccaagaacaacgactgggactacgtggtgaccacagatattagcgagatgggcgccaatttcagagccgaccgcgtcatcgatcctcggagatgcctgaaacccgtgatcctcaaggacgggccggaacgcgttattctggctggccctatgcccgtgaccgtcgcctccgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagagcgccgcgatcgatggggagtatcgcctgagaggagaggcccggaaaacattcgtggaactcatgcgcagaggcgaccttccggtttggctgtcttacaaggtggcttccgaggggtttcaatatagcgatcggcgctggtgcttcgacggcgaaagaaacaatcaggtcctggaggaaaacatggatgtggagatttggaccaaagagggagaacggaagaaactcagaccccgctggctggacgcccggacatactccgaccctcttgctctgagagagtttaaggagttcgccgctggccgccggtctgtcagcggggatctcatcctggagattggaaaactgccccagcacctcacccagagagcccaaaatgcgcttgacaacctggtgatgctgcataattccgaacagggcgggcgggcctatcgccacgctatggaggagctccctgatacaatcgaaaccctgatgcttctggccctcattgctgttctgacgggaggcgtgacactgtttttcctctctggcagagggcttggaaagaccagcatcggcctgctgtgtgtgatggcctccagcgtcctcctgtggatggcctctgttgagccccattggatcgctgcgtccattatccttgaatttttcctgatggtgctcctgattccggagcctgaccggcagcgcacaccccaggataaccaactggcctacgtggtcatcgggctcctttttatgattctgacagtggctgccaatgagatgggactgctcgaaaccacaaagaaagacctgggcatcgggcacgttgccgtggagaaccaccatcacgctgccatgcttgatgtcgacctgcatcctgcgagcgcctggacgctctacgctgtggccaccacaattatcacccccatgatgagacacacaatcgaaaacaccacggctaatatttctctgaccgccatcgcgaaccaggccgctattctgatgggactcgataagggctggcctatctccaaaatggacattggcgtcccccttctggccctggggtgctatagccaggtgaatccgctcacactgaccgctgccgttcttatgctggtggctcattacgccatcatcggacctggcctccaagcgaaggccacacgggaggctcagaaacgcaccgccgctgggattatgaagaaccccacggtcgatggaatcgtggccattgacctggatcccgttgtgtatgacgccaagttcgaaaaacagctgggccagatcatgctccttattctgtgtacatctcaaatcctgctcatgagaaccacatgggcgctgtgcgagagcatcacccttgctaccgggcctctgacaacgctctgggagggatccccgggcaagttttggaataccacaattgccgtctctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcattatggaggtggaccgctccgaagcgaaagaggggctgaagcggggagagacgacaaaacacgccgtgtctagaggcaccgctaaacttcgctggttcgttgaacggaatctggtcaaacccgaggggaaggtgatcgatctcggatgtggcagagggggatggagctactattgcgccggcctgaagaaagtgaccgaagtcaagggctacacaaaagggggacctggccacgaggaacccattcctatggctacctacgggtggaacctggttaagctccattccggaaaagacgtgtttttcattccccctgagaagtgtgatacacttctgtgcgacatcggcgagtctagcccgaatcccacgatcgaagaggggcgcaccctgcgggtgctcaaaatggtcgaaccttggctgagaggaaaccaattttgtatcaagattcttaatccctatatgccttccgtggttgagacactggagcagatgcagcgcaagcacggcggcatgctcgtgcggaaccccctgagcagaaattctacccatgaaatgtactgggtctcctgcgggacaggaaacatcgtgagcgccgttaatatgacctctcgcatgctgctcaaccggttcacgatggcgcacagaaaaccgacctatgagcgcgatgtggacctgggcgccgggacaagacacgtcgctgtggaacctgaggtggccaaccttgatattatcggacagcggattgaaaatatcaagcatgagcacaaatccacctggcattacgacgaggataacccctataagacatgggcttaccacggcagctatgaagtcaaaccctctgggtccgccagctccatggttaatggagtggtgaagctgctcaccaagccttgggacgtcatccccatggtgacacaaattgctatgaccgatacgacaccttttggccagcagcgcgttttcaaagagaaggtggacaccagaaccccgaaagccaagcggggcacagcgcaaatcatggaagtcacggccaaatggctgtgggggtttcttagcagaaacaagaagccccggatttgtacccgcgaggagttcacaagaaaagtgcggtctaatgctgccatcggagctgtttttgtggacgagaaccagtggaatagcgccaaggaggccgtcgaagatgagcgcttctgggacctggtgcatagagaacgggagctccacaaacagggcaagtgcgcgacctgcgtttacaacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtggagggggagggactgcataaactcggctatatcctgagagacatctctaagattcctgggggaaatatgtacgccgatgacacagctggctgggatacccggatcacagaagacgatcttcagaacgaggcccgcattaccgacatcatggaacccgagcacgcgctgctcgccaaaagcatttttaagctgacgtatcaaaataaagtcgtgagagtccagcggcctgctaagaacgggaccgtgatggatgttatctcccgcagagaccagcggggctctggacaggtgggcacatacgggctgaataccttcacaaacatggaagcccaactcatcagacagatggagagcgagggaatcttttcccccagcgaactggagaccccgaaccttgctgaacgcgtcctggattggctcgagaagtatggcgtggaacggctgaaaagaatggccatctctggggacgactgtgtggttaagcctattgatgaccgcttcgcgacggcccttacagctctgaatgatatgggaaaagtgcggaaggacatcccccagtgggagccttccaaaggctggaacgattggcagcaagtccccttttgcagccatcacttccaccagctcattatgaaggacgggagagagatcgtggttccttgtcgcaatcaggatgaactggtgggccgggccagagtctctcagggagctggctggtccctgcgcgagaccgcctgcctcggaaagagctacgctcaaatgtggcagctgatgtattttcatcggagagaccttcgcctggccgcgaacgccatttgttccgctgtgcccgtcgattggatcccgacatctcggaccacgtggagcatccacgcccatcaccagtggatgaccacagaagacatgctctccgtgtggaatagagtttggattgaggaaaacccttggatggaggataaaacccatatcagctcttggggagacgtgccctacctgggcaagcgggaggaccaatggtgcgggtcccttattggactgacagccagagctacctgggccacaaatatccaggtcgcgattaaccaggtgcgccggctcatcggcaatgaaaactacctggattatatgaccagcatgaaaagattcaagaatgagtctgaccccgaaggggctctgtggtga

SEQ ID NO: 19251 - RNA, 9879 nt, synthetic construct
  misc_feature 1..9879: note = derived and/or modified CDS sequence (opt5) from DENV-1__EU482789__SS-prME
  source 1..9879: mol_type = other RNA
agcgtgaccatgctgctgatgctgatgcccaccgcccttgctttccacctgacgaccagaggcggggaacctcatatgatcgtcaccaagcaggaacgggggaagtccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaaatggagggaaagatcgtgcagtacgaaaaccttaaatattctgttatcgtgaccgtccacacaggcgaccagcatcaagtggggaatgagtccaccgaacacggaacaaccgctacgattacaccccaggcccctacaagcgagatccagctgaccgactacggcgccctcacactggattgttctccccggaccggcctggacttcaacgaaatggttctcctgacgatgaaggagaaatcctggcttgtgcataagcagtggtttctggatctccctctgccctggacaagcggggcttccacctctcaagagacatggaatcgccaggaccttctggtcaccttcaaaaccgcgcacgccaagaagcaggaagtggtcgtgctcggaagccaagagggcgctatgcacacagccctgacgggggccaccgaaattcagacatccggaaccacaaccatctttgctggccatctgaaatgcagactcaagatggataaactgacgcttaaggggatgagctatgttatgtgtacaggctctttcaaactggagaaggaagtggccgagacccagcacggaaccgtcctcgtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctctgaaactttcttggttcaagaaaggcagctccattgggaagatgtttgaggccacagctagaggcgcccgccggatggcgatcctcggagataccgcctgggacttcggctctatcgggggagtgtttacaagcgttggcaaactggtccatcagattttcgggaccgcttacggagtgctgttttccggcgtgagctggacgatgaagatcgggattggcgtcctcctgacctggcttggactcaattctagatccacaagcctctctatgacctgtatcgccgtgggcctggttacactgtaccttggggtgatggtccaggctgattccggatgcgtgattaactggaaaggccgcgaactcaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctggaaaacatcatgtggaaacagatttccaacgagctcaatcatatcctgcttgaaaacgacatgaagttcacagtggttgtgggagatgtcgtgggcattctggctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctcaagctgcgcgattcctacacacaggtttgcgaccaccggctgatgagcgcggccattaaagattctaaggctgtgcatgccgacatgggctattggatcgaatccgagaaaaatgaaacctggaaacttgccagagctagcttcatcgaggtgaagacatgtatttggcccaaatctcacaccctctggtccaacggggtcctggaaagcgagatgatcattccgaagatctacggaggccctatttctcaacataattatcgccccgggtacttcacacagaccgccggaccttggcacctgggcaaactcgagctggattttgacctttgcgaagggacgaccgtggttgtggatgagcactgcggaaaccggggccccagcctgagaacaaccacagtcaccggcaagatcatccatgaatggtgttgccggtcctgtacgctccctcccctgcgcttcaaaggggaggacggatgctggtacggcatggagattagaccggtgaaggaaaaggaggaaaatctggttaaaagcatggtgtctgcggggtccggagaggtcgacagcttttcccttggcctcctgtgtatctctattatgatcgaagaggtgatgcggagcagatggtcccgcaagatgctgatgacagggaccctcgctgttttcctgcttctgattatgggacagctcacatggaacgatctgatccggctgtgcattatggtgggcgccaatgcctctgacagaatgggcatggggaccacctatcttgctctgatggccacatttaaaatgcgccctatgttcgcggtcggactcctgtttagacggctcacgagccgcgaggtgctgcttctgaccatcggcctctccctggtggcttctgtcgaactgcccaacagccttgaggaactgggggatggactcgccatgggcatcatgattctgaagctcctgacagacttccaatcccaccagctttgggccaccctgctcagcctgacatttatcaaaaccacgctgtctcttcattacgcttggaagacaatggccatggttctgtccattgtgagcctcttccccctgtgtctctctaccacctcccagaagacaacctggctgcctgtgcttctggggagcctgggatgcaaaccgctcacaatgtttctgatcgctgagaataagatttggggcagaaaatcttggccccttaacgaaggcatcatggccgtcggggtggtttccatcctgctcagctccctgctcaagaacgatgtgcctctggcgggaccccttattgccggcgggatgctgatcgcttgttatgtcattagcggatctagcgccgacctgtccctcgagaaagctgccgaggtgtcttgggaagaggaagccgagcacagcggcgcttcccataatatcctggttgaagtgcaggatgacgggacgatgaagattaaagatgaggagcgggacgatacccttacaatcctgctcaaggcgaccctgctcgccgtctctggagtgtaccctctgagcatccccgctacacttttcgtctggtatttttggcaaaagaaaaagcagcgctccggcgtgctgtgggacaccccttctcccccggaagttgagagagccgtgctggatgacggcatttaccggatcatgcagcgcgggctcctgggaagaagccaggtcggcgtgggggttttccaagaaaacgtgttccacacgatgtggcacgtcacccggggagccgtgcttatgtatcagggcaaacgcctggagccttcctgggctagcgtgaagaaagacctcatttcttacgggggaggctggagactgcagggctcctggaatacaggggaggaagttcaggtcatcgccgtggagcccggaaagaaccctaagaatgtgcaaaccgcgcccggcacatttaaaaccccggaaggggaggtcggagctattgccctcgatttcaagcctggcacaagcgggtctcccatcgtgaaccgggaaggaaaaattgttggcctgtacggcaatggggtggtcacgacctccggaacatatgtgagcgccatcgctcaggccaaggcgtcccaggagggccctcttcccgagatcgaagacgaggtttttagaaaacgcaacctgaccattatggatctgcatcccgggtctggaaagacccggagatacctccctgctatcgtgcgcgaagccattaagcggaaactgagaacacttatcctggccccgacgcgcgtcgtggctagcgagatggccgaagctctcaagggcatgcccattcggtatcaaaccacagccgttaaatccgagcacaccgggaaggagatcgtggacctgatgtgccatgcgacattcaccatgagactgctcagccctgtccgcgtgcccaattacaacatgatcattatggatgaagcccactttacggacccttcttccatcgctgcccggggctatattagcacaagagtgggaatgggcgaggctgccgccatcttcatgaccgctacaccccctgggtctgtcgaagcgtttccgcagagcaatgccgttattcaggatgaggaacgggacatccccgagcgctcctggaactctggatacgagtggatcacagatttccctggcaaaaccgtgtggtttgtgcccagcattaagtccgggaatgacatcgctaactgtcttagaaagaatggaaaacgggtcattcagctgtctcgcaagacattcgataccgaatatcagaagacgaagaacaacgactgggactacgtggttacaaccgatatcagcgagatgggcgccaattttagagccgaccgggtgattgatcctagacgctgcctgaaacccgtcatcctcaaggacgggccggaacgggtgattctggctggccctatgcccgttacagtggcctccgcggctcagagacgcggacggatcggcagaaaccataataaggagggggatcagtacatctatatgggacagccccttaacaatgacgaggatcacgcccactggaccgaagccaaaatgctgctcgacaacattaatacgcctgagggcatcattcccgctctgttcgaacctgagcgcgaaaagagcgccgcgatcgatggggagtaccggctgagaggagaggcccgcaaaaccttcgtcgaactcatgagacggggcgaccttccggtgtggctgtcttataaggtcgcttccgaggggtttcaatacagcgatcgcagatggtgcttcgacggcgaacggaacaatcaggtgctggaggaaaacatggatgttgagatttggacaaaagagggagaacgcaagaaactcagaccccggtggctggacgccagaacctattccgaccctcttgctctgcgcgagtttaaggagttcgccgctggccggagatctgtgagcggggatctcatcctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtcctgaccggaggcgttacgctgtttttcctctctggccgggggcttggaaaaacaagcattggcctgctgtgtgtgatggcctccagcgtgctcctgtggatggcctctgtcgagccccactggatcgctgcgtccattatccttgaatttttcctgatggtgctcctgatcccggagcctgaccgccagagaacaccccaggataaccaactggcctatgttgtgattgggctcctttttatgatcctgaccgtcgctgccaatgagatgggactgctcgaaacaaccaagaaagacctgggcattgggcacgtggccgtcgagaaccatcaccatgctacaatgcttgatgtggacctgcaccctgccagcgcgtggacgctctacgccgttgctaccacaatcattacccccatgatgcggcatacaatcgaaaacaccacggccaatatttctctgaccgctatcgccaaccaggcggccatcctgatgggactcgataagggctggcctatttccaaaatggacatcggcgtgccccttctggctctggggtgctacagccaggtcaatccgctcacactgaccgccgctgtgcttatgctggttgcccactatgctattatcggacctggcctccaagccaaggcgacacgcgaggcccagaagagaaccgctgccgggattatgaaaaaccccacggtggatggaatcgtcgctatcgacctggatcccgtggtgtacgacgccaagttcgaaaaacagctgggccagattatgctccttatcctgtgtacatctcaaattctgctcatgcggaccacatgggccctgtgcgagagcatcacccttgcgaccgggcctctgacaacgctctgggagggatccccgggcaagttttggaataccacaattgctgtttctatggccaacatcttccgcggcagctatctggctggggccggactggccttttccctcatgaaaagccttggcagagggcggcgcggaaccggcgctcagggggaaacactgggagagaagtggaagagacagctgaatcagctctccaaatctgagttcaacatctacaagcggagcggcattatggaggtcgacagatccgaagccaaagagggcctgaagcgcggggagaccacgcggcacgcggtgtctagaggaacagccaaacttcgctggttcgtggaacggaatctggtcaagcccgagggcaaggttatcgatctcgggtgtggaagaggcgggtggagctattactgcgctggactgaaaaaggtgaccgaagtgaaaggctataccaagggcgggcctggacatgaggaacccattcctatggccacatacggctggaacctggtcaaactccactccgggaaggacgtgtttttcacaccccctgagaaatgtgatacacttctgtgcgacatcggagagtctagcccgaatcccacgattgaagagggccgcaccctgcgggttctcaagatggtggaaccttggctgagagggaaccaattttgtatcaagattcttaatccctacatgccttccgtcgtggagacactggagcagatgcagcgcaaacatggaggcatgctcgttcggaaccccctgagcagaaattctacccacgaaatgtattgggtgtcctgcggcacagggaacatcgtcagcgctgtgaatatgacctctcgcatgctgctcaaccggttcacgatggcccacagaaagccgacctacgagcgcgatgtggacctgggagcgggcacaagacatgtcgccgttgaacctgaggtggctaaccttgatatcattgggcagcggatcgaaaatattaaacacgagcataagtccacctggcactatgacgaggataacccctacaaaacatgggcctatcatggaagctacgaagtgaagccctctggctccgctagctccatggtcaatggggtggttaagctgctcaccaaaccttgggacgtgatccccatggtcacacaaattgccatgaccgatacgacaccttttggacagcagcgcgtgttcaaggagaaagttgacaccagaaccccgaaggctaaacggggcacagcccaaatcatggaagtgacggcgagatggctgtggggctttcttagccggaacaagaagccccgcatctgtaccagagaggagttcacacggaaagtccgctctaatgccgctattggggccgtgtttgttgacgagaaccagtggaatagcgctaaggaggccgtggaagatgagagattctgggacctggtccagaaagaacgggagctccacaagcagggaaaatgcgcgacctgcgtgtataacatgatgggcaagcgcgaaaagaaactgggggagtttggaaaggcgaaaggctccagagctatctggtacatgtggctgggggcccggttcctcgagtttgaagccctgggcttcatgaatgaggatcactggttctctcgcgaaaacagcctttccggagtcgagggcgaggggctgcataagctcggatacattctgagagacatctctaaaattcctggcgggaatatgtatgctgatgacacagccggatgggatacccggatcacagaagacgatcttcaaaacgaggctaagatcaccgacattatggaacccgagcacgccctgctcgcgacgagcatctttaaactgacctaccagaataaggtggttcgcgtgcagagacctgccaagtccggcacagtcatggatgtgatttctcggcgcgaccagagagggagcggccaagtgggaacctatggcctgaacacattcaccaatatggaagctcagctcatccggcagatggagtccgaggggatttttctgcccagcgaacttgagacgccgaacctggccgaaagagttctcgattggctggagaaatacggagtggaacgccttaagcggatggctatctctggcgacgactgtgtcgtgaaacctatcgatgacagattcgccacagcgctgaccgccctcaacgatatggggaaggttcgcaaagacattccccagtgggagccttccaagggatggaatgattggcaacaggtgcccttttgcagccatcacttccaccagctgatcatgaaggacggccgggagattgtcgtgccttgtagaaaccaggatgaactggtcgggcgcgctcgggtgtctcaaggcgccggatggtccctcagagagacagcttgcctgggcaaaagctatgcccagatgtggcagcttatgtactttcatcgccgggacctgagactcgctgccaatgcgatctgttccgccgttcccgtggattgggtcccgacctctcgcacgacctggagcattcacgctcatcaccaatggatgacaaccgaagacatgctgtccgtgtggaaccgggtttggatcgaggaaaatccttggatggaggataagacacatgtgagctcttggggagacgtcccctatcttggaaaaagagaggaccagtggtgcggctccctgattgggctcaccgcccgggccacatgggctagcaacatccaggtggccatcaatcaggtgagacgcctgattggaaacgaaaattacctggattacatgacctctatgaagcggttcaaaaacgagggcgaccccgaaggggcgctctggtga

SEQ ID NO: 19252 - RNA, 9879 nt, synthetic construct
  misc_feature 1..9879: note = derived and/or modified CDS sequence (opt5) from DENV-1__EU482790__SS-prME
  source 1..9879: mol_type = other RNA
tccgtgaccatgctgctcatgctgatgcccacggcccttgctttccacctgacgaccagaggcggggaacctcatatgatcgtctccaagcaggaacggggaaaatctctcctgtttaagacatccgccggcgttaacatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccgggtctagcacatcccaagagacctggaatcgccaggaccttctggtgacatttaaaaccgctcacgcgaagaagcaggaagtcgtggttctcggaagccaagagggcgccatgcacaccgctctgacaggggccacggaaattcagacctctggaacaaccacaatcttcgccggccatctgaaatgcagactcaagatggataaactgacccttaaggggatgtcctatgtgatgtgtacgggcagcttcaaactggagaaggaagtcgctgagacacagcacggaaccgtgctcgttcagattaagtacgagggcaccgacgtgccgtgcaaaatccctttttctacacaagatgaaaagggggtcacccagaacggacggctgatcacagccaatcccattgtgacggacaaagagaagcctgtgaacatcgaagcggagccgcccttcggcgagagctatattgttatcggggctggagaaaaagccctgaaactttcctggtttaagaaaggctctagcattgggaagatgttcgaggccaccgctagaggcgcccgccggatggctatcctcggagatacagcctgggactttggctccatcgggggagtcttcaccagcgtgggcaaactggtgcatcagatttttgggacagcgtacggagtcctgttctctggcgtgtcctggaccatgaagatcgggattggcgttctcctgacgtggcttggactgaatagcagatctacctccctcagcatgacatgtatcgccgtgggcctggtcaccctgtaccttggggtgatggttcaggctgattccggatgcgtgattaactggaaaggccgcgaactcaagtgtgggtctggaatctttgtcacaaatgaggtgcacacctggacagaacaatataagttccaggccgacagccctaaacggctgtccgctgccattggcaaggcgtgggaggagggggtttgcggcatcagatctgccacccgcctggaaaacatcatgtggaaacagattagcaacgagctcaatcatatcctgcttgaaaacgacatgaagctgacggtggtcgtgggagatgtggctggcattctcgcccaggggaaaaagatgatccggccgcaacccatggagtacaaatattcctggaaaagctggggaaaggctaagattatcggcgccgacgtccagaatacaacctttatcattgatgggcctaacacccccgaatgtcctgacgatcagagagcctggaatatctgggaggttgaggactacggattcggcatttttacaaccaacatctggctgaagctgcgcgattcttatacacaggtgtgcgaccaccggcttatgtccgctgcgattaaagatagcaaggccgtgcacgctgacatgggctactggatcgaatctgagaaaaatgaaacatggaagctcgccagagcctccttcatcgaggtcaagacctgtatttggcccaaaagccatacactgtggtctaacggggtgctggaaagcgagatgatcattccgaagatctatggaggccctatttcccaacacaattaccgccccgggtacttcacccagacagctggaccttggcatctcggcaaactggagcttgattttgacctgtgcgaagggaccacggttgtggtcgatgagcactgcggaaaccggggccccagcctcagaaccacaaccgtgacaggcaagatcatccacgaatggtgttgccggtcttgtaccctgcctcccctgcgcttcaaaggggaggacggatgctggtatggcatggagattagaccggttaaggaaaaggaggaaaatcttgtgaaatccatggtcagcgccgggtccggagaggtggactcttttagcctcggcctgctgtgtatctccattatgatcgaagaggttatgcggtctagatggagccgcaagatgctcatgacggggacactggcggtgttctttcttctgattatgggacagctcacctggaacgatctgatccggctgtgcattatggtcggcgctaatgcctccgacagaatgggcatggggacaacctaccttgccctgatggctaccttcaaaatgcgccctatgtttgccgtgggactcctgttcagacggctcacatctcgcgaggtgctgcttctgacgatcggcctcagcctggtcgcgtccgttgaactgcccaacagccttgaggaactgggggatggactcgctatgggcatcatgattctgaagctcctgaccgactttcaatctcatcagctttgggccacactgctctccctgaccttcatcaaaacaacctttagcctgcactatgcctggaagacgatggctatggtgctttctattgtgtccctgttccccctctgtctgagcacaacctctcagaagaccacatggctccctgtcctgcttgggtccctgggatgcaaaccgctgaccatgtttctcatcgccgagaataagatttggggcagaaaaagctggcccctgaacgaaggcatcatggctgtggggatcgtttccattcttctgagctctctcctgaagaacgatgtgcctctcgccggacccctgatcgcgggcgggatgcttattgcctgttacgtcatcagcggatcctctgctgacctgagcctggagaaagccgctgaggtgtcctgggaagaggaagccgagcattctggcgccagccacaatattctcgttgaagtgcaggatgacgggacaatgaagatcaaagatgaggagcgggacgatacgctgaccatccttctgaaggctacactcctggcggtctccggagtgtatcctctctctattcccgccaccctgttcgtctggtacttctggcaaaagaaaaagcagcgcagcggcgtgctttgggacacacctagccctcccgaagttgagagagctgtgctggatgacggcatctatcggattatgcagcgcgggctgctcggaagaagccaggtcggcgtgggggtttttcaagaaaacgtgttccataccatgtggcacgtcacgcggggagccgtgctgatgtaccagggcaaacgccttgagccctcttgggcctccgtgaagaaagacctgatcagctacgggggaggctggagactccagggctcttggaataccggggaggaagttcaggtcattgctgtggagcccggaaagaaccctaagaatgtgcaaacagcccccggcacctttaaaacatccgaaggggaggtcggagcgatcgctctggatttcaagccgggcaccagcgggtcccctattgtgaaccgggaaggaaaaatcgttggcctctatggcaatggggtggtcacaacgtctggaacctacgtgagcgccatcgcccaggctaaggcctcccaggagggccccctgcctgagattgaagacgaggtttttagaaaacgcaaccttacaatcatggatctgcaccccgggagcggaaagacccggagatatctgcccgcgattgtgcgcgaagctatcaagcggaaactcagaaccctgattcttgcccctacacgcgtcgtggcctctgagatggctgaagccctgaagggcatgccgatccggtaccaaacgaccgctgttaaatccgagcatacagggaaggagatcgtggacctcatgtgccacgccaccttcacaatgagactgctgagccccgtccgcgtgcctaattataacatgattatcatggatgaagcgcattttaccgacccctctagcattgccgctcggggctacatctccacgagagtgggaatgggcgaggccgctgccattttcatgacagccacccctcccgggtctgtcgaggcttttcctcagagcaatgcggttatccaggatgaagaacgggacatcccggagcgctcctggaactctggatatgagtggattaccgatttccccggcaaaacagtgtggtttgtgcctagcatcaagtccgggaatgacattgccaactgtctcagaaagaatggaaaacgggtcatccagcttagccgcaagaccttcgatacagaataccagaagaccaagaacaacgactgggactacgtggttacgacagatatttctgagatgggcgctaatttcagagccgaccgggtgatcgatcccagacgctgcctgaaacctgtcattctgaaggacgggcccgaacgggtgatcctcgccggcccgatgcctgttaccgtggcttccgccgcgcagagacgcggacggatcggcagaaaccacaataaggagggggatcagtatatttacatgggacagcccctgaacaatgacgaggatcatgctcactggacagaagccaaaatgcttctggacaacatcaatacccccgagggcattatccctgccctctttgaacccgagcgcgaaaagagcgctgccattgatggggagtatcggctgagaggagaggcgcgcaaaacgttcgtcgaactgatgagacggggcgacctccctgtgtggctttcctacaaggtcgcctctgaggggtttcaatatagcgatcgcagatggtgcttcgacggcgaacggaacaatcaggtgctggaggaaaacatggatgttgagatctggaccaaagagggagaacgcaagaaactgagaccgcggtggctcgacgctagaacatactccgaccccctggcccttcgcgagtttaaggagttcgctgccggccggagatctgtgagcggggatctgatcctcgagattggaaagctgcctcagcacctgacccagcgcgctcaaaatgccctcgacaaccttgtgatgctgcataattccgaacagggcgggcgggcgtatagacacgccatggaggagctgcccgatacaatcgaaaccctcatgctgcttgctctgattgccgtcctcacaggaggcgttaccctgtttttcctgagcggccgggggctcggaaaaacgtctatcggccttctgtgtgtgatggcttccagcgtgctgctctggatggcctctgtcgagcctcattggattgccgcttccatcatcctggaatttttccttatggtgctgctcattcccgagccggaccgccagagaacacctcaggataaccaactggcgtacgttgtgatcgggctgctctttatgattcttaccgtcgccgctaatgagatgggactgctggaaaccacaaagaaagacctcggcatcgggcacgtggccgtcgagaaccaccatcacgccgctatgctggatgtggaccttcatcccgccagcgcgtggaccctgtacgccgttgctacaacgattatcacccctatgatgcggcacacaattgaaaacaccacagccaatatctctctcaccgctatcgccaaccaggcggccattctgatgggactggataagggctggcccatcagcaaaatggacattggcgtgcctctccttgctctggggtgctattcccaggtcaatcccctgacgctcaccgccgctgtgctgatgcttgttgcccattacgctatcattggaccgggcctgcaagccaaggcgacacgcgaggcccagaagagaaccgctgccgggatcatgaaaaaccctacagtggatggaatcgtcgctattgacctcgatcccgtggtgtatgacgccaagttcgaaaaacagctgggccagatcatgctgctcattctttgtacctctcaaatcctgctgatgcggacgacatgggccctctgcgagagcattaccctggcgacagggccccttaccaccctgtgggagggatcccctggcaagttttggaatacaacgatcgctgttagcatggccaacatcttccgcggctcctacctcgctggggccggactggccttctctctgatgaaaagcctcggcgggggaagacggggcaccggggctcagggagaaacacttggcgagaagtggaagcgccagctgaatcagctgtccaaatctgaatttaacacctataagagaagcggcattatggaggtcgaccggtccgaagccaaagaggggctcaagagaggagagacaaccaaacacgcggtgtctcgcggcacggccaagctgcggtggttcgtggaaagaaatcttgtcaagccggaggggaaagttatcgatctgggatgtggccgcgggggatggagctactattgcgctggcctcaagaaagtgacagaagtgaagggctacaccaaagggggacccggccacgaggaacctattcccatggccacctacgggtggaacctggtcaagctgtattccggaaaagacgtgtttttcatccctcccgagaagtgtgatacactcctttgcgacattggcgagagctctcctaatccgaccatcgaagaggggcggacactgagagttctgaagatggtggaaccctggctccgcggaaaccaattttgtattaaaatcctgaatccttacatgccctccgtcgtggagacgcttgagcagatgcagcggaagcatggcggcatgctggttagaaaccctctcagccgcaattctacccacgaaatgtattgggtgtcctgcgggacaggaaacatcgtcagcgctgtgaatatgacctctcggatgctgctgaacagattcacaatggcccatcgcaaacccacctacgagcgggatgtggacctcggcgcggggacgagacacgtcgccgttgaaccggaggtgcctaacctggatattatcggacagcgcattgaaaatatcaagcacgagcataaatccacctggcactatgacgaggataacccctacaagacatgggcttatcatggcagctacgaagtgaagccctccgggagcgcctctagcatggtcaatggagtggttaaacttctgaccaagccttgggacgtgattcccatggtcacacaaatcgctatgaccgatacaaccccttttggccagcagagagtgttcaaagagaaggttgacacgcggacaccgaaagccaagcgcggcaccgctcaaatcatggaagtgaccgccaagtggctctgggggtttctgtccagaaacaaaaagccccggatttgtacaagagaggagttcacgcggaaagtccgctctaatgcggccatcggagctgtgtttgttgacgagaaccagtggaatagcgccaaggaggctgtggaagatgagagattctgggaccttgtccaccgggaacgcgagctgcataaacagggcaagtgcgctacctgcgtgtacaacatgatggggaagagagagaaaaagctcggagagtttggcaaagccaaggggtcccgggcgatttggtatatgtggctgggcgctcgcttcctggagttcgaagccctcggatttatgaatgaggatcactggttctctagagaaaacagcctgtccggcgtcgagggggagggacttcacaaactgggctacatcctccgggacatttctaagatccctgggggaaatatgtatgccgatgacacagctggctgggatacccgcatcacagaagacgatctgcagaacgaggccaaaattaccgacatcatggaacccgagcatgcccttctggccaagagcatttttaagctcacataccaaaataaagtggttagagtgcagcggcctgcgaagaacgggaccgtcatggatgtgatctcccgcagagaccagcggggcagcggacaggtgggcacgtatgggctgaataccttcacaaacatggaagcccaactgattcgccagatggagtctgagggaatcttttcccccagcgaactcgagaccccgaacctggctggcagagttcttgattggctggaaaaacacggggtggagcggctcaagagaatggccatctctggagacgactgtgtcgtgaaacctattgatgaccgcttcgctacagccctgaccgcgcttaatgatatgggcaaggttcggaaggacatcccccagtgggaaccttccaaagggtggaacgattggcagcaagtgcccttttgcagccatcacttccaccagctgattatgaaggacggcagagagatcgtcgtgccttgtcgcaatcaggatgagctcgtcggacgggccagagtgtcccagggcgctgggtggtctctgcgcgaaacggcctgcctgggaaaaagctacgctcaaatgtggcagctcatgtattttcatcggagagacctgcgccttgccgctaacgccatttgttccgcggttcccgtggattgggtcccgacaagccggaccacatggtctatccacgcccatcaccagtggatgaccacggaggacatgctgtccgtgtggaatagagtttggattgaagagaacccttggatggaagataagacccatatcagctcttggggcgacgtgccctacctcgggaaacgcgaggaccaatggtgcggaagcctgatcggccttacagctcgggccacctgggccacaaatattcaggtcgctatcaaccaggtgagacggctgattgggaatgagaactacctcgattatatgacctccatgaagagattcaagaatgaatctgaccccgagggcgccctgtggtga

SEQ ID NO: 19253 - RNA, 9879 nt, synthetic construct
  misc_feature 1..9879: note = derived and/or modified CDS sequence (opt5) from DENV-1__EU482791__SS-prME
  source 1..9879: mol_type = other RNA
agcgtgaccatgctgctgatgctgatgcccaccgcccttgctttccacctgacgacccggggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagaaaatcttggcccctgaacgaagggattatggccgtcggagtggtttccatcctcctgagctccctcctgaagaacgacgtgcctcttgcgggccccctgatcgccgggggaatgctgattgcttgttatgtcatcagcggctctagcgccgatctctccctggagaaagctgccgaggtgtcttgggaagaggaagccgagcacagcggggcttcccataatattcttgttgaagtgcaggacgatggaaccatgaagatcaaagacgaggagcgggatgacacactgaccattctcctgaaggcgacactcctggccgtctctggcgtgtaccctcttagcatccccgctaccctgttcgtctggtatttttggcaaaagaaaaagcagcgctccggcgtgctgtgggatacgccttctcccccggaagttgagagagccgtgctcgacgatgggatctaccggattatgcagcgcggactgcttggcagaagccaggtcggggtgggagttttccaagaaaacgtgttccacaccatgtggcacgtcacacggggcgccgtgctgatgtatcaggggaaacgcctcgagccttcctgggctagcgtgaagaaagacctgatctcttacggaggcggctggagactccaggggtcctggaataccggagaggaagttcaggtcattgccgtggagcccggcaagaaccctaagaatgtgcaaacagcgcccgggacctttaaaacaccggaaggagaggtcggcgctatcgccctggacttcaagcctgggacgagcggatctcccattgtgaaccgggaaggcaaaatcgttggcctttacgggaatggagtggtcaccacatccggcacctatgtgagcgccattgctcaggccaaggcgtcccaggaggggcctctgcccgagatcgaagatgaggtttttagaaaacgcaacctgaccatcatggacctccatcccggatctggcaagacacggagatacctgcctgctattgtgcgcgaagccatcaagcggaaacttagaacgctgattctcgccccgacccgcgtcgtggctagcgagatggccgaagctctgaaggggatgcccatccggtatcaaacaaccgccgttaaatccgagcacacaggcaaggagattgtggatctgatgtgccatgcgaccttcacgatgagactccttagccctgtccgcgtgcccaattacaacatgatcatcatggacgaagcccactttacagatccttcttccattgctgcccggggatatatcagcaccagagtgggcatgggggaggctgccgccattttcatgaccgctacaccccctggatctgtcgaagcgtttccgcagagcaatgccgttatccaggacgaggaacgggatattcccgagcgctcctggaactctggctacgagtggatcaccgacttccctgggaaaacagtgtggtttgtgcccagcatcaagtccggaaatgatattgctaactgtctgagaaagaatggcaaacgggtcatccagctgtctcgcaagaccttcgacacggaatatcagaaaaccaagaacaacgattgggactacgtggttaccacagacattagcgagatgggggccaattttagagccgatcgggtgatcgaccctagacgctgcctcaaacccgtcattctgaaggatggcccggaacgggtgatccttgctggacctatgcccgttaccgtggcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgttcgaacctgagcgcgaaaagagcgccgcgattgacggagagtaccggctcagaggcgaggcccgcaaaacattcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatctggaccaaagagggcgaacgcaagaaactgagaccccggtggcttgatgccagaacatattccgaccctctggctctccgcgagtttaaggagttcgccgctgggcggagatctgtgagcggagacctgattctggagatcggcaagctcccccagcatcttacccagcgcgcccaaaatgcgctggataacctggtgatgctccacaattccgaacaagggggacgggcctacagacatgctatggaggagctgcctgacacaatcgaaacccttatgctgctcgccctgattgctgtcctgacgggcggcgttacactctttttcctttctgggcggggactgggcaaaaccagcatcgggctgctctgtgtgatggcctccagcgtgctgctttggatggcctctgtcgagccccactggattgctgcgtccatcattctggaatttttcctcatggtgctgctgatcccggagcctgatcgccagagaacaccccaggacaaccaactcgcctatgttgtgatcggacttctgtttatgattctgacagtcgctgccaatgagatgggcctcctggaaaccacaaagaaagatcttgggatcggacacgtggccgtcgagaaccatcaccatgctacgatgctggacgtggatctccaccctgccagcgcgtggaccctgtacgccgttgctacaaccattatcacacccatgatgcggcataccattgaaaacacgaccgccaatatctctctgacagctattgccaaccaggcggccatcctcatgggccttgacaagggctggcctatctccaaaatggatattggggtgcccctgctggctctcggatgctacagccaggtcaatccgctgacccttacagccgctgtgctgatgctcgttgcccactatgctatcattggccctgggctgcaagccaaggcgacccgcgaggcccagaagagaacggctgccggaatcatgaaaaaccccacagtggacggcattgtcgctatcgatctggaccccgtggtgtacgatgccaagttcgaaaaacagctcgggcagatcatgcttctgattctgtgtacctctcaaatcctcctgatgcggacaacctgggccctttgcgagagcattaccctggcgacaggacctctcacgaccctgtgggagggctccccgggcaagttttggaatacaaccatcgctgtttctatggccaacattttccgcgggagctatctggctggagccggcctcgccttttcccttatgaaaagcctcgggggaggcagacgggggacaggagctcagggcgaaaccctgggcgagaagtggaagcgccagctcaatcagctgtccaaatctgagttcaacatctacaagagaagcgggatcatggaggtcgaccggtccgaagccaaagagggacttaagagaggcgagacgacacgccacgcggtgtctcgggggaccgccaaactgagatggttcgtggaacgcaatctcgtcaagcccgagggaaaggttattgacctgggctgtgggcggggaggctggagctattactgcgctggcctgaaaaaggtgaccgaagtgaaagggtatacaaagggaggccctgggcatgaggaacccatccctatggccacctacggatggaacctcgtcaaacttcactccggcaaggatgtgtttttcacaccccctgagaaatgtgacacgctgctgtgcgatattggggagtctagcccgaatcccaccatcgaagagggaagaacactccgcgttctgaagatggtggaaccttggcttcggggcaaccaattttgtattaagatcctgaatccctacatgccttccgtcgtggagaccctcgagcagatgcagagaaaacatggcgggatgctggttcgcaaccccctgagcagaaattctacacacgaaatgtattgggtgtcctgcggaaccggcaacattgtcagcgctgtgaatatgacgtctagaatgctcctgaaccgcttcaccatggcccaccggaagccgacatacgagagagacgtggatcttggggcgggaacccgccatgtcgccgttgaacctgaggtggctaacctggacatcatcggccagagaattgaaaatatcaaacacgagcataagtccacatggcactatgatgaggacaacccctacaaaacctgggcctatcatgggagctacgaagtgaagccctctggatccgctagctccatggtcaatggcgtggttaagctcctgacaaaaccttgggatgtgattcccatggtcacccaaatcgccatgacggacacaaccccttttggccagcagcgggtgttcaaggagaaagttgatacccgcacaccgaaggctaaaagagggacggcccaaattatggaagtgaccgcgcggtggctttggggatttctgagcagaaacaagaagccccggatctgtacacgcgaggagttcaccagaaaagtccggtctaatgccgctatcggcgccgtgtttgttgacgagaaccagtggaatagcgctaaggaggccgtggaagacgagcgcttctgggatctcgtccagaaagaaagagagctgcacaagcaggggaaatgcgccacatgcgtgtataacatgatgggaaagcgggaaaagaaactgggcgagtttgggaaggcgaaaggctcccgcgctatttggtacatgtggctcggagccagattcctggagtttgaagcccttggcttcatgaatgaggaccactggttctctcgggaaaacagcctgtccggggtcgagggagagggcctccataagctggggtacatccttcgcgatatttctaaaatccctggaggcaatatgtatgctgacgataccgccgggtgggacacaagaattaccgaagatgacctgcaaaacgaggctaagatcacggatatcatggaacccgagcacgccctcctggcgaccagcatttttaaactgacataccagaataaggtggttcgggtgcagcgccctgccaagaacggcaccgtcatggacgtgatctccagacgggatcagcgcggatctggccaagtggggacatatggactcaataccttcacgaacatggaagctcagctgattagacagatggagagcgagggcatctttcttccctccgaactggagacaccgaacctcgccgaacgggttctggactggcttgagaaatacggggtggaaagactgaagcgcatggctattagcggagatgactgtgtcgtgaaacctatcgacgatcggttcgccaccgcgctcacagccctgaatgacatgggcaaggttagaaaagatatcccccagtgggagccttctaaggggtggaacgactggcaacaggtgcccttttgctcccatcacttccaccagctgattatgaaggatggccgcgagatcgtcgtgccttgtcggaatcaggacgaactcgtcggacgggctcgcgtgagccaaggcgccgggtggtctctgcgggagaccgcttgccttggaaaatcctatgcccagatgtggcagctgatgtactttcatagacgcgatctccggctggctgccaacgcgatttgtagcgccgttcccgtggactgggtcccgacgtccagaaccacatggtctatccacgctcatcaccaatggatgaccacagaagatatgcttagcgtgtggaatcgcgtttggattgaggaaaacccttggatggaggacaagacccatgtgtccagctggggcgatgtcccctatctggggaaacgggaggaccagtggtgcggatctctcatcggcctgacagccagagccacctgggcttccaatattcaggtggccatcaaccaggtgcggagactgatcgggaatgaaaactacctcgactacatgacgagcatgaagcgcttcaaaaatgagggcgatcccgaaggagcgctgtggtga

SEQ ID NO: 19254 - RNA, 9879 nt, synthetic construct
  misc_feature 1..9879: note = derived and/or modified CDS sequence (opt5) from DENV-1__EU482792__SS-prME
  source 1..9879: mol_type = other RNA
agcgtgaccatgctgctcatgctgatgcccacagcccttgctttccacctgacgacccggggcggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaaacggaacccgacgatgtggactgttggtgcaatgctaccgatacatgggtgacctatggaacatgtagccaaaccggcgagcaccggcgggacaagcgctccgtcgccctggcccctcatgtggggctgggactcgagacgagaacagaaacctggatgtctagcgagggcgcttggaaacagattcagcgggttgaaacatgggccctgcgccaccccggcttcaccgtgatcgctctttttctggcccatgcgattgggacctccatcacacagaagggaatcattttcatcctcctgatgcttgtcacgccttctatggccatgagatgcgtgggcattgggagccgggattttgttgagggactgtccggcgctacctgggtggacgtcgtgctcgagcacgggagctgtgtgacaaccatggccaaggataaacccacactggacatcgaactgctcaagaccgaggtcacgaaccctgctgttctgcgcaaactttgcattgaagccaagatctctaatacaaccaccgattccagatgtccgacacaaggagaggcgaccctgatggaagaacaagacgccaacttcgtgtgccggcgcacatttgtggatagaggctggggcaatgggtgtggactcttcggcaaagggagcctgattacgtgcgctaagtttaagtgcgtcaccaaacttgagggaaagatcgtgcagtacgaaaacctgaaatattctgttatcgtgacagtccacaccggcgaccagcatcaagtggggaatgagtccacagaacacggaaccacggccaccattacaccccaggctcctaccagcgagatccagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaattcagacctccggaacaaccacgatctttgccggccatctcaaatgcagactgaagatggataaacttacactgaaggggatgagctatgttatgtgtaccggctctttcaaactcgagaaggaagtggctgagacccagcacggaacagtcctggtgcagattaagtacgagggcaccgacgccccgtgcaaaatccctttctccacacaagatgaaaagggggttacgcagaacggacggctgatcaccgcgaatcccattgtgacagacaaagagaagcctgtcaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtgtttaccagcgttggcaaactggtccatcagattttcgggacggcctacggagtgctcttttccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagttcaccgtggttgtgggagatgtcgtgggcattctcgcccaggggaaaaagatgatccggccgcaacccatggagcacaaatactcttggaaaagctggggaaaggctaagattatcggcgccgacgtgcagaataccacatttatcattgatgggcctaacacccccgaatgtcctgacgatcagagagcctggaatatctgggaggtcgaggactatggattcggcatttttacgacaaacatctggctgaagctgcgcgattcctacacccaggtttgcgaccaccggcttatgagcgctgcgattaaagattctaaggccgtgcatgctgacatgggctattggatcgaatccgagaaaaatgaaacatggaagctcgccagagccagcttcatcgaggtgaagacctgtatttggcccaaatctcacacactgtggtccaacggggtcctggaaagcgagatgatcattccgaagatctacggaggccctatttctcaacataattatcgccccgggtacttcacccagacggctggaccttggcacctcggcaaactggagcttgattttgacctgtgcgaagggaccacagtggttgtggatgagcactgcggaaaccggggccccagcctcagaaccacaaccgtcacgggcaagatcatccatgaatggtgttgccggtcctgtacactgcctcccctgcgcttcaaaggggaggacggatgctggtacggcatggagattagaccggtgaaggaaaaggaggaaaatcttgttaaaagcatggtgtctgccgggtccggagaggtcgacagcttttccctcggcctgctgtgtatctctattatgatcgaagaggtgatgcggagcagatggtcccgcaagatgctcatgaccgggacactggcggttttccttctgctcattatgggacagctgacctggaacgatctgatccggctttgcattatggtgggcgctaatgcctctgacagaatgggcatggggaccacatatctggccctcatggctacgtttaaaatgcgccctatgttcgccgtcggactgctctttagacggctgaccagccgcgaggtgcttctgctcacaatcggcctgtccctggtggcgtctgtcgaacttcccaacagcctggaggaactcggggatggactggctatgggcatcatgattctcaagctgcttaccgacttccaatcccaccagctgtgggccacactcctgagcctgacctttatcaaaacgacactttctctgcattacgcctggaagaccatggctatggttctctccattgtgagcctgttccccctctgtctgtctaccacatcccagaagaccacatggcttcctgtgctgctggggagcctcggatgcaaaccgctgacgatgtttcttatcgccgagaataagatttggggcagaaaatcttggcccctgaacgaaggcatcatggctgtcggggtggtttccatcctcctgagctccctcctgaagaacgatgtgcctcttgccggacccctgattgcgggcgggatgctgatcgcctgttatgtcattagcggatctagcgctgacctctccctggagaaagccgctgaggtgtcttgggaagaggaagccgagcacagcggcgcctcccataatatccttgttgaagtgcaggatgacgggaccatgaagattaaagatgaggagcgggacgatacactgaccatcctcctgaaggctacactcctggcggtctctggagtgtaccctcttagcatccccgccaccctgttcgtctggtatttttggcaaaagaaaaagcagcgctccggcgtgctgtgggacacgccttctcccccggaagttgagagagctgtgctcgatgacggcatttaccggatcatgcagcgcgggctgcttggaagaagccaggtcggcgtgggggttttccaagaaaacgtgttccacaccatgtggcacgtcacacggggagccgtgctgatgtatcagggcaaacgcctcgagccttcctgggccagcgtgaagaaagacctgatttcttacgggggaggctggagactccagggctcctggaataccggggaggaagttcaggtcatcgctgtggagcccggaaagaaccctaagaatgtgcaaacagcccccggcacctttaaaacaccggaaggggaggtcggagcgattgctctggatttcaagcctggcacgagcgggtctcccatcgtgaaccgggaaggaaaaattgttggcctttacggcaatggggtggtcaccacatccggaacctatgtgagcgccatcgcccaggctaaggcctcccaggagggccctctgcccgagatcgaagacgaggtttttagaaaacgcaacctgaccattatggatctccatcccgggtctggaaagacacggagatacctgcctgcgatcgtgcgcgaagctattaagcggaaacttagaacgctgatcctcgccccgacccgcgtcgtggccagcgagatggctgaagccctgaagggcatgcccattcggtatcaaacaaccgctgttaaatccgagcacacagggaaggagatcgtggacctgatgtgccatgccaccttcacgatgagactccttagccctgtccgcgtgcccaattacaacatgatcattatggatgaagcgcactttacagacccttcttccatcgccgctcggggctatattagcaccagagtgggaatgggcgaggccgctgccatcttcatgaccgccacaccccctgggtctgtcgaggcttttccgcagagcaatgcggttattcaggatgaggaacgggacatccccgagcgctcctggaactctggatacgagtggatcaccgatttccctggcaaaacagtgtggtttgtgcccagcattaagtccgggaatgacatcgccaactgtctgagaaagaatggaaaacgggtcattcagctgtctcgcaagaccttcgatacggaatatcagaagaccaagaacaacgactgggactacgtggttaccacagatatcagcgagatgggcgctaattttagagccgaccgggtgattgatcctagacgctgcctcaaacccgtcatcctgaaggacgggccggaacgggtgattcttgccggccctatgcccgttaccgtggcttccgccgcgcagagacgcggacggatcggcagaaaccataataaggagggggatcagtacatctatatgggacagcccctgaacaatgacgaggatcacgctcactggacggaagccaaaatgctcctggacaacattaatacccctgagggcatcattcccgccctgttcgaacctgagcgcgaaaagagcgctgccatcgatggggagtaccggctcagaggagaggcgcgcaaaacattcgtcgaacttatgagacggggcgacctgccggtgtggctgtcttataaggtcgcctccgaggggtttcaatacagcgatcgcagatggtgcttcgacggcgaacggaacaatcaggtgctcgaggaaaacatggatgttgagatttggaccaaagagggagaacgcaagaaactgagaccccggtggcttgacgctagaacatattccgaccctctggccctccgcgagtttaaggagttcgctgccggccggagatctgtgagcggggatctgatcctggagatcggaaagctcccccagcatcttacccagcgcgctcaaaatgccctggacaacctggtgatgctccacaattccgaacagggcgggcgggcgtacagacatgccatggaggagctgcctgatacaattgaaacccttatgctgctcgctctgatcgccgtcctgacgggaggcgttacactctttttcctttctggccgggggctgggaaaaaccagcattggcctgctctgtgtgatggcttccagcgtgctgctttggatggcctctgtcgagccccactggatcgccgcttccattatcctggaatttttcctcatggtgctgctgatcccggagcctgaccgccagagaacaccccaggataaccaactcgcgtatgttgtgattgggcttctgtttatgatcctgacagtcgccgctaatgagatgggactcctggaaaccacaaagaaagaccttggcattgggcacgtggccgtcgagaaccatcaccatgccacgatgctggatgtggacctccaccctgctagcgcctggaccctgtacgcggttgccacaaccatcattacacccatgatgcggcataccatcgaaaacacgaccgctaatatttctctgacagccatcgctaaccaggccgcgatcctcatgggacttgataagggctggcctatttccaaaatggacatcggcgtgcccctgctggccctcgggtgctacagccaggtcaatccgctgacccttacagctgccgtgctgatgctcgttgctcactatgccattatcggacctggcctgcaagctaaggccacccgcgaggcgcagaagagaacggccgctgggattatgaaaaaccccacagtggatggaatcgtcgccatcgacctggatcccgtggtgtacgacgctaagttcgaaaaacagctcggccagattatgcttctgatcctgtgtacctctcaaattctcctgatgcggacaacctgggccctttgcgagagcatcaccctggccacagggcctctcacgaccctgtgggagggatccccgggcaagttttggaatacaaccattgcggtttctatggctaacatcttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcattatggaggtcgaccggtccgaagctaaagaggggcttaagagaggagagacgacacgccacgccgtgtctcggggcaccgcgaaactgagatggttcgtggaacgcaatctcgtcaagcccgaggggaaggttatcgatctgggatgtggcagagggggatggagctattactgcgccggcctgaaaaaggtgaccgaagtgaaaggctatacaaaagggggacctggccatgaggaacccattcctatggctacctacgggtggaacctcgtcaaacttcactccggaaaggacgtgtttttcacaccccctgagaaatgtgatacgctgctgtgcgacatcggcgagtctagcccgaatcccaccattgaagaggggagaacactccgcgttctgaagatggtggaaccttggcttcggggaaaccaattttgtatcaagattctgaatccctacatgccttccgtcgtggagaccctcgagcagatgcagagaaaatatggcggcatgctggttcgcaaccccctgagcagaaattctacacatgaaatgtactgggtgtcctgcgggaccggaaacatcgtcagcgccgtgaatatgacgtctagaatgctcctgaaccgcttcaccatggctcaccggaagccgacatatgagagagatgtggaccttggcgccgggacccgccacgtcgcggttgaacctgaggtggccaacctggatatcattggacagagaatcgaaaatattaaacatgagcacaagtccacatggcattacgacgaggataacccctataaaacctgggcttaccacggcagctatgaagtgaagccctctgggtccgccagctccatggtcaatggagtggttaagctcctgacaaaaccttgggacgtgatccccatggtcacccaaattgctatgacggatacaaccccttttggccagcagcgggtgttcaaggagaaagttgacacccgcacaccgaaggccaaaagaggcacggctcaaatcatggaagtgaccgcccggtggctttgggggtttctgagcagaaacaagaagccccggatctgtacacgcgaggagttcaccagaaaagtccggtctaatgcggccattggagctgtgtttgttgacgagaaccagtggaatagcgccaaggaggctgtggaagatgagcgcttctgggacctcgtccagaaagaaagagagctgcataagcagggcaaatgcgccacatgcgtgtacaacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtcgagggggagggactccacaagctgggctatattcttcgcgacatctctaaaattcctgggggaaatatgtacgccgatgacaccgctggctgggatacaagaatcaccgaagacgatctgcaaaacgaggccaagatcacggacattatggaacccgagcatgctctcctggccaccagcatctttaaactgacatatcagaataaggtggttcgggtgcagcgccctgcgaagaacgggaccgtcatggatgtgatttccagacgggaccagcgcggctctggacaagtgggcacatacgggctcaataccttcacgaacatggaagcccagctgatcagacagatggagagcgagggaatttttcttccctccgaactggagacaccgaacctcgctgaacgggttctggattggcttgagaaatatggcgtggaaagactgaagcgcatggccatcagcggggacgactgtgtcgtgaaacctatcgatgaccggttcgctaccgccctcacagcgctgaatgatatgggaaaggttagaaaagacattccccagtgggagccttctaagggctggaacgattggcaacaggtgcccttttgctcccaccatttccaccagctgatcatgaaggacgggcgcgagattgtcgtgccttgtcggaatcaggatgaactcgtcggcagagcccgcgtgagccaaggagctggctggtctctgcgggagaccgcctgccttgggaaatcctacgctcagatgtggcagctgatgtattttcacagacgcgacctccggctggccgctaacgccatctgtagcgcggttcccgtggattgggtcccgacgtccagaaccacatggtctattcatgcccaccatcaatggatgaccacagaagacatgcttagcgtgtggaatcgcgtttggatcgaggaaaacccttggatggaggataagacccacgtgtccagctggggagacgtcccctacctgggcaaacgggaggaccagtggtgcgggtctctcattggactgacagctagagccacctgggcctccaatatccaggtggctatcaaccaggtgcggagactgattggcaatgaaaactacctcgattatatgacgagcatgaagcgcttcaaaaatgagggggaccccgaaggcgccctgtggtga

SEQ ID NO: 19255 - RNA, 9879 nt, synthetic construct
  misc_feature 1..9879: note = derived and/or modified CDS sequence (opt5) from DENV-1__EU482707__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagttcaaagaatttgctgccgggcgccggtctgttagcggagatctcatcctggagatcggcaagctgccccagcacctcacacagagagcgcagaatgcccttgacaacctggtgatgctgcataattccgaacaagggggacgggcttatcgccacgccatggaggagctccctgataccattgaaacactgatgcttctggctctcatcgccgtgctgaccggcggcgtcacgctgttctttctctctgggagaggacttggcaagacaagcattgggctgctgtgtgttatggcctccagcgtgctcctgtggatggcttctgtggagccccattggatcgcggcctccattatccttgagttctttctgatggtcctcctgatcccggagcctgaccggcagcgcacaccccaggataaccagctggcttacgtggttattggactccttttcatgatcctgaccgtggccgccaatgagatgggcctgctcgaaacaaccaaaaaggacctggggattggacacgtcgctgtggagaaccaccatcacgccgcgatgcttgatgtcgacctgcatcctgccagcgcttggacactctacgccgtggctacgaccatcattacacccatgatgagacacaccatcgaaaacacaaccgccaatatttctctgacggcgatcgccaaccaagctgccatcctgatgggcctcgataaaggctggcctatttccaagatggacatcggggttccccttctggctctgggatgctatagccaggtgaatccgctcaccctgacagccgctgtccttatgctggtggcccattacgcgattatcggccctgggctccaggccaaagctacccgggaggcccaaaagcgcacagctgccggaattatgaagaaccccaccgttgatggcatcgtggccatcgacctggatcccgtcgtgtatgacgcgaaatttgaaaagcagctggggcagattatgctccttatcctgtgtacgtctcagattctgctcatgagaacaacctgggctctgtgcgagagcatcacacttgccaccggacctctgaccacactctgggagggctccccgggcaaattctggaatacgaccattgctgtgtctatggccaacatctttcgggggagctacctggccggagctggcctggccttctccctcatgaaaagccttgggggaggccgcagagggacaggagcgcaaggcgaaaccctgggcgagaaatggaagcggcagctgaatcagctctccaagtctgagttcaacacatataaaagaagcgggatcatggaggttgaccgctccgaagccaaggagggactgaaacggggcgagaccacgaagcacgctgtctctagagggacagccaaacttcgctggtttgtggaacggaatctggtgaagcccgagggaaaggtcattgatctcggctgtgggagaggaggctggagctactattgcgctggcctgaaaaaggttaccgaagtgaaagggtacaccaagggaggccctgggcacgaggaacccatccctatggccacatacggatggaacctggtgaaactccattccggcaaggacgtcttctttattccccctgagaaatgtgatacccttctgtgcgacatcggggagtctagcccgaatcccacaattgaagagggacgcacgctgcgggtgctcaagatggttgaaccttggctgagaggcaaccagttctgtatcaagattcttaatccctatatgccttccgtggtcgaggcgctggagcaaatgcagcgcaaacacggcgggatgctcgtgcggaaccccctgagcagaaattctacccatgaaatgtactgggtttcctgcggaacaggcaacatcgtgagcgccgtcaatatgacctctcgcatgctgctcaaccggtttacaatggctcacagaaagccgacctatgagcgcgatgtggacctggggacgggaaccagacacgtggccgtcgaacctgaggttgctaaccttgatatcattggccagcggatcgaaaatattaaacatgagcacaagtccacatggcattacgacgaggataacccctataaaacctgggcctaccacgggagctatgaagtgaagccctctggatccgctagctccatggtgaatggcgtcgtgaagctgctcacaaaaccttgggacgttatccccatggtgacccagattgccatgacagataccacgcctttcggccaacagcgcgtctttaaggagaaagtggacacaagaaccccgaaggcgaaacgggggaccgcccagatcatggaagttacagctagatggctgtggggattccttagccggaacaagaagccccgcatctgtacgagagaggaatttacccggaaagtgcgctctaatgccgctattggcgccgtcttcgtggacgagaaccaatggaatagcgccaaggaggcggttgaagatgagagattttgggacctggtgcatcgggaacgcgagctccacaaacaggggaagtgcgctacatgcgtctacaacatgatgggaaaaagagaaaagaagctgggcgagttcgggaaagccaagggctcccgggccatctggtacatgtggctgggagctcgctttctcgagttcgaagccctgggcttcatgaatgaggatcactggttttctagagaaaacagcctttccggggtggagggagagggcctgcataaactcgggtatattctgcgggacatctctaagattcctggaggcaatatgtacgctgatgacaccgccgggtgggatacacgcatcaccgaagacgatcttcagaacgaggcgaaaatcacagacattatggaacccgagcacgccctgctcgctaaggccatcttcaaactgacctatcagaataaggtcgtgagagttcaacggcctgctaagaacggcacggtgatggatgtcattagccgcagagaccagcggggatccggccaggtggggacctacggactgaatacatttaccaacatggaagcccagctcatcagacaaatggagtctgagggcattttcagcccctccgaactggagacaccgaaccttgcggaacgcgccctggattggctcgagaaatatggggtggaacggctgaagagaatggctatcagcggagacgactgtgttgtgaaacctatcgatgaccgctttgccaccgctcttacggccctgaatgatatgggcaaggtccggaaagacattccccagtgggagccttctaaggggtggaacgattggcaacaggtgcccttctgctcccatcactttcaccaactcatcatgaaggacggcagagagattgttgtgccttgtcgcaatcaggatgaactggtcggacgggctagagtgagccagggcgccgggtggtctctgcgcgagacagcgtgcctcggaaaatcctacgcccagatgtggcaactgatgtatttccatcggagagaccttcgcctggctgccaacgccatctgtagcgctgtccccgtggattgggttccgacctcccggacaacctggtctattcacgcccatcaccagtggatgacgaccgaagacatgctcagcgtgtggaatagagtctggatcgaggaaaacccttggatggaggataagacacatatttccagctgggaggacgtgccctacctgggcaaacgggaagaccagtggtgcgggtctcttatcggactgaccgcgagagctacatgggccaccaatatccaagttgccattaaccaggtgcgccggctcatcggcaatgagaactacctggattatatgacatccatgaagagatttaaaaatgaaagcgaccccgagggggctctgtggtga

SEQ ID NO: 19256 - RNA, 9879 nt, synthetic construct
  misc_feature 1..9879: note = derived and/or modified CDS sequence (opt5) from DENV-1__EU482708__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaaaaagaagcagcggtccggcgtcctttgggacacgccttctcccccggaagtggagcgcgccgttctggatgacggcatctatagaattatgcagcgggggctgctcggacgcagccaggtgggcgtcggggtgtttcaagaaaacgttttccataccatgtggcacgtgacaagaggagccgtcctgatgtaccagggcaaacggcttgagccttcctgggctagcgtgaagaaagacctgatctcttacgggggaggctggagactccagggctcctggaataccggggaggaagtgcaggttattgccgtcgagcccggaaagaaccctaaaaatgtgcaaacagcgcccggcacctttaagacaccggaaggggaggtgggagctatcgccctggatttcaagcctggcacgagcgggtctcccattgtcaaccgcgaaggaaaaatcgtgggcctctatggcaatggggttgtgaccacatccggaacctacgtcagcgccatcgctcaggccaaggcgtcccaggagggccctctgcccgagattgaagacgaggtgtttcggaaaagaaaccttaccatcatggatctgcaccccgggtctggaaagacacgccggtatctgcctgctattgttagagaagccatcaaacgcaagctccggacgctgattcttgccccgaccagagtggtcgctagcgagatggccgaagctctgaagggcatgcccatccgctaccaaacaaccgccgtgaaatccgagcatacagggaaggagatcgttgacctcatgtgccacgcgaccttcacgatgcggctgctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctccgcaaaaatggaaagagagtgatccagctttctcggaagaccttcgatacggaataccagaaaaccaagaacaacgactgggactacgtcgtgaccacagatattagcgagatgggcgccaatttcagagccgaccgcgttatcgatcctcggagatgcctgaaacccgtgattctgaaggacgggccggaacgcgtcatcctcgctggccctatgcccgtgaccgttgcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtggaactgatgcgcagaggcgacctcccggtctggctttcttacaaggtggcttccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgcccggacatactccgaccctctggctcttagagagtttaaggagttcgccgctggccgccggtctgttagcggggatctgatctccgagattggaaaactcccccagcacctgacccagagagcccaaaatgcgctggacaacctcgtgatgcttcataattctgaacagggcgggcgggcctatcgccacgctatggaggagctgcctgatacaatcgaaaccctgatgctcctggcccttattgctgtgctgacgggaggcgtcacactctttttcctgagcggcagagggctgggaaagacctccatcggcctcctttgtgttatggccagctctgtgctgctgtggatggcctccgtggagccccattggattgctgcgagcatcatcctcgaatttttcctgatggtccttctgattccggagcctgaccggcagcgcacaccccaggataaccaactcgcctacgtggttatcgggctgctgtttatgattctcacagtggctgccaatgagatgggacttctggaaaccacaaagaaagacctgggcatcgggcacgtcgccgtggagaaccaccatcacgctgccatgctcgatgtcgacctgcatcctgcgtctgcctggacgctttacgctgtggccaccacaattatcacccccatgatgagacacacaattgaaaacaccacggctaatatctccctgaccgccatcgcgaaccaggccgctattctcatgggactggataagggctggcctatcagcaaaatggacattggcgttcccctgctcgcccttgggtgctattctcaggtgaatccgctgacactgaccgctgccgtcctcatgctggtggctcattacgccatcattggacctggccttcaagcgaaggccacacgggaggctcagaaacgcaccgccgctgggatcatgaagaaccccacggttgatggaatcgtggccattgacctggatcccgtcgtgtatgacgccaagttcgaaaaacagctcggccagatcatgctgctgattctctgtacaagccaaatccttctgatgagaaccacatgggcgctgtgcgagtccattaccctcgctaccgggcctctgacaacgctttgggagggatctccgggcaagttttggaataccacaatcgccgtgagcatggctaacatcttccggggctcctacctggccggggccggactcgctttcagcctgatgaaatccctgggcgggggacgcagaggcaccggggcccagggagaaacactcggcgagaagtggaaacggcagcttaatcagctgtctaagagcgaatttaacacctataagagatccggcattatggaggttgaccgctctgaagcgaaagaggggctgaagcggggagagacgacaaaacacgccgtcagcagaggcaccgctaagctccgctggttcgtggaacggaatctggtgaaacccgaggggaaggtcatcgatcttggatgtggcagagggggatggtcctactattgcgccggcctgaagaaagttaccgaagtgaagggctacacaaaagggggacctggccacgaggaacccattcctatggctacctacgggtggaacctcgtgaagctgcattctggaaaagacgtctttttcattccccctgagaagtgtgatacactgctctgcgacattggcgagagctccccgaatcccacgatcgaagaggggcgcacccttcgggtgctgaaaatggttgaaccttggctgagaggaaaccaattttgtattaagatcctcaatccctatatgcctagcgtggtcgagacactggagcagatgcagcgcaagcacggcggcatgcttgtgcggaaccccctgtctagaaattccacccatgaaatgtactgggttagctgcgggacaggaaacatcgtgtctgccgtcaatatgacctcccgcatgctcctgaaccggttcacgatggcgcacagaaaaccgacctatgagcgcgatgtggacctgggcgccgggacaagacacgtggctgtcgaacctgaggttgccaacctcgatattatcggacagcggattgaaaatatcaagcatgagcacaaaagcacctggcattacgacgaggataacccctataagacatgggcttaccacggctcttatgaagtgaaaccctccgggagcgcctccagcatggtgaatggagtcgtgaagctgcttaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctgtgggggtttctctctagaaacaagaagccccggatttgtacccgcgaggagttcacaagaaaagtgcggagcaatgctgccatcggagctgtctttgtggacgagaaccagtggaactccgccaaggaggccgttgaagatgagcgcttctgggacctggtgcatagagaacgggagcttcacaaacagggcaagtgcgcgacctgcgtctacaacatgatggggaaacgcgaaaagaagctgggagagtttggcaaagctaaggggtctagagccatttggtacatgtggctcggcgcccggttcctggagttcgaagctctgggatttatgaatgaggatcactggttcagccgcgaaaactccctctctggcgtggagggggagggactgcataaacttggctatatcctgagagacattagcaagatccctgggggaaatatgtacgccgatgacacagctggctgggatacccggatcacagaagacgatctccagaacgaggcccgcattaccgacatcatggaacccgagcacgcgctgcttgccagatccatttttaaactgacgtatcaaaataaggtcgtgcgggttcagcgccctgctaaaaacgggaccgtgatggatgtcatctctagacgggaccagagaggcagcggacaggtgggcacatacgggctcaataccttcacaaacatggaagcccaactgattcgccagatggagtccgagggaatctttagcccctctgaactggagaccccgaacctcgctgaacgggtgctggattggcttgagaagtatggcgttgaaagactgaagcgcatggccatctccggggacgactgtgtggtcaaacctattgatgaccggttcgcgacggccctcacagctctgaatgatatgggaaaggtgagaaaagacatcccccagtgggagcctagcaagggctggaacgattggcagcaagttcccttttgctctcatcacttccaccagcttattatgaaagacgggcgcgagatcgtggtcccttgtcggaatcaggatgaactggtgggcagagcccgcgtctcccagggagctggctggagcctccgggagaccgcctgcctggggaagtcctacgctcaaatgtggcagctgatgtattttcatagacgcgacctccggctggccgcgaacgccatttgttctgctgtgcccgttgattggatcccgacaagcagaaccacgtggtccattcacgcccatcaccagtggatgaccacagaagacatgcttagcgtgtggaatcgggtctggatcgaggaaaacccttggatggaggataagacccatatctcttcctggggagacgtgccctacctgggcaaaagagaggaccaatggtgcgggagcctcattggactgacagcccgcgctacctgggccacaaatatccaggttgcgattaaccaggtgcggagacttatcggcaatgaaaactacctggattatatgacctctatgaagcgcttcaaaaatgagagcgaccccgaaggggctctctggtga

SEQ ID NO: 19257 - RNA, 9879 nt, synthetic construct
  misc_feature 1..9879: note = derived and/or modified CDS sequence (opt5) from DENV-1__EU482709__SS-prME
  source 1..9879: mol_type = other RNA
agcgtgaccatgctgctcatgctggtgcccacagcccttgctttccacctgacgaccagaggcggggaacctcatatgatcgtttccaagcaggaacgggggaaatctctcctgtttaagacaagcgccggcgtgaacatgtgcacccttatcgcgatggacctgggggagctctgtgaagatacaatgacctacaaatgcccccgcatcacagagaccgaacccgacgatgtggactgttggtgcaatgctacggatacctgggtcacatatggaacctgttcccaaacaggcgagcacagacgggacaagcgctctgtggccctggcccctcatgttgggctgggactcgagaccagaacggaaacatggatgagctccgagggcgcttggaaacagattcagcgggtggaaacctgggccctgcgccaccccggcttcacagtcatcgctctttttctggcccatgcgattgggacctctatcacccagaagggaatcattttcatcctcctgatgcttgtgacacctagcatggccatgagatgcgttggcattgggtcccgggattttgtggagggactgagcggcgctacgtgggtcgacgtggtgctcgagcacgggtcttgtgtcaccacaatggccaaggataaacccaccctggacatcgaactgctcaagacagaggttaccaaccctgctgtgctgcgcaaactttgcattgaagccaagatctccaatacgacaaccgatagcagatgtccgacccaaggagaggcgacactggtggaagaacaagacgccaacttcgtctgccggcgcacctttgtggatagaggctggggcaatgggtgtggactcttcggcaaagggtctctgattacatgcgctaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgccacgattacaccccaagctcctaccaccgagatccagctcacagactacggcgccctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggttgtgctgggaagccaagagggcgccatgcacacggctctgaccggggccacagaaattcagacctccggaacaaccacgatctttgccggccatctcaaatgcagactgaagatggataaacttacactgaaggggatgagctatgtcatgtgtaccggctctttcaaactcgagaaggaagtggctgagacccagcacggaacagttctggtgcagattaagtacgagggcaccgacgccccgtgcaaaatccctttctccacacaagatgaaaagggggtcacgcagaacggacggctgatcaccgcgaatcccattgtgacagacaaagagaagcctgtgaacatcgaagctgagccgccctttggcgagagctatattgttatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtctttaccagcgtgggcaaactggtgcatcagattttcgggacggcctacggagtcctcttttccggcgtgagctggaccatgaagatcgggattggcgttctgcttacatggctgggactcaattctagatccaccagcctgtctatgacatgtatcgctgtgggcctggtcaccctttacctcggggtgatggttcaggccgattccggatgcgtgattaactggaaaggccgcgaactgaagtgtgggagcggaatcttcgtcacaaatgaggtgcacacctggacggaacaatataagtttcaggctgactcccctaaacggctgtctgccgcgattggcaaggcctgggaggagggggtttgcggcatcagaagcgctacacgcctcgaaaacatcatgtggaaacagatttccaacgagctgaatcatatccttctggaaaacgacatgaagttcaccgtggtcgtgggagatgtggccggcattctcgctcaggggaaaaagatgatccggccgcaacccatggagtacaaatattcttggaaaagctggggaaaggccaagattatcggcgccgacgtccagaataccacatttatcattgatgggcctaacacccccgaatgtcctgacgatcagagagcttggaatatctgggaggttgaggactacggattcggcatttttacgacaaacatctggctgaagctgcgcgattcctatacccaggtgtgcgaccaccggcttatgagcgcggccattaaagattctaaggctgtgcacgccgacatgggctactggatcgaatccgagaaaaatgaaacatggaagctcgccagagctagcttcatcgaggtcaagacctgtatttggcccaaatctcatacactgtggtccaacggggtgctggaaagcgagatgatcattccgaagatctatggaggccctatttctcaacacaattaccgccccgggtacttcacccagacggccggaccttggcatctcggcaaactggagcttgattttgacctgtgcgaagggaccacagttgtggtcgatgagcactgcggaaaccggggccccagcctcagaaccacaaccgtgacgggcaagatcatccacgaatggtgttgccggtcctgtacactgcctcccctgcgcttcagaggggaggacggatgctggtatggcatggagattcggccggttaaagaaaaggaggaaaatcttgtcaagagcatggtctctgcggggtccggagaggtggacagcttttccctcggcctgctgtgtatctctattatgatcgaagaggttatgagaagccgctggtcccggaaaatgctcatgaccgggacactggctgtgttctttcttctgattatgggacagctcacctggaacgatctgatcagactgtgcattatggtcggcgccaatgcctctgaccgcatgggcatggggaccacataccttgctctgatggccacgttcaagatgagacctatgtttgcggtgggactcctgttccggcgcctcaccagcagagaggtgctgcttctgacaatcggcctctccctggtcgcttctgttgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggtgctttccattgtgagcctgttccccctctgtctgtctaccacatcccagaagaccacatggctccctgtcctgcttgggagcctgggatgcaagccgctgacgatgtttctcatcgctgagaataaaatttggggccggcgctcttggcccctgaacgaaggcatcatggccgtggggatcgtttccattcttctgagctccctcctgaagaacgatgtgcctctcgcgggacccctgatcgccggcgggatgcttattgcttgttacgtcatcagcggatctagcgccgacctgtccctggagaaagctgccgaggtgtcttgggaagaggaagccgagcatagcggcgcttcccacaatattctcgttgaagtgcaggatgacgggaccatgaagatcaaagatgaggagagagacgatacactgaccatccttctgaaggcgacactcctggccgtctctggagtgtatcctctcagcattcccgctaccctgttcgtctggtacttctggcagaagaagaagcagcggtccggcgtgctttgggacacgccttctcccccggaagttgagcgcgccgtgctggatgacggcatctatagaattatgcagcgggggctgctcggacgcagccaggtcggcgtgggggtttttcaagaaaacgtgttccataccatgtggcacgtcacaagaggagccgtgctgatgtaccagggcaaacggcttgagccttcctgggctagcgtgaagaaagacctgatctcttacgggggaggctggagactccagggctcctggaataccggggaggaagttcaggtcattgccgtggagcccggaaagaaccctaaaaatgtgcaaacagcgcccggcacctttaagacaccggaaggggaggtcggagctatcgccctggatttcaagcctggcacgagcgggtctcccattgtgaaccgcgaaggaaaaatcgttggcctctatggcaatggggtggtcaccacatccggaacctacgtgagcgccatcgctcaggccaaggcgtcccaggagggccctctgcccgagattgaagacgaggtttttcggaaaagaaaccttaccatcatggatctgcaccccgggtctggaaagacacgccggtatctgcctgctattgtgagagaagccatcaaacgcaagctccggacgctgattcttgccccgaccagagtcgtggctagcgagatggccgaagctctgaagggcatgcccatccgctaccaaacaaccgccgttaaatccgagcatacagggaaggagatcgtggacctcatgtgccacgcgaccttcacgatgcggctgctgagccctgtcagagtgcccaattataacatgattatcatggatgaagcccattttacagacccttcttccattgctgcccggggctacatcagcacccgcgtgggaatgggcgaggctgccgccattttcatgaccgctacaccccctgggtctgtcgaagcgtttccgcagagcaatgccgttatccaggatgaggaaagagacatccccgagcggtcctggaactctggatatgagtggattaccgatttccctggcaaaacagtgtggtttgtgcccagcatcaagtccgggaatgacattgctaactgtctccgcaaaaatggaaagagagtcatccagctttctcggaagaccttcgatacggaataccagaaaaccaagaacaacgactgggactacgtggttaccacagatattagcgagatgggcgccaatttcagagccgaccgcgtgatcgatcctcggagatgcctgaaacccgtcattctgaaggacgggccggaacgcgtgatcctcgctggccctatgcccgttaccgtggcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtcgaactgatgcgcagaggcgacctcccggtgtggctttcttacaaggtcgcttccgaggggtttcaatatagcgatcggcgctggtgcttcgacggcgaaagaaacaatcaggtgctggaggaaaacatggatgttgagatctggaccaaagagggagaacggaagaaactgagaccccgctggctcgacgcccggacatactccgaccctctggctcttagagagtttaaggagttcgccgctggccgccggtctgtgagcggggatctgatcctcgagattggaaaactgccccagcacctgacccagagagcccaaaatgcgctcgacaaccttgtgatgctgcataattccgaacagggcgggcgggcctatcgccacgctatggaggagctgcctgatacaatcgaaaccctcatgctgcttgccctgattgctgtcctcacgggaggcgttacactgtttttcctgtctggcagagggctcggaaagaccagcatcggccttctgtgtgtgatggcctccagcgtgctgctctggatggcctctgtcgagccccattggattgctgcgtccatcatcctggaatttttccttatggtgctgctcattccggagcctgaccggcagcgcacaccccaggataaccaactggcctacgttgtgatcgggctgctctttatgattcttacagtcgctgccaatgagatgggactgctggaaaccacaaagaaagacctcggcatcgggcacgtggccgtcgagaaccaccatcacgctgccatgctggatgtggaccttcatcctgcgagcgcctggacgctgtacgctgttgccaccacaattatcacccccatgatgagacacacaattgaaaacaccacggctaatatctctctcaccgccatcgcgaaccaggccgctattctgatgggactggataagggctggcctatctccaaaatggacattggcgtgcccctccttgccctggggtgctatagccaggtcaatccgctgacactcaccgctgccgtgctgatgcttgttgctcattacgccatcattggacctggcctgcaagcgaaggccacacgggaggctcagaaacgcaccgccgctgggatcatgaagaaccccacggtggatggaatcgtcgccattgacctcgatcccgtggtgtatgacgccaagttcgaaaaacagctgggccagatcatgctgctcattctttgtacatctcaaatcctgctgatgagaaccacatgggcgctctgcgagagcattaccctggctaccgggcctcttacaacgctgtgggagggatccccgggcaagttttggaataccacaatcgccgtttctatggctaacatcttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcattatggaggtcgaccgctccgaagcgaaagaggggctcaagcggggagagacgacaaaacacgccgtgtctagaggcaccgctaagctgcgctggttcgtggaacggaatcttgtcaaacccgaggggaaggttatcgatctgggatgtggcagagggggatggagctactattgcgccggcctcaagaaagtgaccgaagtgaagggctacacaaaagggggacctggccacgaggaacccattcctatggctacctacgggtggaacctggtcaagctgcattccggaaaagacgtgtttttcattccccctgagaagtgtgatacactcctttgcgacattggcgagtctagcccgaatcccacgatcgaagaggggcgcaccctgcgggttctgaaaatggtggaaccttggctcagaggaaaccaattttgtattaagatcctgaatccctatatgccttccgtcgtggagacacttgagcagatgcagcgcaagcacggcggcatgctggttcggaaccccctcagcagaaattctacccatgaaatgtactgggtgtcctgcgggacaggaaacatcgtcagcgccgtgaatatgacctctcgcatgctgctgaaccggttcacgatggcgcacagaaaaccgacctatgagcgcgatgtggacctcggcgccgggacaagacacgtcgctgttgaacctgaggtggccaacctggatattatcggacagcggattgaaaatatcaagcatgagcacaaatccacctggcattacgacgaggataacccctataagacatgggcttaccacggcagctatgaagtgaaaccctctgggtccgccagctccatggtcaatggagtggttaaacttctgaccaagccttgggacgtgattcccatggtcacacaaatcgctatgaccgatacgacaccttttggccagcagcgcgtgttcaaagagaaggttgacaccagaaccccgaaagccaagcggggcacagcgcaaatcatggaagtgacggccaaatggctctgggggtttctgagcagaaacaagaagccccggatttgtacccgcgaggagttcacaagaaaagtccggtctaatgctgccatcggagctgtgtttgttgacgagaaccagtggaatagcgccaaggaggccgtggaagatgagcgcttctgggaccttgtccatagagaacgggagctgcacaaacagggcaagtgcgcgacctgcgtgtacaacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtcgagggggagggacttcataaactgggctatatcctcagagacatttctaagatccctgggggaaatatgtacgccgatgacacagctggctgggatacccggatcacagaagacgatctgcagaacgaggcccgcattaccgacatcatggaacccgagcacgcgcttctggccaaaagcatttttaagctcacgtatcaaaataaagtggttagagtgcagcggcctgctaagaacgggaccgtcatggatgtgatctcccgcagagaccagcggggctctggacaggtgggcacatacgggctgaataccttcacaaacatggaagcccaactgattagacagatggagagcgagggaatcttttcccccagcgaactcgagaccccgaacctggctgaacgcgttcttgattggctggagaagtatggcgtggaacggctcaaaagaatggccatctctggggacgactgtgtcgtgaagcctattgatgaccgcttcgcgacggccctgacagctcttaatgatatgggaaaagttcggaaggacatcccccagtgggagccttccaaaggctggaacgattggcagcaagtgcccttttgcagccatcacttccaccagctgattatgaaggacgggagagagatcgtcgtgccttgtcgcaatcaggatgaactcgtcggccgggccagagtgtctcagggagctggctggtccctgcgcgagaccgcctgcctgggaaagagctacgctcaaatgtggcagctcatgtattttcatcggagagacctgcgccttgccgcgaacgccatttgttccgctgttcccgtggattggatcccgacatctcggaccacgtggagcattcacgcccatcaccagtggatgaccacagaagacatgctgtccgtctggaatagagtgtggatcgaggaaaacccttggatggaggataaaacccatatcagctcttggggagacgttccctacctcggcaagcgggaggaccaatggtgcgggtccctgattggacttacagccagagctacctgggccacaaatatccaggtggcgattaaccaggtccgccggctgatcggcaatgaaaactacctcgattatatgaccagcatgaaaagattcaagaatgagtctgaccccgaaggggctctgtggtga

SEQ ID NO: 19258 - RNA, 9879 nt, synthetic construct
  misc_feature 1..9879: note = derived and/or modified CDS sequence (opt5) from DENV-1__EU482710__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaatatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaacactcttggaaaagctggggaaaggccaagatcattggcgccgacgtccagaataccacctttatcatcgatgggcctaacacacccgaatgtcctgacgatcagagagcttggaatatttgggaggttgaggactacggattcggcatctttaccacgaacatttggctgaagctgcgcgattcctatacacaggtgtgcgaccatcggcttatgagcgcggccatcaaagattctaaggctgtgcacgccgacatgggctactggattgaatccgagaaaaatgaaacctggaagctcgccagagctagcttcatcgaggtcaagacatgtatctggcccaaatctcataccctgtggtccaacggggtgctggaaagcgagatgattatcccgaagatttatggaggccctatctctcaacacaatcaccgccccgggtacttcacacagaccgccggaccttggcatctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtatggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctacctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgtgagcctgttccccctctgtctgtctaccacctcccagaagacaacctggcttcctgtcctgctggggagcctcggatgcaaaccgctgacaatgtttcttattacggagaataagatctggggcagaaaatcttggcccctgaacgaaggcattatggctgtgggggttgtgtccatcctcctgagctccctcctgaagaacgatgtccctcttgccggacccctgatcgcgggcgggatgctgattgcctgttatgtgatcagcggatctagcgctgacctctccctggagaaagccgctgaggtttcttgggaagaggaagccgagcacagcggcgcctcccacaatattcttgtggaagtccaggatgacgggaccatgaagatcaaagatgaggagcgggacgatacactgaccattctcctgaaggctacactcctggcggtgtctggagtctaccctcttagcatccccgccaccctgttcgtgtggtatttttggcaaaagaaaaagcagcgctccggcgttctgtgggacacgccttctcccccggaagtggagagagctgtcctcgatgacggcatctaccggattatgcagcgcgggctgcttggaagaagccaggtgggcgttggggtgttccaagaaaacgtcttccataccatgtggcacgtgacacggggagccgtgctgatgtatcagggcaaacgcctcgagccttcctgggccagcgttaagaaagacctgatctcttacgggggaggctggagactccagggctcctggaataccggggaggaagtccaggtgattgctgtggagcccggaaagaaccctaagaatgtccaaacagcccccggcacctttaaaacaccggaaggggaggtgggagcgatcgctctggatttcaagcctggcacgagcgggtctcccattgttaaccgggaaggaaaaatcgtgggcctttatggcaatggggtcgtgaccacatccggaacctacgttagcgccattgcccaggctaaggcctcccaggagggccctctgcccgagatcgaagacgaggtgtttagaaaacgcaacctgaccatcatggatctccatcccgggtctggaaagacacggagatacctgcctgcgattgtccgcgaagctatcaagcggaaacttagaacgctgattctcgccccgacccgcgtggttgccagcgagatggctgaagccctgaagggcatgcccatccggtatcaaacaaccgctgtgaaatccgagcacacagggaaggagattgtcgacctgatgtgccatgccaccttcacgatgagactccttagccctgtgcgcgtgcccaattacaacatgatcatcatggatgaagcgcactttacagacccttcttccattgccgctcggggctatatcagcaccagagtcggaatgggcgaggccgctgccattttcatgaccgccacaccccctgggtctgttgaggcttttccgcagagcaatgcggtgatccaggatgaggaacgggacattcccgagcgctcctggaactctggatacgagtggatcaccgatttccctggcaaaacagtgtggtttgtccccagcatcaagtccgggaatgacattgccaactgtctgagaaagaatggaaaacgggtgatccagctgtctcgcaagaccttcgatacggaatatcagaagaccaagaacaacgactgggactacgttgtgaccacagatattagcgagatgggcgctaattttagagccgaccgggtcatcgatcctagacgctgcctcaaacccgtgattctgaaggacgggccggaacgggttatccttgccggccctatgcccgtgaccgtcgcttccgccgcgcagagacgcggacggattggcagaaaccacaataaggagggggatcagtatatctacatgggacagcccctgaacaatgacgaggatcatgctcactggacggaagccaaaatgctcctggacaacatcaatacccctgagggcattatccccgccctgttcgaacctgagcgcgaaaagagcgctgccattgatggggagtaccggctcagaggagaggcgcgcaaaacattcgtggaacttatgagacggggcgacctgccggtctggctgtcttataaggtggcctccgaggggtttcaatacagcgatcgcagatggtgcttcgacggcgaacggaacaatcaggttctcgaggaaaacatggatgtggagatctggaccaaagagggagaacgcaagaaactgagaccccggtggcttgacgctagaacatattccgaccctctggccctccgcgagtttaaggagttcgctgccggccggagatctgtgagcggggatctgatttccgagatcggaaagctgccccagcatctcacccagcgcgctcaaaatgcccttgacaacctggtcatgctgcacaattctgaacagggcgggcgggcgtacagacacgccatggaggagctccctgatacaatcgaaaccctgatgcttctggctctcattgccgttctgacgggaggcgtgacactgtttttcctcagcggccgggggcttggaaaaacctccatcggcctgctgtgtgtgatggctagctctgtcctcctgtggatggcctccgtggagccccattggattgccgctagcatcattcttgaatttttcctgatggttctcctgatcccggagcctgaccgccagagaacaccccaggataaccaactggcgtatgtggtcatcgggctcctttttatgattctgacagtggccgctaatgagatgggactgctcgaaaccacaaagaaagacctgggcatcgggcacgtcgccgtggagaaccatcaccatgccacgatgcttgatgttgacctgcaccctgcttctgcctggaccctctacgcggtggccacaaccattatcacacccatgatgcggcacaccattgaaaacacgaccgctaatatctccctgacagccattgctaaccaggccgcgatcctgatgggactcgataagggctggcctatcagcaaaatggacattggcgtcccccttctggccctggggtgctattctcaggtgaatccgctcaccctgacagctgccgttcttatgctggtggctcattacgccatcattggacctggcctccaagctaaggccacccgcgaggcgcagaagagaacggccgctgggatcatgaaaaaccccacagtcgatggaattatcgccatcgacctggatcccgtggtgtacgacgctaagttcgaaaaacagctgggccagattatgctccttatcctgtgtaccagccaaattctgctcatgcggacaacctgggccctgtgcgagtccatcacccttgccacagggcctctgacgaccctctgggagggatctccgggcaagttttggaatacaaccattgcggttagcatggctaacatcttccgcggctcctatctggccggggctggactggcctttagcctcatgaaatcccttggcgggggaagacggggcacaggggcccagggagaaaccctgggcgagaagtggaagcgccagctgaatcagctctctaaaagcgagttcaacatctacaagagatccggcattatggaggtcgaccggtctgaagctaaagaggggctgaagagaggagagacgacacgccacgccgtgagccggggcaccgcgaaacttagatggttcgtggaacgcaatctggtcaagcccgaggggaaggttatcgatctcggatgtggcagagggggatggtcctattactgcgccggcctgaaaaaggtgaccgaagtgaaaggctatacaaaagggggacctggccatgaggaacccattcctatggctacctacgggtggaacctggtcaaactccactctggaaaggacgtgtttttcacaccccctgagaaatgtgatacgcttctgtgcgacatcggcgagagctccccgaatcccaccattgaagaggggagaacactgcgcgttctcaagatggtggaaccttggctgcggggaaaccaattttgtatcaagattcttaatccctatatgcctagcgtcgtggagaccctggagcagatgcagagaaaacacggcggcatgctcgttcgcaaccccctgtctagaaattccacacatgaaatgtactgggtgagctgcgggaccggaaacatcgtctctgccgtgaatatgacgtccagaatgctgctcaaccgcttcaccatggctcaccggaagccgacatacgagagagatgtggacctgggcgccgggacccgccatgtcgcggttgaacctgaggtggccaaccttgatatcattggacagagaatcgaaaatattaaacacgagcataagagcacatggcactatgacgaggataacccctacaaaacctgggcttatcacggctcttacgaagtgaagccctccgggagcgcctccagcatggtcaatggagtggttaagctgctcacaaaaccttgggacgtgatccccatggtcacccaaattgctatgacggatacaaccccttttggccagcagcgggtgttcaaggagaaagttgacacccgcacaccgaaggccaaaagaggcacggctcaaatcatggaagtgaccgcccggtggctgtgggggtttctttctagaaacaagaagccccggatctgtacacgcgaggagttcaccagaaaagtccggagcaatgcggccattggagctgtgtttgttgacgagaaccagtggaactccgccaaggaggctgtggaagatgagcgcttctgggacctggtccagaaagaaagagagctccataagcagggcaaatgcgccacatgcgtgtataacatgatggggaagcgggaaaagaaactgggagagtttggcaaggccaaagggtctcgcgcgatctggtacatgtggctgggcgctagattcctcgagtttgaagccctgggattcatgaatgaggatcactggttcagccgggaaaactccctttctggcgtcgagggggagggactgcataagctcggctatattctgcgcgacatcagcaaaattcctgggggaaatatgtacgccgatgacaccgctggctgggatacaagaatcaccgaagacgatcttcaaaacgaggccaagatcacggacattatggaacccgagcacgctctgctcgccacctccatctttaaactgacataccagaataaggtggttcgggtgcagcgccctgcgaagaacgggaccgtcatggatgtgatttctagacgggaccagcgcggcagcggacaagtgggcacatatgggctgaataccttcacgaacatggaagcccagctcatcagacagatggagtccgagggaatttttctgcccagcgaacttgagacaccgaacctggctgaacgggttctcgattggctggagaaatacggcgtggaaagacttaagcgcatggccatctctggggacgactgtgtcgtgaaacctatcgatgaccggttcgctaccgccctgacagcgctcaatgatatgggaaaggttagaaaagacattccccagtgggagccttccaagggctggaacgattggcaacaggtgcccttttgcagccaccatttccaccagctgatcatgaaggacgggcgcgagattgtcgtgccttgtcggaatcaggatgaactggtcggcagagcccgcgtgtctcaaggagctggctggtccctccgggagaccgcctgcctggggaaaagctatgctcagatgtggcagcttatgtactttcatagacgcgacctgcggctcgccgctaacgccatctgttccgcggttcccgtggattgggtcccgacgtctagaaccacatggagcattcacgcccatcaccaatggatgaccacagaagacatgctgtccgtgtggaatcgcgtttggatcgaggaaaacccttggatggaggataagacccacgtgagctcttggggagacgtcccctatcttggcaaacgggaggaccagtggtgcgggtccctgattggactcacagctagagccacctgggccagcaatatccaggtggctatcaaccaggtgcggagactgattggcaatgaaaactacctggattatatgacgtctatgaagcgcttcaaaaatgagggggaccccgaaggcgccctctggtga

SEQ ID NO: 19259 - RNA, 9879 nt, synthetic construct
  misc_feature 1..9879: note = derived and/or modified CDS sequence (opt5) from DENV-1__EU482712__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaaattatggaggccctattagccagcacaactaccgccccgggtactttacacaaaccgcgggaccttggcatctgggcaagctcgagctggatttcgacctttgcgaagggacgaccgtggttgtggatgagcactgcggaaatcggggcccctccctgagaacaaccacagtcaccggcaaaatcattcacgaatggtgttgccggagctgtacgctccctcccctgcgctttaagggggaggacggatgctggtatggcatggagatcagaccggtgaaggaaaaagaggaaaacctggttaagtctatggtgtccgctgggagcggagaggtcgactccttctctcttggcctcctgtgtatcagcattatgatcgaagaggtgatgcggtccagatggtctcgcaaaatgctgatgacagggaccctcgccgttctgtttcttctgattatgggacagctcacatggaatgatctgatccggctgtgcattatggtgggcgccaacgctagcgacagaatgggcatggggaccacctaccttgccctgatggcgacattcaagatgcgccctatgtttgctgtcggactcctgttcagacggctcacgtcccgcgaggtgctgcttctgaccatcggcctctctctggtggccagcgtcgaactgcccaattcccttgaggaactgggggatggactcgccatgggcattatgatcctgaaactcctgacagactttcagagccatcaactttgggctaccctgctctctctgacattcatcaagaccacgttttccctgcactatgcctggaagacaatggctatggttcttagcattgtgtctctgttccccctctgtctgtccaccaccagccagaaaacaacctggctccctgtgctgcttgggtctctgggatgcaagccgctgacaatgtttctcatcgccgagaacaaaatttggggcagaaagtcctggcccctgaacgaaggcatcatggcggtcgggattgtgagcatccttctgtccagcctcctgaaaaatgatgttcctctcgccggacccctgatcgctggcgggatgcttattgcctgttacgtgatctctggaagctccgctgacctgtctctggagaaggccgccgaggtcagctgggaagaggaagctgagcattccggcgcgtctcacaacattctcgtggaagttcaggatgacgggacgatgaaaatcaaggatgaggagcgggacgataccctgacaattcttctgaaggccaccctcctggctgtgagcggagtctatcctctctccatccccgccacactgttcgtgtggtacttctggcagaaaaagaaacaacgctctggcgtcctttgggacaccccttcccctcccgaagtggagagagccgttctggatgacggcatctatcggattatgcagcgcgggctgctcggaagatcccaggtgggcgtcggggtgtttcaggaaaatgttttccatacgatgtggcacgtgacccggggagctgtcctgatgtaccaaggcaagcgccttgagcccagctgggcctctgtgaaaaaggacctgatctcctacgggggaggctggagactccagggcagctggaacacaggggaggaagtgcaggttattgcggtcgagcccggaaagaatcctaaaaacgtgcagaccgctcccggcacatttaagacctctgaaggggaggtgggagccatcgccctggatttcaaaccgggcacatccgggagccctattgtcaatcgggaaggaaagatcgtgggcctctatggcaacggggttgtgacgacctccggaacatacgtctctgctattgcccaagcgaaagctagccaggagggccccctgcctgagatcgaagacgaggtgtttagaaagcgcaatcttaccatcatggatctgcaccccgggtccggaaagacccggagatatctgcccgccattgttcgcgaagccatcaaacggaagctcagaacactgattcttgctcctacgcgcgtggtcgccagcgagatggctgaagccctgaaaggcatgccgatccggtaccagaccacagcggtgaagtctgagcataccgggaaagagattgttgacctcatgtgccacgccacattcaccatgagactgctgtcccccgtgcgcgtccctaactataatatgatcatcatggatgaagctcattttacggaccccagctctattgccgctcggggctacatcagcacaagagtgggaatgggcgaggccgccgctattttcatgaccgcgacccctcccgggtccgtggaagcctttcctcaatctaacgctgtcatccaggatgaggaacgggacattccggagcgcagctggaactccggatatgagtggatcacagatttccccggcaagaccgtttggtttgtgccttctatcaagagcgggaacgacattgccaattgtctccgcaagaatggaaagcgggtgatccagctttcccgcaaaacattcgataccgaataccagaagacgaaaaacaatgactgggactacgtcgtgacaaccgatattagcgagatgggcgccaacttcagagctgaccgggttatcgatcccagacgctgcctgaagcctgtgattctgaaggacgggcccgaacgggtcatcctcgccggcccgatgcctgtgacagttgcgtctgctgcccaaagacgcggacggattggcagaaatcacaacaaagagggggatcagtatatctacatgggacagcccctgaataacgacgaggatcatgcccactggaccgaagctaagatgcttctggacaatatcaacacgcccgagggcattatccctgccctctttgaacccgagcgcgaaaaatccgcggccattgatggggagtatcggctgagaggagaggctcgcaagaccttcgtggaactgatgagacggggcgacctccctgtctggcttagctacaaagtggcctccgaggggtttcagtattctgatcgcagatggtgcttcgacggcgaacggaataaccaagtcctggaggaaaatatggatgtggagatctggacaaaggagggagaacgcaaaaagctgagaccgcggtggctcgacgctagaacctacagcgaccccctggcccttcgcgagtttaaggagttcgctgccggccggagatccgtttctggggatctgattctcgagatcggaaaactgcctcagcacctgacacagcgcgcgcagaacgccctcgacaatcttgtgatgctgcataacagcgaacaaggcgggcgggcttatagacacgccatggaggagctgcccgataccatcgaaacactcatgctgcttgctctgattgccgtgctcaccggaggcgtcacgctgtttttcctgtccggccgggggctcggaaagacaagcatcggccttctgtgtgttatggcctcttccgtgctgctctggatggctagcgtggagcctcattggattgcggcctctatcattctggaatttttccttatggtcctgctcatccccgagccggaccgccagagaacccctcaggataatcagctggcttacgtggttatcgggctgctctttatgattcttaccgtggccgccaacgagatgggactgctggaaacaaccaaaaaggacctcggcatcgggcacgtcgctgtggagaaccaccatcacgccgcgatgctggatgtcgaccttcatcccgcctccgcttggacactgtacgccgtggctacgaccattatcacacctatgatgcggcacaccattgaaaatacaaccgccaacatcagcctcacggcgattgccaatcaagctgccatcctgatgggactggataaaggctggcccatctctaagatggacattggcgttcctctccttgctctggggtgctatagccaggtgaaccccctgaccctcacagccgctgtcctgatgcttgtggcccattacgcgatcattggaccgggcctgcaggccaaggctacccgcgaggcccagaagagaacagctgccgggatcatgaagaatcctaccgttgatggaattgtggccatcgacctcgatcccgtcgtgtatgacgcgaaattcgaaaagcagctgggccagatcatgctgctcattctttgtacgtcccagatcctgctgatgcggacaacctgggctctctgcgagtctattacactggccaccgggccccttaccacactgtgggagggaagccctggcaaattttggaacacgaccatcgctgtgtccatggccaatattttccgcggcagctacctcgccggggctggactggccttctccctgatgaagtctctcggcgggggaagacggggcacaggggcgcaaggagaaacccttggcgagaagtggaaacgccagctgaaccagctgagcaagtccgaatttaatacatataaaagatctggcatcatggaggttgaccggagcgaagccaaggaggggctcaaaagaggagagaccacgaagcacgctgtctcccgcggcacagccaagctgcggtggttcgtggaaagaaaccttgtgaaaccggaggggaaggtcatcgatctgggatgtggccgcgggggatggtcttactattgcgctggcctcaaaaaggttaccgaagtgaaaggctacaccaaagggggacccggccacgaggaacctattcccatggccacatacgggtggaatctggtgaaactgcatagcggaaaggacgtctttttcatccctcccgagaagtgtgataccctcctttgcgacattggcgagtccagccctaacccgacaatcgaagaggggcggacgctgagagtgctgaaaatggttgaaccctggctccgcggaaatcagttttgtattaagatcctgaacccttatatgccctctgtggtcgagacccttgagcaaatgcagcggaaacacggcggcatgctggtgagaaatcctctctcccgcaacagcacacatgaaatgtactgggtttcttgcgggaccggaaatattgtgtccgcggtcaacatgacaagccggatgctgctgaacagattcaccatggcccaccgcaagcccacgtatgagcgggatgtggacctcggcgctgggaccagacacgtggccgtcgaaccggaggttgctaatctggatatcatcggacagcgcattgaaaacatcaaacatgagcacaagtctacatggcattacgacgaggataatccttataagacctgggcctaccacggctcctatgaagtgaaacccagcgggtccgctagctctatggtgaacggagtcgtgaaacttctgacaaaaccctgggacgttattcctatggtgacccagatcgccatgacagataccacgccctttggccaacagagagtcttcaaggagaaagtggacacacggacccctaaggcgaagcgcggcaccgcccagattatggaagttacagctaaatggctctgggggtttctgagcagaaataagaaaccgcggatctgtacgagagaggagttcacccggaaggtgcgctccaacgccgctatcggagccgtctttgtggacgagaatcaatggaactctgccaaagaggcggttgaagatgagagattctgggaccttgtgcatcgggaacgcgagctgcacaagcagggcaagtgcgctacatgcgtctacaatatgatggggaaaagagaaaagaaactcggagagtttggcaaggccaaagggagccgggccatttggtacatgtggctgggcgctcgcttcctggagttcgaagccctcggatttatgaacgaggatcactggttctccagagaaaattctctgagcggcgtggagggggagggacttcataagctgggctatatcctccgggacatttccaaaatccccgggggaaacatgtacgctgatgacaccgccggctgggatacacgcattaccgaagacgatctgcagaatgaggcgaagatcacagacatcatggaacctgagcacgcccttctggctaagtctatttttaaactcacctatcagaacaaggtcgtgagagttcaacggcccgccaaaaatgggacggtgatggatgtcatcagccgcagagaccagcggggctccggacaggtgggcacctacgggctgaacacattcaccaacatggaagctcagctgattcgccaaatggagagcgagggaatcttttctccttccgaactcgagacacccaatctggccggcagagtgcttgattggctggaaaagcatggggttgagcggctcaaaagaatggcgattagcggagacgactgtgtggtcaagccgatcgatgaccgcttcgccaccgctctgacggcccttaacgatatgggcaaggtgcggaaagacatccctcagtgggaaccctctaaggggtggaatgattggcagcaggttcctttttgctcccaccacttccatcaactgattatgaaagacggcagagagatcgtggtcccctgtcgcaaccaggatgagctcgtgggacgggctagagtcagccagggcgccgggtggtccctgcgcgaaacagcttgcctgggaaagtcttatgcccagatgtggcaactcatgtactttcaccggagagacctgcgccttgcggccaatgctatttgtagcgccgtgcctgttgattgggtgcccacctcccggacaacctggagcatccatgcccaccatcagtggatgacgaccgaggacatgctgtctgtctggaacagagtgtggattgaagagaatccgtggatggaagataaaacacacatctccagctggggcgacgttccttatctcgggaagcgcgaggaccagtggtgcggatctctgattggccttaccgctcgggccacatgggcgaccaacatccaagtggctatcaatcaggtcagacggctgattgggaacgagaattacctcgattacatgacaagcatgaagagattcaaaaacgaatccgaccccgagggcgccctgtggtga

SEQ ID NO: 19260 - RNA, 9879 nt, synthetic construct
  misc_feature 1..9879: note = derived and/or modified CDS sequence (opt5) from DENV-1__EU249490__SS-prME
  source 1..9879: mol_type = other RNA
agcgtgaccatgctgctcatgctgatgcccaccgcccttgctttccacctgacgacccggggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcagaacattcgataccgaataccagaaaacgaagaacaacgactgggactacgtcgtgacaaccgatatcagcgagatgggcgccaattttcgggctgacagagttattgatccccgccggtgccttaaacctgtgatcctgaaggacgggcccgaaagagtcattctggccggcccgatgcctgtgacagttgcgtctgctgcccaacgccggggaagaatcggccgcaaccacaataaggagggggatcagtatatctacatgggacagcccctcaacaatgacgaggatcatgcccactggaccgaagctaaaatgctgcttgacaacattaatacgcccgagggcatcattcctgccctgttcgaacccgagcgggaaaagtccgcggccatcgatggggagtatagactccgcggagaggctagaaaaacctttgtggaactgatgcggcgcggcgacctgcctgtctggctcagctacaaggtggcctccgaggggttccagtattctgatagacggtggtgctttgacggcgaacgcaacaatcaagtccttgaggaaaacatggatgtggagatttggacaaaagagggagaaagaaagaaactgcggccgagatggctggacgctcgcacctacagcgaccccctcgccctgcgggagttcaaggaatttgctgccggcagacgctccgtttctggggatcttatcctggagatcggaaagctccctcagcacctgacacagcgggcgcagaatgccctggacaacctcgtgatgcttcataatagcgaacaaggcgggagagcttatcggcacgccatggaggagctgcccgataccattgaaacactgatgctcctggctcttatcgccgtgctgaccggaggcgtcacgctgttctttctgtccggccgcgggctgggaaaaacaagcattggcctcctttgtgttatggcctcttccgctctgctgtggatggcgagcgtggagcctcattggatcgccgcttctattatcctcgagttctttctgatggtgcttctgatccccgagccggacagacagcggacccctcaggataaccagctcgcctacgtcgtgattgggctgctgttcatgatcctcaccgttgccgctaatgagatgggacttctggaaacaaccaagaaagacctgggcattgggcacgtggccgtcgagaaccaccatcacgcggccatgctcgatgtggacctgcatcccgcttccgcctggacactttacgctgtcgccacgaccatcattacacctatgatgcgccacaccatcgaaaacacaaccgcgaatattagcctgacggccatcgctaaccaagccgctatcctcatgggactggataagggctggcccatttctaaaatggacatcggcgtgcctctgctcgcccttgggtgctatagccaggttaatcccctgaccctgacagctgccgtgctcatgctggtcgcgcattacgccattatcggaccgggccttcaggctaaggccaccagagaggctcaaaagcggacagccgccgggattatgaaaaaccctaccgtggatggaatcgttgcgatcgacctggatcccgtggtctatgacgctaagtttgaaaaacagctcggccagattatgctgctgatcctctgtacgtcccagattcttctgatgcgcacaacctgggccctgtgcgagtctatcacactcgctaccgggcccctgaccacactttgggagggaagccctggcaagttctggaatacgaccattgccgtgtccatggccaacatcttcagaggcagctacctggctggggccggactcgcgttttccctgatgaaatctctgggcgggggacggcgcggcacaggggcccaaggagaaaccctcggcgagaagtggaagagacagcttaatcagctgagcaaatccgagttcaacacatataagcggtctggcatcatggaggtggacagaagcgaagctaaagaggggctgaagcgcggagagaccacgaaacacgccgtttcccggggcacagctaagctcagatggtttgtcgaacgcaatctggtgaagccggaggggaaagtgattgatcttggatgtggcagagggggatggtcttactattgcgccggcctgaagaaagtcaccgaagttaagggctacaccaaagggggacccggccacgaggaacctatccccatggcgacatacgggtggaacctcgtgaagctgcatagcggaaaagacgtgttctttattcctcccgagaagtgtgataccctgctctgcgacatcggcgagtccagccctaatccgacaattgaagaggggagaacgcttcgcgtcctgaagatggtggaaccctggctgcggggaaaccagttctgtatcaaaattctcaatccttatatgccctctgttgtggagaccctggagcaaatgcagagaaagcacggcggcatgcttgtccgcaaccctctgtcccggaatagcacacatgaaatgtactgggtgtcttgcgggaccggaaacatcgtttccgccgtgaatatgacaagcagaatgctcctgaaccgctttaccatggctcaccggaaacccacgtatgagagagatgtcgacctgggcgccgggacccgccacgtggctgtggaaccggaggtcgccaacctcgatatcattggacagagaatcgaaaatattaagcatgagcacaaatctacatggcattacgacgaggataacccttataagacctgggcttaccacggctcctatgaagttaagcccagcgggtccgccagctctatggtgaatggagtggtcaaactgcttacaaagccctgggacgtgatccctatggttacccagattgcgatgacagataccacgcccttcggccaacagcgggtgtttaaagagaaggtcgacacacgcacccctaaagccaagagaggcaccgctcagatcatggaagtgacagccaagtggctgtgggggttcctcagccggaacaaaaagccgagaatctgtacgcgggaggaatttacccgcaaagttagatccaatgctgccattggagccgtgttcgtcgacgagaaccaatggaactctgcgaaggaggctgtggaagatgagcggttttgggacctggttcatcgcgaaagagagcttcacaaacagggcaagtgcgccacatgcgtgtacaacatgatggggaagcgggagaaaaagctgggagagttcggcaaagccaaggggagccgcgctatctggtacatgtggctcggcgccagattcctggagtttgaagctctgggattcatgaatgaggatcactggttttcccgggaaaactctctcagcggcgtcgagggggagggactgcataaacttggctatattctgcgcgacatctccaagattcccgggggaaatatgtacgccgatgacaccgcgggctgggatacaagaatcaccgaagacgatctccagaacgaggccaaaatcacagacattatggaacctgagcacgctctgcttgccaagtctatcttcaagctgacctatcagaataaagtggtccgggtgcaacgccccgctaagaacgggacggttatggatgtgattagcagacgggaccagcgcggctccggacaggtcggcacctacgggctcaatacatttaccaacatggaagcccagctgatcagacaaatggagagcgagggaattttctctccttccgaactggagacacccaacctcgcgggccgggtgctggattggcttgaaaaacatggggtggagagactgaagcgcatggccatcagcggagacgactgtgttgtgaaaccgatcgatgaccggtttgctaccgccctcacggctctgaatgatatgggcaaggtcagaaaggacattcctcagtgggaaccctctaaagggtggaacgattggcaacaggtgcctttctgctcccaccactttcatcaacttatcatgaaggacggccgcgagattgttgtgccctgtcggaatcaggatgagctggtcggcagagcccgcgtgagccagggagctgggtggtccctccgggaaacagcctgcctgggaaaatcttatgcgcagatgtggcaactgatgtacttccacagacgcgacctccggctggccgctaacgccatctgtagcgccgtccctgtggattgggttcccacctccagaacaacctggagcattcatgctcaccatcagtggatgacgaccgaggacatgctttctgtgtggaatcgcgtctggatcgaagagaacccgtggatggaagataagacacacatttccagctggggcgacgtgccttatctggggaaacgggaggaccagtggtgcggatctctcatcggcctgaccgccagagcgacatgggctaccaatatccaagttgccattaaccaggtgcggagacttatcgggaatgagaactacctggattacatgacaagcatgaagcgctttaagaatgaatccgaccccgagggcgccctctggtga

SEQ ID NO: 19261 - RNA, 9879 nt, synthetic construct
  misc_feature 1..9879: note = derived and/or modified CDS sequence (opt5) from DENV-1__EU249491__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgcgatggacctgggggaactctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggctatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacgcgcctcgaaaacatcatgtggaaacagatttccaacgagctgaatcatatccttctggaaaacgacatgaagctcacagtggttgtgggagatgtcgccggcattctggggcagggcaagaagatgatccggccgcaacccatggagtacaaatattcttggaaaagctggggcaaggccaagattatcggggctgacgcgcagaataccaccttcatcattgatggacctaacacacccgaatgtcctgacgatcagagagcctggaatatctgggaggtggaggactacggctttggcattttcaccacgaacatctggctgaaacttcgcgattcctatacacaggtgtgcgaccaccggctcatgagcgctgccattaaagattctaaggccgtccacgctgacatggggtactggatcgaatccgagaaaaatgaaacctggaagctggccagagcgagctttatcgaggttaagacatgtatttggcccaaatctcataccctgtggtccaacggagtgctcgaaagcgagatgatcattccgaagatctatggcgggcctatttctcaacacaattaccgccccggatacttcacacagaccgctggcccttggcatctggggaaacttgagctggatttcgacctctgcgaaggaacgaccgtggtcgtggatgagcactgcggcaaccggggccccagcctgagaacaaccacagttaccgggaagatcatccacgaatggtgttgccggtcctgtacgctgcctccccttcgctttagaggagaggacggctgctggtatgggatggagattcggccggtgaaagaaaaggaggaaaatctcgtcaagagcatggtgtctgccggatccggcgaggttgacagcttctccctggggctgctctgtatctctattatgatcgaagaggtgatgagaagccgctggtcccggaaaatgctgatgacaggaacccttgccgtctttttcctgctcattatgggccagctgacatggaacgatctgatcagactttgcattatggtgggcgctaatgcctctgaccgcatggggatgggaaccacctacctggcgctcatggctacatttaagatgagacctatgttcgccgttggcctgctctttcggcgcctgacgagcagagaggtgcttctgctcaccatcgggctgtccctggtcgcctctgtggaacttcccaacagcctggaggaactcggagatggcctggctatggggatcatgattctcaaactgcttacagacttccaatcccatcagctgtgggccaccctcctgagcctgacatttatcaagaccacgttctctcttcactatgcttggaaaacaatggccatggtgctgtccattgtcagcctctttcccctgtgtctctctaccacctcccagaagacaacctggctgcctgttcttctgggaagcctgggctgcaagccgctcacaatgttcctgatcgcggagaataaaatttggggccggaagtcttggccccttaacgaagggatcatggccgtgggaatcgtgtccattctgctcagctccctgctcaaaaacgatgtccctctggctggcccccttatcgccgggggaatgctgattgcttgttacgtgatcagcggctctagcgccgacctgtccctcgagaaggccgctgaggtttcttgggaagaggaagcggagcatagcggggcctcccacaatattctggtggaagtccaggatgacggaacgatgaaaatcaaggatgaggagcgcgacgatacccttacaatcctgctcaaagctaccctgctcgccgtgtctggcgtttatcctctgagcattcccgccacactttttgtgtggtacttctggcaaaagaagaaacagagatccggcgtcctgtgggacaccccttctcccccggaagtggagcgggctgtcctggatgacgggatctatcgcattatgcagagaggactcctgggccggagccaggtgggggttggagtgttccaagaaaacgtctttcatacgatgtggcacgtgacccgcggcgccgttcttatgtaccaggggaagagactggagccttcctgggcgagcgtgaaaaaggacctcatctcttacggaggcggctggcggctgagagggtcctggaatacaggagaggaagtccaggtgattgctgtggagcccggcaaaaaccctaagaatgttcagaccgcccccgggacattcaagaccccggaaggagaggtcggcgccatcgctctcgattttaaacctgggacaagcggatctcccattgtgaaccgcgaaggcaagatcgtgggcctgtatgggaatggagtcgtgacgacctccggcacatacgttagcgccatcgcgcaagctaaagcctcccaggaggggcctcttcccgagattgaagacgaggtgttccggaagagaaacctgaccatcatggatctgcaccccggatctggcaaaacccgccggtatctccctgccattgtcagagaagctatcaagcgcaagctgcggacacttattctggccccgacgagagtggttgctagcgagatggccgaagcgctcaaagggatgcccatccgctaccagaccacagccgtgaagtccgagcataccggcaaagagatcgtcgacctgatgtgccacgctacatttaccatgcggctgctcagccctgtgagagttcccaattataacatgattatcatggatgaagcccatttcacggacccttcttccattgctgcccggggatacatcagcacacgcgtgggcatgggggaggccgctgcgatttttatgaccgccacaccccctggatctgtcgaggctttcccgcaaagcaatgccgtgatccaggatgaggaaagagacatccccgagcggtcctggaactctggctatgagtggattacagattttcctgggaagaccgtgtggttcgtccccagcatcaaatccggaaatgacattgccaactgtcttcgcaagaatggcaagagagttatccagctgtctcggaaaacatttgataccgaataccagaagacgaaaaacaacgactgggactacgtggtgacaaccgatattagcgagatgggggctaatttcagagccgaccgcgtcatcgatcctcggagatgcctgaagcccgtgattctcaaagacggcccggaacgcgttatcctggcgggacctatgcccgtgacagtcgcttccgccgcccaacggagaggccgcatcgggcggaaccacaataaggagggagatcagtatatttacatgggccagccccttaacaatgacgaggatcatgctcactggaccgaagccaagatgctgctcgacaacatcaatacgcctgaggggattatccccgcgctgttcgaacctgagagagaaaagagcgccgctgtggatggagagtatcgcctgagaggcgaggcccggaagacctttgttgagctcatgcgcagaggggaccttccggtgtggctgtcttacaaagtcgcttccgagggcttccagtatagcgatcggcgctggtgctttgacggagaaagaaacaatcaagtgctggaggaaaacatggatgtcgagatttggacaaaggagggcgaacggaaaaagctcagaccccgctggctggacgcccggacctactccgaccctcttgctctgagagagttcaaagaatttgccgcggggcgccggtctgtgagcggagatctcatcctggagatcggcaagctgccccagcacctcacacagagagcccagaatgctcttgacaacctggttatgctgcataattccgaacaagggggacgggcctatcgccacgctatggaggagctccctgataccattgaaacactgatgcttctggccctcatcgccgtgctgaccggcggcgtgacgctgttctttctctctgggagaggacttggcaagacaagcattgggctgctgtgtgtcatggcttccagcgttctcctgtggatggcgtctgtggagccccattggatcgccgcttccattatccttgagttctttctgatggtgctcctgatcccggagcctgaccggcagcgcacaccccaggataaccagctggcctacgtcgtgattggactccttttcatgatcctgaccgttgccgctaatgagatgggcctgctcgaaacaaccaaaaaggacctggggattggacacgtggccgtcgagaaccaccatcacgcggccatgcttgatgtggacctgcatcctgctagcgcctggacactctacgctgtcgccacgaccatcattacacccatgatgagacacaccatcgaaaacacaaccgcgaatatttctctgacggccatcgctaaccaagccgctatcctgatgggcctcgataaaggctggcctatttccaagatggacatcggggtgccccttctggccctgggatgctatagccaggttaatccgctcaccctgacagctgccgtgcttatgctggtcgcgcattacgccattatcggccctgggctccaggctaaagccacccgggaggctcaaaagcgcacagccgccggaattatgaagaaccccaccgtggatggcatcgttgcgatcgacctggatcccgtggtctatgacgctaaatttgaaaagcagctggggcagattatgctccttatcctgtgtacgtctcagattctgctcatgagaacaacctgggccctgtgcgagagcatcacacttgctaccggacctctgaccacactctgggagggctccccgggcaaattctggaatacgaccattgccgtgtctatggccaacatctttcgggggagctacctggctggagccggcctggcgttctccctcatgaaaagccttgggggaggccgcagagggacaggagcccaaggcgaaaccctgggcgagaaatggaagcggcagctgaatcagctctccaagtctgagttcaacacatataaaagaagcgggatcatggaggtggaccgctccgaagctaaggagggactgaaacggggcgagaccacgaagcacgccgtttctagagggacagctaaacttcgctggtttgtcgaacggaatctggtgaagcccgagggaaaggtgattgatctcggctgtgggagaggaggctggagctactattgcgccggcctgaaaaaggtcaccgaagttaaagggtacaccaagggaggccctgggcacgaggaacccatccctatggcgacatacggatggaacctggtgaaactccattccggcaaggacgtgttctttattccccctgagaaatgtgatacccttctgtgcgacatcggggagtctagcccgaatcccacaattgaagagggacgcacgctgcgggtcctcaagatggtggaaccttggctgagaggcaaccagttctgtatcaagattcttaatccctatatgccttccgttgtggagaccctggagcaaatgcagcgcaaacacggcgggatgctcgtccggaaccccctgagcagaaattctacacatgaaatgtactgggtgtcctgcggaaccggcaacatcgttagcgccgtgaatatgacatctcgcatgctgctcaaccggtttaccatggctcacagaaagccgacgtatgagcgcgatgtcgacctggggaccggaacaagacacgtggccgtggaacctgaggtcgctaaccttgatatcattggccagcggatcgaaaatattaaacatgagcacaagtccacctggcattacgacgaggataacccctataaaacatgggcctaccacgggagctatgaagttaagccctctggatccgctagctccatggtgaatggcgtggtcaagctgctcaccaaaccttgggacgtgatccccatggttacacagattgccatgaccgatacgacacctttcggccaacagcgcgtgtttaaggagaaagtcgacaccagaaccccgaaggcgaaacgggggacagcccagatcatggaagtgacggctagatggctgtggggattccttagccggaacaagaagccccgcatctgtaccagagaggaatttacacggaaagttcgctctaatgccgctattggcgccgtgttcgtcgacgagaaccaatggaatagcgccaaggaggcggtggaagatgagagattttgggacctggttcatcgggaacgcgagctccacaaacaggggaagtgcgctacctgcgtgtacaacatgatgggaaaaagagaaaagaagctgggcgagttcgggaaagccaagggctcccgggccatctggtacatgtggctgggagctcgctttctcgagttcgaagccctgggcttcatgaatgaggatcactggttttctagagaaaacagcctttccggggtcgagggagagggcctgcataaactcgggtatattctgcgggacatctctaagattcctggaggcaatatgtacgctgatgacacagccgggtgggatacccgcatcacagaagacgatcttcagaacgaggcgaaaatcaccgacattatggaacccgagcacgccctgctcgctaaggccatcttcaaactgacgtatcagaataaggtggtcagagtgcaacggcctgctaagaacggcaccgttatggatgtgattagccgcagagaccagcggggatccggccaggtcgggacatacggactgaatacctttacaaacatggaagcccagctcatcagacaaatggagtctgagggcattttcagcccctccgaactggagaccccgaaccttgcggaacgcgccctggattggctcgagaaatatggggtggaacggctgaagagaatggctatcagcggagacgactgtgtggttaaacctatcgatgaccgctttgccacggctcttacagccctgaatgatatgggcaaggtgcggaaagacattccccagtgggagccttctaaggggtggaacgattggcagcaggtccccttctgctcccatcactttcaccaactcatcatgaaggacggcagagagattgtggttccttgtcgcaatcaggatgaactggtgggacgggctagagtcagccagggcgccgggtggtctctgcgcgagaccgcgtgcctcggaaaatcctacgcccagatgtggcaactgatgtatttccatcggagagaccttcgcctggctgccaacgccatctgtagcgctgtgcccgtcgattgggtgccgacatcccggaccacgtggtctattcacgcccatcaccagtggatgaccacagaagacatgctcagcgtttggaatagagtgtggatcgaggaaaacccttggatggaggataagacccatatttccagctgggaggacgtcccctacctgggcaaacgggaagaccagtggtgcgggtctcttatcggactgacagcgagagctacctgggccacaaatatccaagtggccattaaccaggttcgccggctcatcggcaatgagaactacctggattatatgacctccatgaagagatttaaaaatgaaagcgaccccgagggggctctgtggtga

SEQ ID NO: 19262 - RNA, 9879 nt, synthetic construct
  misc_feature 1..9879: note = derived and/or modified CDS sequence (opt5) from DENV-1__EU249492__SS-prME
  source 1..9879: mol_type = other RNA
agcgtgacaatgctgctgatgctgatgcccacagcccttgctttccacctgacgacccggggaggggagcctcatatgatcgtctccaagcaggaacgggggaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcagatgtgcgaccaccggcttatgtctgccgctattaaagattccaaggccgttcacgccgacatgggctactggatcgaaagcgagaaaaatgaaacatggaagctcgctagagcctctttcatcgaggtgaagacctgtatttggcccaaatcccatacactgtggagcaacggggtgctggaatctgagatgatcattccgaagatctatggaggccctattagccaacacaattaccgccccgggtacttcacccagacagcgggaccttggcatctcggcaaactggagcttgattttgacctgtgcgaagggaccacggtcgtggttgatgagcactgcggaaaccggggcccctccctcagaaccacaaccgtgacaggcaagatcatccacgaatggtgttgccggagctgtaccctgcctcccctgcgcttcaaaggggaggacggatgctggtatggcatggagattagaccggtcaaggaaaaggaggaaaatcttgtgaaatctatggtttccgctgggagcggagaggtggactccttttctctcggcctgctgtgtatcagcattatgatcgaagaggtcatgcggtccagatggtctcgcaagatgctcatgacggggacactggccgtgttctttcttctgattatgggacagctcacctggaacgatctgatccggctgtgcattatggttggcgccaatgctagcgacagaatgggcatggggacaacctaccttgccctgatggcgaccttcaaaatgcgccctatgtttgctgtgggactcctgttcagacggctcacatcccgcgaggtcctgcttctgacgatcggcctctctctggtggccagcgtggaactgcccaactcccttgaggaactgggggatggactcgccatgggcatcatgattctgaagctcctgaccgactttcaaagccatcagctttgggctacactgctctctatgaccttcatcagaacaaccttttccctgcactatgcctggaaaacgatggctatggtcctgagcattgtttctcttttccccctgtgtctctccacaaccagccagaagaccacatggctgcctgtgctcctggggtctcttggatgcaagccgctgaccatgtttctgatcgccgagaataaaatttggggccggaagtcctggcccctcaacgaaggcatcatggcggtggggatcgtcagcattctgctttccagcctgctcaaaaacgatgtgcctctggccggacccctcatcgctggcgggatgctgattgcctgttacgttatctctggaagctccgctgacctttctctggagaaggccgccgaggtgagctgggaagaggaagctgagcattccggcgcgtctcacaatattctggtcgaagtgcaggatgacgggacaatgaaaatcaaggatgaggagcgcgacgatacgctcaccatcctgcttaaagccacactgctcgctgttagcggagtgtatcctctgtccattcccgccaccctcttcgtctggtacttctggcaaaagaagaaacagagatctggcgtgctgtgggacacaccttcccctcccgaagtccagcgggccgtgcttgatgacggcatctatcgcattatgcagagagggctgctgggacggtcccaagttggcgtgggggtctttcaggagaacgtgttccataccatgtggcacgttacgcgcggagctgtgctcatgtaccagggcaagagactggaacccagctgggcctctgtcaaaaaggaccttatctcctacgggggaggctggcggctgcagggcagctggaataccggggaggaggtgcaagtgattgcggttgaacccggcaagaaccctaagaatgtccagacagctcccggcacctttaagacatctgagggggaagtgggagccatcgccctcgatttcaaaccgggcacctccgggagccctattgtgaacagagagggaaagatcgtcggcctgtatggcaatggggtggttacaacgtccggaacctacgtgtctgctatcgcccaggcgaaagctagccaagaaggccccctccctgagattgaggacgaagtctttcgcaagcggaacctgacaatcatggatcttcaccccgggtccggaaaaaccagacgctatctgcccgccattgtgcgggaggccatcaagagaaagctgcgcaccctcattctggctcctacacgggttgtggccagcgaaatggctgaggcccttaaaggcatgccgatcagataccagacgaccgcggtcaagtctgaacatacagggaaagagatcgtggacctgatgtgccacgccaccttcacaatgcgcctcctgtcccccgttcgggtgcctaattataacatgattatcatggatgaggctcattttaccgaccccagctctattgccgctagaggctacatcagcacgcgggtcggaatgggcgaagccgccgctattttcatgacagcgacccctcccgggtccgtggaggcctttcctcagtctaatgctgtgatccaggatgaagaaagagacatcccggaaagaagctggaactccggatatgagtggattaccgatttccccggcaagacagtctggtttgttccttctatcaaaagcgggaatgacattgccaactgtctgcggaagaatggaaagcgcgtgatccaactctccagaaaaaccttcgatacagagtaccagaagaccaaaaacaacgactgggactacgtggtcacgacagatattagcgaaatgggcgccaatttccgggctgacagagtgatcgatccccgccggtgccttaagcctgttattctgaaagacgggcccgagagagtgatcctggccggcccgatgcctgtcaccgtggcgtctgctgcccagcgccggggaagaatcggccgcaaccacaataaggaaggggatcagtatatttacatgggacaacccctcaacaatgacgaggatcatgcccactggacagaggctaagatgctgcttgacaacatcaatacccccgaaggcattatccctgccctgtttgagcccgaacgggagaaatccgcggccattgatggggaatatagactccgcggagaggctagaaagacgttcgttgagctgatgcggcgcggcgacctgcctgtgtggctcagctacaaagtcgcctccgaagggtttcagtattctgatagacggtggtgcttcgacggcgagcgcaacaatcaggtgcttgaagagaacatggatgtcgaaatctggaccaaggagggagagcgcaagaagctgcggccgagatggctggacgctcgcacatacagcgaccccctcgccctgcgggaatttaaagagttcgctgccggcagacgctccgtgtctggggatcttatcctggaaattggaaagctccctcagcacctgacccaacgggcgcagaatgccctggacaacctcgttatgcttcataatagcgagcagggcgggagagcttatcggcacgccatggaggaactgcccgatacaatcgagaccctgatgctcctggctcttattgccgtgctgacaggaggcgtgaccctctttttcctgtccggccgcgggctgggaaagacgagcatcggcctcctttgtgtcatggcctcttccgttctgctgtggatggctagcgtggaacctcattggattgcggcctctatcatcctcgagtttttcctgatggtgcttctgattcccgaaccggacagacagcggacacctcaagataaccagctcgcttacgtcgtgatcgggctgctgtttatgattctcaccgttgccgccaatgagatgggacttctggagaccaccaaaaaggacctgggcatcgggcacgtggctgtcgaaaaccaccatcacgccgcgatgctcgatgtggacctgcatcccgcctccgcttggaccctttacgccgtcgctacaacgattatcacccctatgatgcgccacacaattgagaacaccacagccaatatcagcctgaccgcgatcgccaaccaggctgccattctcatgggactggataaaggctggcccatctctaagatggacattggcgtgcctctgctcgctcttgggtgctatagccaagttaatcccctgacgctgaccgccgctgtgctcatgctggtcgcccattacgcgatcattggaccgggccttcaggccaaagctacaagagaagcccagaagcggaccgctgccgggatcatgaagaaccctacagtggatggaatcgttgccattgacctggatcccgtggtctatgacgcgaaattcgagaagcagctcggccaaatcatgctgctgattctctgtacctcccagatccttctgatgcgcacgacatgggctctgtgcgaatctattaccctcgccacagggcccctgaccaccctttgggagggaagccctggcaaattttggaatacaacgatcgctgtgtccatggccaacatcttcagaggcagctacctggccggggctggactcgccttctccctgatgaagtctctgggcgggagccggcgcggaaccggcgcgcagggggagacactcggagaaaaatggaagagacagcttaatcaactgtccaagtctgagtttaacacctataaacggagcggcattatggaagtggacagatccgaggccaaggaaggcctgaaacgcggggagacaaccaagcacgctgtttctcggggaacggccaaactcagatggttcgtcgagcgcaatctggtgaagccggaaggcaaggtgatcgatcttgggtgtggacggggcgggtggagctactattgcgctggactgaaaaaggtcacagaggttaaaggctacaccaagggcgggcccggacacgaggagcctattcccatggccacctacggctggaacctcgtgaaactgcattccgggaaggacgtgtttttcatccctcccgaaaaatgtgatacactgctctgcgacattggagagagctctcctaatccgaccatcgaggaaggcagaacacttcgcgtcctgaagatggtggagccctggctgcgggggaaccagttttgtattaagatcctcaatccttatatgccctccgttgtggaaacgctggagcagatgcagagaaaacacggaggcatgcttgtccgcaaccctctgagcagaaattctacccatgagatgtactgggtgtcctgcggcacagggaacatcgttagcgcggtgaatatgacctctagaatgctcctgaaccgcttcacaatggcccaccggaagcccacctatgaaagagatgtcgacctgggagctggcacgcgccacgtggccgtggagccggaagtcgctaacctcgatattatcgggcaaagaattgagaatatcaaacatgaacacaagtccacctggcattacgacgaggataacccttataaaacatgggcctaccacggaagctatgaggttaagccctccggcagcgcttctagcatggtgaatggggtggtcaagctgcttaccaaaccctgggacgtgattcctatggttacacagatcgccatgaccgatacaaccccctttggacagcaacgggtgttcaaggaaaaagtcgacacgcgcacacctaaggcgaaaagaggcaccgcccagatcatggaggtgaccgctaagtggctgtggggctttctctcccggaacaagaaaccgagaatttgtacacgggaagagttcacgcgcaaggttagatctaatgccgctatcggggccgtgtttgtcgacgaaaaccagtggaatagcgccaaagaggcggtggaggatgaacggttctgggacctggttcatcgcgagagagaacttcacaagcagggaaaatgcgctacctgcgtgtacaacatgatgggcaagcgggagaagaaactgggggaatttggaaaggccaaaggctcccgcgccatttggtacatgtggctcggggctagattcctggagttcgaggccctgggctttatgaatgaagatcactggttctctcgggagaacagcctctccggagtcgaaggcgaggggctgcataaacttggatatatcctgcgcgacatttctaaaatccccggcgggaatatgtacgctgatgacacagccggatgggataccagaatcacagaggacgatctccaaaacgaagcgaagattaccgacatcatggagcctgaacacgccctgcttgctaaaagcatttttaagctgacatatcagaataaggtggtccgggtgcagcgccccgccaaaaacggcaccgttatggatgtgatctccagacgggaccagcgcgggagcggccaagtcggaacgtacggcctcaataccttcacaaacatggaggctcagctgattagacagatggaatctgaggggatcttttcccctagcgagctggatacccccaacctcgccggacgggtgctggactggcttgaaaagcatggcgtggagagactgaaacgcatggcgatctctggggacgattgtgttgtgaagccgattgacgatcggttcgccacagctctcaccgccctgaatgacatgggaaaagtcagaaaggatatccctcagtgggaaccctccaagggctggaacgactggcaacaggtgcctttttgcagccaccacttccatcagcttattatgaaagatgggcgcgagatcgttgtgccctgtcggaatcaggacgaactggtcggcagagctcgcgtgtcccaaggagccggctggtctctccgggagacggcttgcctgggaaagagctatgcccagatgtggcagctgatgtactttcacagacgcgatctccggctggcggccaacgctatttgttccgccgtccctgtggactgggttcccacaagcagaaccacatggtctatccatgcccaccatcaatggatgaccacggaggatatgctttccgtgtggaatcgcgtctggattgaagagaacccgtggatggaagacaaaacccacatcagctcttggggagacgtgccttatctgggcaagcgggaggatcagtggtgcgggagcctcatcggactgacagctagagccacctgggcgacaaatattcaggttgctatcaaccaggtgcggagacttctgggcaatgaaaactacctcgactacatgacctccatgaaacgcttcaagaatgagtctgggcccgagggcgccctgtggtga

SEQ ID NO: 19263 - RNA, 9879 nt, synthetic construct
  misc_feature 1..9879: note = derived and/or modified CDS sequence (opt5) from DENV-1__EU249493__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttactattgcgctggcctgaaaaaggttaccgaagtgaaaggctacaccaaagggggacccggccacgaggaacctatccccatggccacatacgggtggaacctcgtgaaactgcatagcggaaaggacgtcttctttattcctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttatatgccctctgtggtcgagaccctggagcaaatgcagcggaaacacggcggcatgcttgtgagaaaccctctgtcccgcaatagcacacatgaaatgtactgggtttcttgcgggaccggaaacatcgtgtccgcggtcaatatgacaagccggatgctcctgaacagatttaccatggcccaccgcaagcccacgtatgagcgggatgtggacctgggcgctgggaccagacacgtggccgtcgaaccggaggttgctaacctcgatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacatgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacaccgccggctgggatacacgcatcaccgaagacgatctccagaacgaggcgaagatcacagacattatggaacctgagcacgccctgcttgctaagtctatcttcaaactgacctatcagaataaggtcgtgagagttcaacggcccgccaaaaacgggacggtgatggatgtcattagccgcagagaccagcggggctccggacaggtgggcacctacgggctcaatacatttaccaacatggaagctcagctgatccgccaaatggagagcgagggaattttctctccttccgaactggagacacccaacctcgccggcagagtgctggattggcttgaaaagcatggggttgagcggctgaaaagaatggcgatcagcggagacgactgtgtggtcaagccgatcgatgaccgctttgccaccgctctcacggccctgaatgatatgggcaaggtgcggaaagacattcctcagtgggaaccctctaaggggtggaacgattggcagcaggttcctttctgctcccaccactttcatcaacttatcatgaaagacggcagagagattgtggtcccctgtcgcaatcaggatgagctggtgggacgggctagagtcagccagggcgccgggtggtccctccgcgacacagcttgcctgggaaagtcttatgcccagatgtggcaactgatgtacttccaccggagagatctccgcctggcggccaacgctatctgtagcgccgtgcctgttgactgggtgcccacctcccggacaacctggagcattcatgcccaccatcagtggatgacgaccgaagatatgctttctgtctggaatagagtgtggatcgaggaaaacccgtggatggaggacaaaacacacatttccagctggggcgacgttccttatctggggaagcgcgaagatcagtggtgcggatctctcatcggcctgaccgctcgggccacatgggcgaccaatatccaagtggctattaaccaggtcagacggcttatcgggaatgagaactacctggactacatgacaagcatgaagagatttaaaaatgagtccgatcccgaaggcgccctctggtga

SEQ ID NO: 19264 - RNA, 9879 nt, synthetic construct
  misc_feature 1..9879: note = derived and/or modified CDS sequence (opt5) from DENV-1__EU249494__SS-prME
  source 1..9879: mol_type = other RNA
agcgtgaccatgctgctcatgctgatgcccaccgcccttgctttccacctgacgacccggggcggggaacctcatatgattgtcaccaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggctatggtgcaggccgattccggatgcgtcattaactggaaaggccgcgaactgaagtgtgggagcggaatcttcgtgaccaatgaggttcacacatggaccgaacaatataagtttcaggcggactcccctaaacggctgtctgccgctattggcaaggcctgggaggagggggtgtgcggcatcagaagcgctacgcgcctcgaaaacatcatgtggaaacagatttccaacgagctgaatcatatccttctggaaaacgacatgaagttcacagtcgtggttggagatgtggtcggcattctcgcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtggaggactatggattcggcatttttaccacgaacatctggctgaagctgcgcgattcctacacacaggtctgcgaccaccggcttatgagcgccgctattaaagattctaaggccgttcatgccgacatgggctattggatcgaatccgagaaaaatgaaacctggaagctcgctagagccagcttcatcgaggtgaagacatgtatttggcccaaatctcacaccctgtggtccaacggggtgctggaaagcgagatgatcattccgaagatctacggaggccctatttctcaacataattatcgccccgggtacttcacacagaccgcgggaccttggcacctcggcaaactggagcttgattttgacctgtgcgaagggacgaccgtcgtggttgatgagcactgcggaaaccggggccccagcctcagaacaaccacagtgaccggcaagatcatccatgaatggtgttgccggtcctgtacgctgcctcccctgcgcttcaaaggggaggacggatgctggtacggcatggagattagaccggtcaaggaaaaggaggaaaatcttgtgaaaagcatggtttctgctgggtccggagaggtggacagcttttccctcggcctgctgtgtatctctattatgatcgaagaggtcatgcggagcagatggtcccgcaagatgctcatgacagggaccctggccgtgttccttctgctcattatgggacagctgacatggaacgatctgatccggctttgcattatggttggcgccaatgcttctgacagaatgggcatggggaccacctatctggccctcatggcgacatttaaaatgcgccctatgttcgctgtgggactgctctttagacggctgacgagccgcgaggtccttctgctcaccatcggcctgtccctggtggcctctgtggaacttcccaacagcctggaggaactcggggatggactggccatgggcatcatgattctcaagctgcttacagacttccaatcccaccagctgtgggctaccctcctgagcctgacatttatcaaaaccacgctttctctgcattacgcctggaagacaatggctatggtcctctccattgttagcctgttccccctctgtctgtctaccacctcccagaagacaacctggcttcctgtgctgctggggagcctcggatgcaaaccgctgacaatgtttcttatcgccgagaataagatttggggcagaaaatcttggcccctgaacgaaggcatcatggcggtgggggtcgtgtccatcctcctgagctccctcctgaagaacgatgttcctcttgccggacccctgattgctggcgggatgctgatcgcctgttatgtgattagcggatctagcgctgacctctccctggagaaagccgccgaggtctcttgggaagaggaagctgagcacagcggcgcgtcccataatatccttgtggaagttcaggatgacgggacgatgaagattaaagatgaggagcgggacgataccctgacaatcctcctgaaggccaccctcctggctgtgtctggagtctaccctcttagcatccccgccacactgttcgtgtggtatttttggcaaaagaaaaagcagcgctccggcgtcctgtgggacaccccttctcccccggaagtggagagagccgttctcgatgacggcatttaccggatcatgcagcgcgggctgcttggaagaagccaggtgggcgtcggggtgttccaagaaaacgttttccacacgatgtggcacgtgacccggggagctgtcctgatgtatcagggcaaacgcctcgagccttcctgggccagcgtgaagaaagacctgatttcttacgggggaggctggagactccagggctcctggaatacaggggaggaagtgcaggttatcgcggtcgagcccggaaagaaccctaagaatgtgcaaaccgctcccggcacatttaaaaccccggaaggggaggtgggagccattgccctggatttcaagcctggcacaagcgggtctcccatcgtcaaccgggaaggaaaaattgtgggcctttacggcaatggggttgtgacgacctccggaacatatgtcagcgctatcgcccaggcgaaggcttcccaggagggccctctgcccgagatcgaagacgaggtgtttagaaaacgcaacctgaccattatggatctccatcccgggtctggaaagacccggagatacctgcctgccatcgttcgcgaagccattaagcggaaacttagaacactgatcctcgctccgacgcgcgtggtcgccagcgagatggctgaagccctgaagggcatgcccattcggtatcaaaccacagcggtgaaatccgagcacaccgggaaggagatcgttgacctgatgtgccatgccacattcaccatgagactccttagccctgtgcgcgtccccaattacaacatgatcattatggatgaagctcactttacggacccttcttccatcgccgctcggggctatattagcacaagagtgggaatgggcgaggccgccgctatcttcatgaccgcgacaccccctgggtctgtggaagcctttccgcagagcaatgctgtcattcaggatgaggaacgggacatccccgagcgctcctggaactctggatacgagtggatcacagatttccctggcaaaaccgtttggtttgtgcccagcattaagtccgggaatgacatcgccaactgtctgagaaagaatggaaaacgggtgattcagctgtctcgcaagacattcgataccgaatatcagaagacgaagaacaacgactgggactacgtcgtgacaaccgatatcagcgagatgggcgccaattttagagctgaccgggttattgatcctagacgctgcctcaaacccgtgatcctgaaggacgggccggaacgggtcattcttgccggccctatgcccgtgacagttgcgtccgctgcccagagacgcggacggatcggcagaaaccataataaggagggggatcagtacatctatatgggacagcccctgaacaatgacgaggatcacgcccactggaccgaagctaaaatgctcctggacaacattaatacgcctgagggcatcattcccgccctgttcgaacctgagcgcgaaaagagcgcggccatcgatggggagtaccggctcagaggagaggctcgcaaaaccttcgtggaacttatgagacggggcgacctgccggtctggctgtcttataaggtggcctccgaggggtttcaatacagcgatcgcagatggtgcttcgacggcgaacggaacaatcaggtcctcgaggaaaacatggatgtggagatttggacaaaagagggagaacgcaagaaactgagaccccggtggcttgacgctagaacctattccgaccctctggccctccgcgagtttaaggagttcgctgccggccggagatctgttagcggggatctgatcctggagatcggaaagctcccccagcatcttacacagcgcgcgcaaaatgccctggacaacctggtgatgctccacaattccgaacagggcgggcgggcttacagacatgccatggaggagctgcctgataccattgaaacacttatgctgctcgctctgatcgccgtgctgaccggaggcgtcacgctctttttcctttctggccgggggctgggaaaaacaagcattggcctgctctgtgttatggcctccagcgtgctgctttggatggcttctgtggagccccactggatcgcggcctccattatcctggaatttttcctcatggtcctgctgatcccggagcctgaccgccagagaacaccccaggataaccaactcgcttatgtggttattgggcttctgtttatgatcctgaccgtggccgccaatgagatgggactcctggaaacaaccaagaaagaccttggcattgggcacgtcgctgtggagaaccatcaccatgccacaatgctggatgtcgacctccaccctgcgagcgcctggacgctgtacgctgtggccaccacaatcattacccccatgatgcggcatacaatcgaaaacaccacggctaatatttctctgaccgccatcgcgaaccaggccgctatcctcatgggacttgataagggctggcctatttccaaaatggacatcggcgttcccctgctggccctcgggtgctacagccaggtgaatccgctgacacttaccgctgccgtcctgatgctcgtggctcactatgccattatcggacctggcctgcaagcgaaggccacacgcgaggctcagaagagaaccgccgctgggattatgaaaaaccccacggttgatggaatcgtggccatcgacctggatcccgtcgtgtacgacgccaagttcgaaaaacagctcggccagattatgcttctgatcctgtgtacatctcaaattctcctgatgcggaccacatgggcgctttgcgagagcatcaccctggctaccgggcctctcacaacgctgtgggagggatccccgggcaagttttggaataccacaattgccgtgtctatggctaacatcttccgcggcagctatctggccggggccggactcgctttttcccttatgaaaagcctgggcgggggaagacggggcaccggggcccagggagaaacactgggcgagaagtggaagcgccagctcaatcagctgtccaaatctgagttcaacatctacaagagaagcggcattatggaggttgaccggtccgaagcgaaagaggggcttaagagaggagagaccacgcgccacgccgtctctcggggcacagctaaactgagatggttcgtggaacgcaatctcgtgaagcccgaggggaaggtcatcgatctgggatgtggcagagggggatggagctattactgcgccggcctgaaaaaggttaccgaagtgaaaggctataccaaagggggacctggccatgaggaacccattcctatggctacatacgggtggaacctcgtgaaacttcactccggaaaggacgtctttttcacaccccctgagaaatgtgatacactgctgtgcgacatcggcgagtctagcccgaatcccacgattgaagaggggagaaccctccgcgtgctgaagatggttgaaccttggcttcggggaaaccaattttgtatcaagattctgaatccctacatgccttccgtggtcgagacactcgagcagatgcagagaaaacatggcggcatgctggtgcgcaaccccctgagcagaaattctacccacgaaatgtattgggtttcctgcgggacaggaaacatcgtgagcgccgtcaatatgacctctagaatgctcctgaaccgcttcacgatggcgcaccggaagccgacctacgagagagatgtggaccttggcgccgggacacgccatgtggctgtcgaacctgaggttgccaacctggatatcattggacagagaatcgaaaatattaaacacgagcataagtccacctggcactatgacgaggataacccctacaaaacatgggcttatcatggcagctacgaagtgaagccctctgggtccgccagctccatggtgaatggagtcgtgaagctcctgaccaaaccttgggacgttatccccatggtgacacaaattgctatgaccgatacgacaccttttggccagcagcgggtcttcaaggagaaagtggacacccgcaccccgaaggccaaaagaggcacagcgcaaatcatggaagttacggcccggtggctttgggggtttctgagcagaaacaagaagccccggatctgtacccgcgaggagttcacaagaaaagtgcggtctaatgctgccattggagctgtctttgtggacgagaaccagtggaatagcgccaaggaggccgttgaagatgagcgcttctgggacctcgtgcagaaagaaagagagctgcacaagcagggcaaatgcgcgacctgcgtctataacatgatggggaagcgggaaaagaaactgggagagtttggcaaggctaaagggtcccgcgccatctggtacatgtggctcggcgccagattcctggagtttgaagctcttggattcatgaatgaggatcactggttctctcgggaaaacagcctgtccggcgtggagggggagggactccataagctgggctacattcttcgcgacatctctaaaattcctgggggaaatatgtatgccgatgacacagctggctgggataccagaatcacagaagacgatctgcaaaacgaggccaagatcaccgacattatggaacccgagcacgcgctcctggccacgagcatctttaaactgacctaccagaataaggtcgtgcgggttcagcgccctgctaagaacgggacagtgatggatgtcatttccagacgggaccagcgcggctctggacaagtgggcacctatgggctcaatacattcaccaacatggaagcccagctgatcagacagatggagagcgagggaatcttttcccccagcgaacttgagatcccgaacctggctgaacgggtgctcgattggctggagaaatacggcgttgaaagacttaagcgcatggccatctctggggacgactgtgtggtcaaacctattgatgaccggttcgcgacggccctgacagctctcaatgatatgggaaaggtgagaaaagacgttccccagtgggagccttccaagggctggaacgattggcaacaggtgcccttttgcagccatcacttccaccagctgatcatgaaggacgggcgcgagattgtcgtgccttgtcggaatcaggatgaactggtcggcagagcccgcgtgtctcaaggagctggctggtccctccgggagaccgcctgcctggggaaaagctatgctcagatgtggcagcttatgtactttcatagacgcgacctgcggctcgccgcgaacgccatctgttccgctgttcccgtggattgggtcccgacatctagaaccacgtggagcattcacgcccatcaccaatggatgaccacagaagacatgctgtccgtgtggaatcgcgtttggatcgaggaaaacccttggatggaggataagacccatgtgagctcttggggagacgtcccctatcttggcaaacgggaggaccagtggtgcgggtccctgattggactcacagccagagctacctgggccagcaatatccaggtggcgatcaaccaggtgcggagactgattggcaatgaaaactacctggattgtatgacatctatgaagcgcttcaaaaatgagggggaccccgaaggcgctctctggtga

SEQ ID NO: 19265 - RNA, 9879 nt, synthetic construct
  misc_feature 1..9879: note = derived and/or modified CDS sequence (opt5) from DENV-1__EU249495__SS-prME
  source 1..9879: mol_type = other RNA
tccgtgaccatgctgctcatgctgatgcccaccgcccttgctttccacctgacgaccagaggcggggaacctcatatgatcgtcaccaagcaggaacggggaaaatccctcctgtttaagaccacagccggcgttaatatgtgcacccttattgccatggacctgggggaactctgtgaagataccatgacctacaaatgcccgcgcatcacggaggctgaacccgacgatgtggactgttggtgcaatgccaccgatacatgggtgacctatggaacatgttctcaaaccggcgagcaccggcgggacaagcgcagcgttgccctggctcctcatgtggggctgggactcgagacgagaacagaaacctggatgtcctctgagggcgcctggaaacagattcagcgggttgaaacatgggctctgcgccaccccggcttcaccgtgatcgccctttttctggcgcatgccattgggaccagcatcacacagaagggaatcattttcatcctcctgatgcttgtcacgccttccatggctatgagatgcgtgggcattgggtctcgggattttgttgagggactgagcggcgccacctgggtggacgtcgtgctcgagcacgggtcctgtgtgacaaccatggctaaggataaacccacactggacatcgaactgctcaagaccgaggtcacgaaccctgccgttctgcgcaaactttgcattgaagcgaagatcagcaatacaaccaccgattctagatgtccgacacaaggagaggccaccctgatggaagaacaagacgctaacttcgtgtgccggcgcacatttgtggatagaggctggggcaatgggtgtggactcttcggcaaagggtccctgattacgtgcgccaagtttaagtgcgtcaccaaacttgagggaaagatcgtgcagtacgaaaacctgaaatatagcgttatcgtgacagtccacaccggcgaccagcatcaagtggggaatgagtctacagaacacggaaccacggctaccattacaccccaggcccctacctccgagatccagctcacagactacggcgccctgaccctggattgtagcccccggacgggcctcgacttcaacgaaatggttctgcttacaatgaaggagaaatcttggctggtgcataagcagtggtttctcgatctgcctcttccctggacctccggggctagcacatcccaagagacctggaatcgccaggacctgctcgtcaccttcaaaacagcgcacgccaagaagcaggaagtggtcgtgctgggatctcaagagggcgctatgcacacggccctgaccggggccacagaaattcagaccagcggaacaaccacgatctttgctggccatctcaaatgcagactgaagatggataaacttacactgaaggggatgtcctatgttatgtgtaccggcagcttcaaactcgagaaggaagtggccgagacccagcacggaacagtcctggtgcagattaagtacgagggcaccgacgcgccgtgcaaaatccctttctctacacaagatgaaaagggggttatccagaacggacggctgattacggctaatcccatcgtgaccgacaaagagaagcctgtcaacattgaagccgagccgccctttggcgagtcctatatcgtgattggggtgggagaaaaagcccttaagctcagctggttcaagaaaggctctagcatcgggaagatgtttgaggctacagccagaggcgctcgccggatggccatcctgggagataccgcgtgggacttcggctccattgggggagtttttacatctgtcggcaaactggtgcatcagatcttcgggaccgcctacggagtgctctttagcggcgtctcctggacgatgaagattgggatcggcgtgctgcttacctggctgggactcaatagcagatctacatccctgagcatgacctgtattgctgttggcctggtgacactttacctcggggtcatggtgcaggccgattctggatgcgttatcaactggaaaggccgcgaactgaagtgtgggtccggaattttcgtgaccaatgaggtccacacatggaccgaacaatataagtttcaggctgacagccctaaacggctgtccgccgcgatcggcaaggcctgggaggagggggtgtgcggcatcagatctgctacgcgcctcgaaaacattatgtggaaacagatcagcaacgagctgaatcatattcttctggaaaacgacatgaagttcacagttgtggtcggagatgtggtgggcatcctcgcccaggggaaaaagatgattcggccgcaacccatggagcacaaatactcctggaagtcttggggaaaggctaaaatcatcggcgccgacgtccagaataccacctttattatcgatgggcctaacacacccgaatgtcctgacgatcagagagcctggaatatttgggaggttgaggactatggattcggcatctttaccacgaacatttggctgaagctgcgcgatagctacacacaggcttgcgaccaccggcttatgtccgcggccatcaaagatagcaaggctgtgcatgccgacatgggctattggatcgaatctgagaaaaatgaaacctggaagctcgccagagcttccttcattgaggtgaagacatgtatctggcccaaaagccacaccctgtggtctaacggggtcctggaatccgagatggtgattccgaagatctacggaggccctattagccaacataattatcgccccgggtacttcacacagaccgccggaccttggcacctcggcaaactggagcttgattttgacctgtgcgaagggacgaccgttgtggtcgatgagcactgcggaaaccggggcccctctctcagaacaaccacagtgaccggcaagatcatccatgaatggtgttgccggagctgtacgctgcctcccctgcgcttcaaaggggaggacggatgctggtacggcatggagattagaccggttaaggaaaaggaggaaaatcttgtgaaatccatggtcagcgcggggtctggagaggtggactcctttagcctcggcctgctgtgtatctccattatgatcgaagaggttatgcggtctagatggagccgcaagatgctcatgacagggaccctggctgtgttccttctgctcattatgggacagctgacatggaacgatctgatccggctttgcattatggtcggcgccaatgcctccgacagaatgggcatggggaccacctatctggctctcatggccacatttaaaatgcgccctatgttcgcggtgggactgctctttagacggctgacgtctcgcgaggtgcttctgctcaccatcggcctgagcctggtcgcttccgttgaacttcccaactctctggaggaactcggggatggactggccatgggcatcatgattctcaagctgcttacagacttccaaagccaccagctgtgggccaccctcctgtccctgacatttatcaaaaccacgcttagcctgcattacgcttggaagacaatggccatggtgctctctattgtgtccctgttccccctctgtctgagcaccacctctcagaagacaacctggcttcctgtcctgctggggtccctcggatgcaaaccgctgacaatgtttcttatcgctgagaataagatttggggcagaaaaagctggcccctgaacgaaggcatcatggccgtgggggttgtgtctatcctcctgtccagcctcctgaagaacgatgtccctcttgcgggacccctgattgccggcgggatgctgatcgcttgttatgtgatttccggaagctctgccgacctcagcctggagaaagctgccgaggtttcctgggaagaggaagccgagcactctggcgctagccataatatccttgtggaagtccaggatgacgggacgatgaagattaaagatgaggagcgggacgataccctgacaatcctcctgaaggcgaccctcctggccgtgtccggagtctaccctctttctatccccgctacactgttcgtgtggtatttttggcaaaagaaaaagcagcgcagcggcgttctgtgggacacccctagccctcccgaagtggagagagccgtcctcgatgacggcatttaccggatcatgcagcgcgggctgcttggaagatctcaggtgggcgttggggtgttccaagaaaacgtcttccacacgatgtggcacgtgacccggggagccgtgctgatgtatcagggcaaacgcctcgagcccagctgggcttccgttaagaaagacctgattagctacgggggaggctggagactccagggctcttggaatacaggggaggaagtccaggtgatcgccgtggagcccggaaagaaccctaagaatgtccaaaccgcgcccggcacatttaaaaccccggaaggggaggtgggagctattgccctggatttcaagcctggcacatccgggagccccatcgttaaccgggaaggaaaaattgtgggcctttacggcaatggggtcgtgacgacctctggaacatatgtttccgccatcgctcaggccaaggcgagccaggagggccctctgcccgagatcgaagacgaggtgtttagaaaacgcaacctgaccattatggatctccatcccgggtccggaaagacccggagatacctgcctgctatcgtccgcgaagccattaagcggaaacttagaacactgatcctcgccccgacgcgcgtggttgcttctgagatggccgaagctctgaagggcatgcccattcggtatcaaaccacagccgtgaaaagcgagcacaccgggaaggagatcgtcgacctgatgtgccatgcgacattcaccatgagactcctttcccctgtgcgcgtgcccaattacaacatgatcattatggatgaagcccactttacggaccctagctctatcgctgcccggggctatatttccacaagagtcggaatgggcgaggctgccgccatcttcatgaccgctacaccccctgggagcgttgaagcgtttccgcagtctaatgccgtgattcaggatgaggaacgggacatccccgagcgcagctggaactccggatacgagtggatcacagatttccctggcaaaaccgtgtggtttgtcccctctattaagagcgggaatgacatcgctaactgtctgagaaagaatggaaaacgggtgattcagctgtcccgcaagacattcgataccgaatatcagaagacgaagaacaacgactgggactacgttgtgacaaccgatatctctgagatgggcgccaattttagagccgaccgggtcattgatcctagacgctgcctcaaacccgtgatcctgaaggacgggccggaacgggttattcttgctggccctatgcccgtgacagtcgccagcgcggctcagagacgcggacggatcggcagaaaccataataaggagggggatcagtacatctatatgggacagcccctgaacaatgacgaggatcacgcccactggaccgaagccaaaatgctcctggacaacattaatacgcctgagggcatcattcccgctctgttcgaacctgagcgcgaaaagtccgccgcgatcgatggggagtaccggctcagaggagaggcccgcaaaaccttcgtggaacttatgagacggggcgacctgccggtctggctgagctataaggtggcttctgaggggtttcaatactccgatcgcagatggtgcttcgacggcgaacggaacaatcaggttctcgaggaaaacatggatgtggagatttggacaaaagagggagaacgcaagaaactgagaccccggtggcttgacgccagaacctatagcgaccctctggctctccgcgagtttaaggagttcgccgctggccggagatccgtgtctggggatctgatcctggagatcggaaagctcccccagcatcttacacagcgcgcccaaaatgcgctggacaacctggtcatgctccacaatagcgaacagggcgggcgggcctacagacatgctatggaggagctgcctgataccattgaaacacttatgctgctcgccctgatcgctgttctgaccggaggcgtgacgctctttttcctttccggccgggggctgggaaaaacatctattggcctgctctgtgtgatggccagctccgtcctgctttggatggccagcgtggagccccactggatcgctgcgtctattatcctggaatttttcctcatggttctgctgatcccggagcctgaccgccagagaacaccccaggataaccaactcgcctatgtggtcattgggcttctgtttatgatcctgaccgtggctgccaatgagatgggactcctggaaacaaccaagaaagaccttggcattgggcacgtcgccgtggagaaccatcaccatgctacaatgctggatgttgacctccaccctgcctccgcgtggacgctgtacgccgtggctaccacaatcattacccccatgatgcggcatacaatcgaaaacaccacggccaatattagcctgaccgctatcgccaaccaggcggccatcctcatgggacttgataagggctggcctatttctaaaatggacatcggcgtccccctgctggctctcgggtgctactcccaggtgaatccgctgacacttaccgccgctgttctgatgctcgtggcccactatgctattatcggacctggcctgcaagccaaggcgacacgcgaggcccagaagagaaccgctgccgggattatgaaaaaccccacggtcgatggaatcgtggctatcgacctggatcccgtggtttacgacgccaagttcgaaaaacagctcggccagattatgcttctgatcctgtgtacaagccaaattctcctgatgcggaccacatgggccctttgcgagtctatcaccctggcgaccgggcctctcacaacgctgtgggagggaagcccgggcaagttttggaataccacaattgctgtctccatggccaacatcttccgcggctcttatctggctggggccggactcgcctttagccttatgaaatccctgggcgggggaagacggggcaccggggctcagggagaaacactgggcgagaagtggaagcgccagctcaatcagctgagcaaatccgagttcaacatctacaagagatctggcattatggaggtggaccggagcgaagccaaagaggggcttaagagaggagagaccacgcgccacgcggtgtcccggggcacagccaaactgagatggttcgtcgaacgcaatctcgttaagcccgaggggaaggtgatcgatctgggatgtggcagagggggatggtcttattactgcgctggcctgaaaaaggtgaccgaagtcaaaggctataccaaagggggacctggccatgaggaacccattcctatggccacatacgggtggaacctcgtgaaacttcacagcggaaaggacgtctttttcacaccccctgagaaatgtgatacactgctgtgcgacatcggcgagtcctctccgaatcccacgattgaagaggggagaaccctccgcgtgctgaagatggtcgaaccttggcttcggggaaaccaattttgtatcaagattctgaatccctacatgcctagcgtggttgagacactcgagcagatgcagagaaaacatggcggcatgctggtgcgcaaccccctgtcccggaatagcacccacgaaatgtattgggtctcttgcgggacaggaaacatcgtgtccgctgtgaatatgaccagcagaatgctcctgaaccgcttcacgatggcccaccggaagccgacctacgagagagatgtcgaccttggcgcggggacacgccatgttgccgtggaacctgaggtggctaacctggatatcattggacagagaatcgaaaatattaaacacgagcataagtctacctggcactatgacgaggataacccctacaaaacatgggcctatcatggctcctacgaagtcaagcccagcgggtctgcttccagcatggtgaatggagttgtgaagctcctgaccaaaccttgggacgtcatccccatggtgacacaaattgccatgaccgatacgacaccttttggccagcagcgggttttcaaggagaaagtggacacccgcaccccgaaggctaaaagaggcacagcccaaatcatggaagtcacggcgcggtggctttgggggtttctgtccagaaacaagaagccccggatctgtacccgcgaggagttcacaagaaaagtgcggagcaatgccgctattggagccgtttttgtggacgagaaccagtggaactctgctaaggaggccgtcgaagatgagcgcttctgggacctcgtgcagaaagaaagagagctgcacaagcagggcaaatgcgcgacctgcgtctataacatgatggggaagcgggaaaagaaactgggagagtttggcaaggcgaaagggagccgcgctatctggtacatgtggctcggcgccagattcctggagtttgaagcccttggattcatgaatgaggatcactggttctcccgggaaaactctctgagcggcgtggagggggagggactccataagctgggctacattcttcgcgacatctccaaaattcctgggggaaatatgtatgctgatgacacagccggctgggataccagaatcacagaagacgatctgcaaaacgaggctaagatcaccgacattatggaacccgagcacgccctcctggcgacgtctatctttaaactgacctaccagaataaggttgtgcgggtccagcgccctgccaagaacgggacagtgatggatgtgattagcagacgggaccagcgcggctccggacaagttggcacctatgggctcaatacattcaccaacatggaagctcagctgatcagacagatggagtctgagggaatttttcttcccagcgaactggagacgccgaacctcgccgaacgggtgctggattggcttgagaaacatggcgtcgaaagactgaagcgcatggctatctccggggacgactgtgtggttaaacctatcgatgaccggttcgccacagcgctcaccgccctgaatgatatgggaaaggtgagaaaagacattccccagtgggagcctagcaagggctggaacgattggcaacaggtccccttttgctctcaccacttccatcagctgatcatgaaggacgggcgcgagattgtggtcccttgtcggaatcaggatgaactcgtgggcagagctcgcgtttcccaaggagccggctggagcctgcgggagacagcttgccttgggaaatcttacgcccagatgtggcagctgatgtattttcacagacgcgacctccggctggctgccaacgcgatctgttccgccgtgcccgtcgattgggtgccgaccagcagaacgacctggtccattcatgctcaccatcaatggatgacaaccgaagacatgctttctgtttggaatcgcgtgtggatcgaggaaaacccttggatggaggataagacacacgtcagctcctggggagacgtgccctacctgggcaaacgggaggaccagtggtgcgggagcctcattggactgaccgccagagccacatgggcttctaatatccaggtggccatcaaccaggttcggagactgattggcaatgaaaactatctcgattacatgacctccatgaagcgcttcaaaaatgagggggaccccgaaggcgcgctgtggtga

SEQ ID NO: 19266 - RNA, 9879 nt, synthetic construct
  misc_feature 1..9879: note = derived and/or modified CDS sequence (opt5) from DENV-1__EU482794__SS-prME
  source 1..9879: mol_type = other RNA
agcgtgaccatgctgctcatgctgatgcccaccgcccttgctttccacctgacgaccagaggcggggagcctcatatgatcgtgacaaagcaggaacggggaaaatccctcctgtttaagacctctgccggcgttaatatgtgcacccttattgccatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgctagcctgttccccctctgtctgtctaccacctcccagaagacaacctggcttcctgtgctgctggggagcctcggatgcaaaccgctgacaatgtttcttattacggagaccaagatctggggcagaaaatcttggcccctgaatgaaggcattatggccgtcggggtggtttccatcctcctgagctccctcctgaagaacgatgtgcctcttgcgggacccctgatcgccggcgggatgctgattgcttgttatgtcatcagcggatctagcgccgacctctccctggagaaagctgccgaggtgtcttgggaagaggaagccgagcacagcggcgcttcccataacattcttgttgtggtccaggatgacgggacaatgaagatcaaagatgaggaacgggacgataccctgacaattctcctgaaggcgaccctcctggccgtgtctggagtctaccctcttagcatccccgctacgctgttcgtgtggtatttttggcaaaagaaaaagcagcgctccggcgttctgtgggacaccccttctcccccggaggtggaaagagccgtcctcgatgacggcatctaccggattatgcagcgcgggctgcttggaagaagccaggtgggcgttggggtgttccaagagaatgtcttccacacaatgtggcacgtgacccggggagccgtgctgatgtatcagggcaaacgcctcgaaccttcctgggctagcgttaagaaagacctgatctcttacgggggaggctggagactccagggctcctggaacacaggggaggaggtccaggtgattgccgtggaacccggaaagaatcctaagaacgtccaaaccgcgcccggcacatttaaaacgccggagggggaagtgggagctatcgccctggatttcaagcctggcaccagcgggtctcccattgttaatcgggagggaaaaatcgtgggcctttacggcaacggggtcgtgacaacctccggaacctatgttagcgccattgctcaggccaaggcgtcccaggaaggccctctgcccgagatcgaggacgaagtgtttagaaaacgcaatctgacaatcatggatctccatcccgggtctggaaagacgcggagatacctgcctgctattgtccgcgaggccatcaagcggaaacttagaaccctgattctcgccccgacacgcgtggttgctagcgaaatggccgaggctctgaagggcatgcccatccggtatcaaaccacagccgtgaaatccgaacacaccgggaaggagattgtcgacctgatgtgccatgcgacgttcacaatgagactccttagccctgtgcgcgtgcccaactacaatatgatcatcatggatgaggcccactttaccgacccttcttccattgctgcccggggctatatcagcaccagagtcggaatgggcgaagctgccgccattttcatgacagctacaccccctgggtctgttgaggcgtttccgcagagcaacgccgtgatccaggatgaggaacgggacattcccgaacgctcctggaactctggatacgagtggatcacagatttccctggcaaaaccgtgtggtttgtccccagcatcaagtccgggaacgacattgctaattgtctgagaaagaacggaaaacgggtgatccagctgtctcgcaagacgttcgatacagagtatcagaagaccaagaataacgactgggactacgttgtgacaaccgatattagcgaaatgggcgccaactttagagccgaccgggtcatcgatcctagacgctgcctcaaacccgtgattctgaaggacgggccggagcgggttatccttgctggccctatgcccgtgacggtcgcctccgcggctcagagacgcggacggattggcagaaattacaacaaggaaggggatcagtatatctacatgggacagcccctgaataacgacgaggatcatgcccactggaccgaggccaaaatgctcctggacaatatcaacacacctgaaggcattatccccgctctgttcgagcctgaacgcgaaaagagcgccgcgattgatggggaatatcggctcagaggagaggcccgcaaaaccttcgtggagcttatgagacggggcgacctgccggtctggctgtcttacaaggtggcttccgaagggtttcaatatagcgatcgcagatggtgcttcgacggcgagcggaataaccaggttctcgaagagaatatggatgtggaaatctggacaaaagagggagagcgcaagaaactgagaccccggtggcttgacgccagaacctactccgaccctctggctctccgcgaatttaaggagttcgccgctggccggagatctgtgagcggggatctgattctggaaatcggaaagctcccccagcaccttacacagcgcgcccaaaacgcgctggacaatctggtcatgctccataactccgagcagggcgggcgggcctatagacacgctatggaggaactgcctgataccatcgagacgcttatgctgctcgccctgattgctgttctgacaggaggcgtgaccctctttttcctttctggccgggggctgggaaaaaccagcatcggcctgctctgtgtgatggcctccagcgtcctgctttggatggcctctgtggaaccccattggattgctgcgtccatcattctggagtttttcctcatggttctgctgatcccggaacctgaccgccagagaacaccccaggataatcaactcgcctacgtggtcatcgggcttctgtttatgattctgaccgtggctgccaacgagatgggactcctggagacaacgaagaaagaccttggcatcgggcacgtcgccgtggaaaatcaccatcacgctaccatgctggatgttgacctccatcctgccagcgcgtggacactgtacgccgtggctaccacaattatcacccccatgatgcggcacacgattgagaacaccacagccaacatctctctgaccgctattgccaatcaggcggccatcctcatgggacttgataagggctggcctatctccaaaatggacattggcgtccccctgctggctctcgggtgctatagccaggtgaacccgctgacacttaccgccgctgttctgatgctcgtggcccattacgctatcattggacctggcctgcaagccaaggcgacgcgcgaagcccagaagagaacagctgccgggatcatgaaaaatcccaccgtcgatggaattgtggctatcgacctggatcccgtggtttatgacgccaagttcgagaaacagctcggccagatcatgcttctgattctgtgtacatctcaaatcctcctgatgcggaccacctgggccctttgcgaaagcattacactggcgacggggcctctcaccacactgtgggagggatccccgggcaagttttggaacaccacaatcgctgtctctatggccaatattttccgcggcagctacctggctggggccggactcgccttttcccttatgaaaagcctgggcgggggaagacggggcaccggggctcagggagagacgctgggcgaaaagtggaagcgccagctcaaccagctgtccaaatctgagttcaatatctataagagaagcggcatcatggaagtggaccggtccgaggccaaagaagggcttaagagaggagagacaacccgccacgcggtgtctcggggcaccgccaaactgagatggttcgtcgagcgcaacctcgttaagcccgaagggaaggtgattgatctgggatgtggcagagggggatggagctactattgcgctggcctgaaaaaggtgacagaggtcaaaggctacaccaaagggggacctggccacgaggagcccatccctatggccacatacgggtggaatctcgtgaaacttcattccggaaaggacgtctttttcacgccccctgaaaaatgtgataccctgctgtgcgacattggcgagtctagcccgaaccccacaatcgaggaagggagaaccctccgcgtgctgaagatggtcgagccttggcttcggggaaatcaattttgtattaagatcctgaacccctatatgccttccgtggttgaaacactcgagcagatgcagagaaaacacggcggcatgctggtgcgcaatcccctgagccggaactctacccatgagatgtactgggtctcctgcgggacgggaaatattgtgagcgctgtgaacatgacctctagaatgctcctgaatcgcttcacaatggcccaccggaagccgacctatgaaagagatgtcgaccttggcgcggggacacgccacgttgccgtggagcctgaagtggctaacctggatatcatcggacagagaattgagaacatcaaacatgaacacaagtccacctggcattacgacgaggataatccctataaaacatgggcctaccacggcagctatgaggtcaagccctctgggtccgctagctccatggtgaacggagttgtgaagctcctgaccaaaccttgggacgtcattcccatggtgacgcaaatcgccatgacagataccaccccttttggccagcagcgggttttcaaggaaaaagtggacacacgcacgccgaaggctaaaagaggcaccgcccaaattatggaggtcacagcgcggtggctttgggggtttctgagcagaaataagaagccccggatctgtacccgcgaagagttcacaagaaaagtgcggtctaacgccgctatcggagccgtttttgtggacgaaaatcagtggaacagcgctaaggaggccgtcgaggatgaacgcttctgggacctcgtgcagaaagagagagaactgcataagcagggcaaatgcgcgacctgcgtctacaatatgatggggaagcgggagaagaaactgggagaatttggcaaggcgaaagggtcccgcgctatttggtacatgtggctcggcgccagattcctggagtttgaggcccttggattcatgaacgaagatcactggttctctcgggagaatagcctgtccggcgtggaaggggagggactccacaagctgggctatatccttcgcgacatttctaaaatccctgggggaaacatgtacgctgatgacacagccggctgggataccagaattacggaggacgatctgcaaaatgaagctaagatcaccgacatcatggagcccgaacatgccctcctggcgacaagcatttttaaactgacctatcagaacaaggttgtgcgggtccagcgccctgccaagaatgggacagtgatggatgtgatctccagacgggaccagcgcggctctggacaagttggcacctacgggctcaacacgttcacaaatatggaggctcagctgattagacagatggaaagcgagggaatctttcttccctccgagctggaaaccccgaacctcgccgagcgggtgctggattggcttgaaaaatatggcgtcgagagactgaagcgcatggctattagcggggacgactgtgtggttaaacctatcgatgaccggttcgccacagcgctcaccgccctgaacgatatgggaaaggtgagaaaagacatcccccagtgggaaccttctaagggctggaatgattggcaacaggtccccttttgctcccaccatttccaccagctgattatgaaggacgggcgcgagatcgtggtcccttgtcggaaccaggatgagctcgtgggcagagctcgcgttagccaaggagccggctggtctctgcgggaaacggcttgccttgggaaatcctacgcccagatgtggcagctgatgtattttcacagacgcgacctccggctggctgccaatgcgatttgtagcgccgtgcccgtcgattgggtgccgacctccagaacaacctggtctatccatgctcaccatcaatggatgacaaccgaggacatgcttagcgtttggaaccgcgtgtggattgaagagaatccttggatggaagataagacacacgtctccagctggggagacgtgccctacctgggcaaacgggaggaccagtggtgcgggtctctcatcggactgaccgccagagccacgtgggcttccaacattcaggtggccatcaatcaggttcggagactgatcggcaacgagaattacctcgattatatgacaagcatgaagcgcttcaaaaacgaaggggaccccgagggcgcgctgtggtga

SEQ ID NO: 19267 - RNA, 9879 nt, synthetic construct
  misc_feature 1..9879: note = derived and/or modified CDS sequence (opt5) from DENV-1__EU482795__SS-prME
  source 1..9879: mol_type = other RNA
tccgtgaccatgctgctcatgctgatgcccaccgctcttgctttccacctgacgacccggggcggggaacctcatatgattgtctccaagcaggaacggggaaaatctctcctgtttaagacatccgccggcgttaacatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttctctggccatctgaagtgcagactcaaaatggataagctgacgcttaaagggatgtcctatgtgatgtgtacaggcagcttcaagctggagaaggaagtcgctgagacccagcacggaaccgtgctcgttcagatcaaatacgagggcacagacgccccgtgcaagattcctttttctacccaggatgaaaaaggggtgacacaaaacggacggctgatcacggcgaatcccatcgtcaccgacaaggagaaacctgtgaacattgaagctgagccgcccttcggcgagagctatatcgtgattggggccggagaaaaggccctgaaactttcctggtttaaaaagggctctagcatcgggaaaatgttcgaggctacagccagaggcgctcgccggatggccattctcggagataccgcgtgggactttggctccatcgggggagttttcacaagcgtcggcaagctggtgcatcagatctttgggaccgcctacggagtgctgttctctggcgtctcctggacgatgaaaattgggatcggcgtgctcctgacctggcttggactgaatagcagatctacatccctcagcatgacctgtattgctgttggcctggtgacactgtaccttggggtcatggtgcaggccgattccggatgcgttatcaactggaagggccgcgaactcaagtgtgggtctggaatttttgtgaccaatgaggtccacacatggaccgaacagtataaattccaagctgacagccctaagcggctgtccgccgcgatcggcaaagcctgggaggagggggtgtgcggcattagatctgctacgcgcctggaaaacatcatgtggaagcagatcagcaacgagctcaatcatattctgcttgaaaacgacatgaaatttacagttgtggtcggagatgtggccggcatcctggctcaggggaagaaaatgattcggccgcagcccatggagtacaagtattcctggaaaagctggggaaaggccaagatcattggcgccgacgtgcaaaataccaccttcatcatcgatgggcctaacacacccgaatgtcctgacgatcagagagcttggaatatttgggaggtcgaggactacggatttggcatcttcaccacgaacatttggctcaaactgcgcgattcttatacacaggtttgcgaccaccggctgatgtccgcggccatcaaggatagcaaagctgtgcacgccgacatgggctactggattgaatctgagaagaatgaaacctggaaacttgccagagcttccttcatcgaggtgaaaacatgtatctggcccaagagccataccctctggtctaacggggtcctggaaagcgagatgattatcccgaaaatttatggaggccctatctcccagcacaattaccgccccgggtactttacacaaaccgccggaccttggcatctgggcaagctcgagctggatttcgacctttgcgaagggacgaccgtggttgtggatgagcactgcggaaaccggggccccagcctgagaacaaccacagtcaccggcaaaattatccacgaatggtgttgccggtcttgtacgctccctcccctgcgctttaagggggaggacggatgctggtatggcatggagatcagaccggtgaaggaaaaagaggaaaatctggttaagtccatggtgagcgcggggtccggagaggtcgactctttcagccttggcctcctgtgtatttccatcatgattgaagaggtgatgcggtctagatggagccgcaaaatgctgatgacagggaccctcgctgtctttttcctgcttatcatgggacagctgacatggaacgatctcattcggctgtgcatcatggtgggcgccaatgcctccgacagaatgggcatggggaccacctacctggctcttatggccacatttaagatgcgccctatgttcgcggtcggactgctctttagacggctgacgtctcgcgaggtgctcctgcttaccattggcctgagcctcgtggcttccgtcgaactgcccaacagcctggaggaacttggggatggactggccatgggcatcatgatcctcaaactgctcacagacttccagtctcatcaactgtgggccacccttctgtccctcacatttattaagaccacgttcagcctgcactatgcttggaagacaatggccatggttctgtctatcgtgtcccttctgcccctctgtctgagcaccacctctcagaaaacaacctggctccctgtgctgcttgggtccctgggatgcaagccgctgacaatgtttctcattgctgagaataaaatctggggcagaaagagctggcccctgaacgaaggcattatggccgtcgggatcgtgtccatccttctgagctctctcctgaaaaacgatgttcctctcgcgggacccctgattgccggcgggatgcttatcgcttgttacgtgattagcggatcctctgccgacctgagcctggagaaggctgccgaggtctcctgggaagaggaagccgagcattctggcgctagccacaatatcctcgtggaagttcaggatgacgggacgatgaaaattaaggatgaggagcgggacgataccctgacaatccttctgaaggcgaccctcctggccgtgtccggagtctatcctctctctatccccgctacactgttcgtgtggtacttctggcagaaaaagaaacaacgcagcggcgtcctttgggacacccctagccctcccgaagtggagagagccgttctggatgacggcatttatcggatcatgcagcgcgggctgctcggaagaagccaggtgggcgtcggggtgtttcaggaaaacgttttccatacgatgtggcacgtgacccggggagccgtcctgatgtaccaaggcaagcgccttgagccctcttgggcttccgtgaaaaaggacctgattagctacgggggaggctggagactccagggctcttggaatacaggggaggaagtgcaggttatcgccgtcgagcccggaaagaaccctaaaaatgtgcagaccgcgcccggcacatttaagacctccgaaggggaggtgggagctattgccctggatttcaaaccgggcacaagcgggtcccctatcgtcaaccgggaaggaaagattgtgggcctctatggcaatggggttgtgacgacctctggaacatacgtcagcgccatcgctcaagccaaagcgtcccaggagggccccctgcctgagatcgaagacgaggtgtttagaaagcgcaaccttaccattatggatctgcaccccgggagcggaaagacccggagatatctgcccgctatcgttcgcgaagccattaaacggaagctcagaacactgatccttgcccctacgcgcgtggtcgcttctgagatggccgaagctctgaaaggcatgccgattcggtaccagaccacagccgtgaagtccgagcataccgggaaagagatcgttgacctcatgtgccacgcgacattcaccatgagactgctgagccccgtgcgcgtccctaattataacatgatcattatggatgaagcccattttacggacccctctagcatcgctgcccggggctacatttccacaagagtgggaatgggcgaggctgccgccatcttcatgaccgctacccctcccgggtctgtggaagcgtttcctcaaagcaatgccgtcattcaggatgaggaacgggacatcccggagcgctcctggaactctggatatgagtggatcacagatttccccggcaagaccgtttggtttgtgcctagcattaagtccgggaatgacatcgctaactgtctccgcaagaatggaaagcgggtgattcagcttagccgcagaacattcgataccgaataccagaaaacgaagaacaacgactgggactacgtcgtgacaaccgatatctctgagatgggcgccaatttccgggccgacagagttattgatccccgccggtgcctgaaacctgtgatcctgaaggacgggcccgaaagagtcattctcgctggcccgatgcctgtgacagttgcctccgcggctcaacgccggggaagaatcggccgcaaccacaataaggagggggatcagtatatctacatgggacagcccctgaacaatgacgaggatcatgcccactggaccgaagccaaaatgcttctggacaacattaatacgcccgagggcatcattcctgctctctttgaacccgagcgggaaaagagcgccgcgatcgatggggagtatagactgcgcggagaggccagaaaaaccttcgtggaactgatgcggcgcggcgacctccctgtctggctttcctacaaggtggcttctgaggggtttcagtatagcgatagacggtggtgcttcgacggcgaacgcaacaatcaagtcctggaggaaaacatggatgtggagatttggacaaaagagggagaaagaaagaaactgcggccgagatggctcgacgcccgcacctactccgaccccctggcccttcgggagtttaaggagttcgccgctggcagacgctctgttagcggggatctgatcctcgagatcggaaagctgcctcagcacctgacacagcgggcccagaatgcgctcgacaaccttgtgatgctgcataattccgaacaaggcgggagagcctatcggcacgctatggaggagctgcccgataccattgaaacactcatgctgcttgccctgatcgctgtgctcaccggaggcgtcacgctgtttttcctgagcggccgcgggctcggaaaaacatctattggccttctgtgtgttatggcctccagcgccctgctctggatggcttctgtggagcctcattggatcgcggcctccattatcctggaatttttccttatggtgctgctcatccccgagccggacagacagcggacccctcaggataaccagctggcttacgtcgtgattgggctgctctttatgatccttaccgttgccgccaatgagatgggactgctggaaacaaccaagaaagacctcggcattgggcacgtggctgtcgagaaccaccatcacgccgcgatgctggatgtggaccttcatcccgccagcgcttggacactgtacgccgtcgctacgaccatcattacacctatgatgcgccacaccatcgaaaacacaaccgccaatatttctctcacggcgatcgccaaccaagctgccatcctgatgggactggataagggctggcccattagcaaaatggacatcggcgtgcctctccttgctctggggtgctattcccaggttaatcccctgaccctcacagccgctgtgctgatgcttgtcgcccattacgcgattatcggaccgggcctgcaggccaaggctaccagagaggcccaaaagcggacagctgccgggattatgaaaaaccctaccgtggatggaatcgttgccatcgacctcgatcccgtggtctatgacgcgaagttcgaaaaacagctgggccagattatgctgctcatcctttgtacgtctcagattctgctgatgcgcacaacctgggctctctgcgagagcatcacactggccaccgggccccttaccacactgtgggagggatcccctggcaagttttggaatacgaccattgctgtgagcatggccaacatcttcagaggctcctacctcgccggggctggactggccttctctctgatgaaaagcctcggcgggggacggcgcggcacaggggcgcaaggagaaacccttggcgagaagtggaagagacagctgaatcagctgtccaaatctgaatttaacacatataagcggagcggcatcatggaggtggacagatccgaagccaaagaggggctcaagcgcggagagaccacgaaacacgctgtttctcggggcacagccaagctgagatggttcgtcgaacgcaatcttgtgaagccggaggggaaagtgattgatctgggatgtggcagagggggatggagctactattgcgctggcctcaagaaagtcaccgaagttaagggctacaccaaagggggacccggccacgaggaacctatccccatggccacatacgggtggaacctggtgaagctgcattccggaaaagacgtgtttttcattcctcccgagaagtgtgataccctcctttgcgacatcggcgagagctctcctaatccgacaattgaagaggggagaacgctgcgcgtcctgaagatggtggaaccctggctccggggaaaccagttttgtatcaaaattctgaatccttatatgccctccgttgtggagacccttgagcaaatgcagagaaagcacggcggcatgctggtccgcaaccctctcagcagaaattctacacatgaaatgtactgggtgtcctgcgggaccggaaacatcgttagcgcggtgaatatgacatctagaatgctgctgaaccgcttcaccatggcccaccggaaacccacgtatgagagagatgtcgacctcggcgctgggacccgccacgtggccgtggaaccggaggtcgctaacctggatatcattggacagagaatcgaaaatattaagcatgagcacaaatccacatggcattacgacgaggataacccttataagacctgggcctaccacggcagctatgaagttaagccctccgggagcgcttctagcatggtgaatggagtggtcaaacttctgacaaagccctgggacgtgatccctatggttacccagattgccatgacagataccacgccctttggccaacagcgggtgttcaaagagaaggtcgacacacgcacccctaaagcgaagagaggcaccgcccagatcatggaagtgacagctaagtggctctgggggtttctgtcccggaacaaaaagccgagaatctgtacgcgggaggagttcacccgcaaagttagatctaatgccgctattggagccgtgtttgtcgacgagaaccaatggaatagcgccaaggaggcggtggaagatgagcggttctgggaccttgttcatcgcgaaagagagctgcacaaacagggcaagtgcgctacatgcgtgtacaacatgatggggaagcgggagaagaagctcggagagtttggcaaagccaaggggtcccgcgccatctggtacatgtggctgggcgctagattcctggagttcgaagccctcggatttatgaatgaggatcactggttctctcgggaaaacagcctgtccggcgtcgagggggagggacttcataaactgggctatattctccgcgacatctctaagattcccgggggaaatatgtacgctgatgacaccgccggctgggatacaagaatcaccgaagacgatctgcagaacgaggcgaaaatcacagacattatggaacctgagcacgcccttctggctaagagcatctttaagctcacctatcagaataaagtggtccgggtgcaacgccccgccaagaacgggacggttatggatgtgatttccagacgggaccagcgcggcagcggacaggtcggcacctacgggctgaatacattcaccaacatggaagctcagctgatcagacaaatggagtctgagggaatcttttcccctagcgaactcgagacacccaacctggccggccgggtgcttgattggctggaaaaacatggggtggagagactcaagcgcatggcgatctctggagacgactgtgttgtgaaaccgatcgatgaccggttcgccaccgctctgacggcccttaatgatatgggcaaggtcagaaaggacattcctcagtgggaaccctccaaagggtggaacgattggcaacaggtgcctttttgcagccaccacttccatcaactgatcatgaaggacggccgcgagattgttgtgccctgtcggaatcaggatgagctcgtcggacgggctcgcgtgtcccagggcgccgggtggtctctgcgggaaacagcttgcctgggaaaaagctatgcccagatgtggcaactcatgtactttcacagacgcgacctgcggcttgcggccaacgctatctgttccgccgtccctgtggattgggttcccaccagcagaacaacctggtctattcatgcccaccatcagtggatgacgaccgaggacatgctgtccgtgtggaatcgcgtctggatcgaagagaacccgtggatggaagataagacacacattagctcttggggcgacgtgccttatctcgggaaacgggaggaccagtggtgcggaagcctgatcggccttaccgctagagccacatgggcgaccaatatccaagttgctattaaccaggtgcggagactgatcgggaatgagaactacctcgattacatgacatccatgaagcgcttcaagaatgaatctgaccccgagggcgccctgtggtga

SEQ ID NO: 19268 - RNA, 9879 nt, synthetic construct
  misc_feature 1..9879: note = derived and/or modified CDS sequence (opt5) from DENV-1__EU482796__SS-prME
  source 1..9879: mol_type = other RNA
agcgtgaccatgctgctcatgctgatgcccaccgcccttgctttccacctgacgacccggggcggggagcctcatatgatcgtcaccaagcaggaacggggaaagtccctcctgtttaagacctctgccggcgttaacatgtgcacccttattgccatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcattggcaaactggttcatcagatcttcgggaccgcttacggagtcctcttttccggcgtgagctggacgatgaagattgggatcggcgtgctgcttacctggctgggactcaattctagatccacaagcctgtctatgacctgtattgccgtcggcctggtgacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagtcgtggttggagatgtggtcggcatcctcgctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaagatgcgcgattcctacacacaggtctgcgaccaccggctgatgagcgcggccatcaaagattctaaggctgttcatgccgacatgggctattggatcgaatccgagaaaaatgaaacctggaaacttgccagagctagcttcattgaggtgaagacatgtatctggcccaaatctcacaccctctggtccaacggggtgctggaaagcgagatgattatcccgaagatttacggaggccctatctctcaacataattatcgccccgggtacttcacacagaccgccggaccttggcacctgggcaaactcgagctggattttgacctttgcgaagggacgaccgtcgtggttgatgagcactgcggaaaccggggccccagcctgagaacaaccacagtgaccggcaagatcattcatgaatggtgttgccggtcctgtacgctccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgacagggaccctcgctgtgttcctgcttctgatcatgggacagctcacatggaacgatctgattcggctgtgcatcatggttggcgccaatgcctctgacagaatgggcatggggaccacctatcttgctctgatggccacatttaaaatgcgccctatgttcgcggtgggactcctgtttagacggctcacgagccgcgaggtcctgcttctgaccatcggcctctccctggtggcttctgtggaactgcccaacagccttgaggaactgggggatggactcgccatgggcattatgatcctgaagctcctgacagacttccaatcccaccagctttgggccaccctgctcagcctgacatttattaaaaccacgctgtctcttcattacgcttggaagacaatggccatggtcctgtccatcgttagcctcattcccctgtgtctctctaccacctcccagaagacaacctggctgcctgtgcttctggggagcctgggatgcaaaccgctcacaatgttcctgatcgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgttatgtgattagcggatctagcgccgacctgtccctcgagaaagctgccgaggtctcttgggaagaggaagccgagcacagcggcgcttcccataatatcctggtggaagttcaggatgacgggacgatgaagatcaaagatgaggagcgggacgatacccttacaattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgtttcaagaaaacgttttccacacgatgtggcacgtgacccggggagccgtccttatgtatcagggcaaacgcctggagccttcctgggctagcgtgaagaaagacctcatttcttacgggggaggctggagactgcagggctcctggaatacaggggaggaagtgcaggttatcgccgtcgagcccggaaagaaccctaagaatgtgcaaaccgcgcccggcacattcaaaaccccggaaggggaggtgggagctattgccctcgattttaagcctggcacaagcgggtctcccatcgtcaaccgggaaggaaaaatcgtgggcctgtacggcaatggggttgtgacgacctccggaacatatgtcagcgccattgctcaggccaaggcgtcccaggagggccctcttcccgagatcgaagacgaggtgttcagaaaacgcaacctgaccattatggatctgcatcccgggtctggaaagacccggagatacctccctgctatcgttcgcgaagccattaagcggaaactgagaacacttatcctggccccgacgcgcgtggtcgctagcgagatggccgaagctctcaagggcatgcccatccggtatcaaaccacagccgtgaaatccgagcacaccgggaaggagattgttgacctgatgtgccatgcgacatttaccatgagactgctcagccctgtgcgcgtccccaattacaacatgatcattatggatgaagcccacttcacggacccttcttccatcgctgcccggggctatattagcacaagagtgggaatgggcgaggctgccgccatctttatgaccgctacaccccctgggtctgtggaagcgttcccgcagagcaatgccgtcatccaggatgaggaacgggacattcccgagcgctcctggaactctggatacgagtggatcacagattttcctggcaaaaccgtttggttcgtgcccagcattaagtccgggaatgacatcgctaactgtcttagaaagaatggaaaacgggtgattcagctgtctcgcaagacatttgataccgaatatcagaagacgaagaacaacgactgggactacgtcgtgacaaccgatatcagcgagatgggcgccaatttcagagccgaccgggttattgatcctagacgctgcctgaaacccgtgatcctcaaggacgggccggaacgggtcatcctggctggccctatgcccgtgacagttgcctccgcggctcagagacgcggacggattggcagaaaccataataaggagggggatcagtacatctatatgggacagccccttaacaatgacgaggatcacgcccactggaccgaagccaaaatgctgctcgacaacattaatacgcctgagggcatcattcccgctctgtttgaacctgagcgcgaaaagagcgccgcgatcgatggggagtaccggctgagaggagaggcccgcaaaaccttcgtggaactcatgagacggggcgaccttccggtctggctgtcttataaggtggcttccgaggggttccaatacagcgatcgcagatggtgctttgacggcgaacggaacaatcaggtcctggaggaaaacatggatgtggagatctggacaaaagagggagaacgcaagaaactcagaccccggtggctggacgccagaacctattccgaccctcttgctctgcgcgagttcaaggaatttgccgctggccggagatctgttagcggggatctcattctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtgctgaccggaggcgtcacgctgttctttctctctggccgggggcttggaaaaacaagcattggcctgctgtgtgttatggcctccagcgtgctcctgtggatggcctctgtggagccccactggatcgctgcgtccatcattcttgagttctttctgatggtcctcctgatcccggagcctgaccgccagagaacaccccaggataaccaactggcctatgtggttattgggctccttttcatgatcctgaccgtggctgccaatgagatgggactgctcgaaacaaccaagaaagacctgggcattgggcacgtcgccgtggagaaccatcaccatgctacaatgcttgatgtcgacctgcaccctgccagcgcgtggacgctctacgccgtggctaccacaatcattacccccatgatgcggcatacaatcgaaaacaccacggccaatatctctctgaccgctattgccaaccaggcggccatcctgatgggactcgataagggctggcctatttccaaaatggacatcggcgttccccttctggctctggggtgctacagccaggtgaatccgctcacactgaccgccgctgtccttatgctggtggcccactatgctattatcggacctggcctccaagccaaggcgacacgcgaggcccagaagagaaccgctgccgggatcatgaaaaaccccacggttgatggaattgtggctatcgacctggatcccgtcgtgtacgacgccaagtttgaaaaacagctgggccagattatgctccttatcctgtgtacatctcaaattctgctcatgcggaccacatgggccctgtgcgagagcatcacccttgcgaccgggcctctgacaacgctctgggagggatccccgggcaagttctggaataccacaatcgctgtgtctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgaatttaacatctacaagagaagcggcattatggaggttgaccggtccgaagccaaagaggggctgaagagaggagagaccacgcgccacgcggtctctcggggcacagccaaacttagatggttcgtggaacgcaatctggtgaagcccgaggggaaggtcatcgatctcggatgtggcagagggggatggagctattactgcgctggcctgaaaaaggttaccgaagtgaaaggctataccaaagggggacctggccatgaggaacccattcctatggccacatacgggtggaacctggtgaaactccactccggaaaggacgtcttctttacaccccctgagaaatgtgatacacttctgtgcgacatcggcgagtctagcccgaatcccacgattgaagaggggagaaccctgcgcgtgctcaagatggttgaaccttggctgcggggaaaccaattctgtatcaagatccttaatccctacatgccttccgtggtcgagacactggagcagatgcagagaaaacatggcggcatgctcgtgcgcaaccccctgagcagaaattctacccacgaaatgtattgggtttcctgcgggacaggaaacattgtgagcgctgtcaatatgacctctagaatgctgctcaaccgctttacgatggcccaccggaagccgacctacgagaaagatgtggacctgggcgcggggacaagacatgtggccgtcgaacctgaggttgctaaccttgatatcattggacagcgcatcgaaaatattaagcacgagcataaatccacctggcactatgacgaggataacccctacaagacatgggcctatcatggcagctacgaagtgaagccctctgggtccgctagctccatggtgaatggagtcgtgaaactgctcaccaagccttgggacgttatccccatggtgacacaaatcgccatgaccgatacgacacctttcggccagcagagagtctttaaagagaaggtggacacccggaccccgaaagctaagcgcggcacagttcaaattatggaagtgacggccagatggctgtgggggttccttagccggaacaagaaacccagaatctgtacccgggaggaatttacacgcaaggtcagatctaatgcggccattggagctgtgttcgttgacgagaaccagtggaatagcgccaaagaggctgtggaagatgagcggttttgggacctggtcaagaaagaacgcgagctccacaagcagggcaagtgcgcgacctgcgtgtataacatgatggggaaaagagaaaagaaactgggagagttcggcaaggccaaagggtcccgggcgatctggtacatgtggctgggcgctcgctttctcgagttcgaagccctgggatttatgaatgaggatcactggttctctagagaaaacagcctttccggcgtcgagggggagggactgcataagctcggctacattctgcgggacatctctaaaatccctgggggaaatatgtatgccgatgacacagctggctgggatacccgcattacagaagacgatcttcagaacgaggccaagatcaccgacattatggaacccgagcacgctctgctcgccacgagcatcttcaagctgacctaccaaaataaagtggttagagtgcagcggcctgcgaagaacgggacagtcatggatgtgatttcccgcagagaccagcggggctctggacaggtgggcacctatgggctgaatacatttaccaacatggaagcccaactcatccgccagatggagagcgagggaatcttcctgccctccgaacttgagacgccgaacctggctgaaagagttctcgattggctggagaaatacggcgtggaacggcttaagagaatggccattagcggggacgactgtgtcgtgaaacctatcgatgaccgctttgctacagccctgaccgcgctcaatgatatgggaaaggttcggaaggacattccccagtgggagccttctaaaggctggaacgattggcagcaagtgcccttctgctcccatcactttcaccagctgatcatgaaggacgggagagagattgtcgtgccttgtcgcaatcaggatgaactggtcggccgggccagagtgagccagggagctggctggtctctccgcgagacagcctgcctggggaaatcctatgctcaaatgtggcagcttatgtacttccatcggagagacctgcgcctcgccgctaacgccatctgtagcgcggttcccgtggattgggtcccgacctcccggacgacctggtctattcacgcccatcaccagtggatgacaaccgaagacatgctgagcgtgtggaatagagtttggatcgaggaaaacccttggatggaggataagacacatgtgtccagctggggagacgtcccctatcttggcaaacgcgaggaccaatggtgcgggtctctgatcggactcaccgctcgggccacatgggcctccaatattcaggtggctatcaaccaggtgagacggctgattggcaatgaaaactacctggattacatgaccagcatgaagagatttaagaatgagggggaccccgaaggcgccctctggtga

SEQ ID NO: 19269 - RNA, 9879 nt, synthetic construct
  misc_feature 1..9879: note = derived and/or modified CDS sequence (opt5) from DENV-1__EU482797__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttactattgcgctggcctgaaaaaggttaccgaagtgaaaggctacaccaaagggggacccggccacgaggaacctatccccatggccacatacgggtggaacctcgtgaaactgcatagcggaaaggacgtcttctttattcctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttatatgccctctgtggtcgagaccctggagcaaatgcagcggaaacacggcggcatgcttgtgagaaaccctctgtcccgcaatagcacacatgaaatgtactgggtttcttgcgggaccggaaacatcgtgtccgcggtcaatatgacaagccggatgctcctgaacagatttaccatggcccaccgcaagcccacgtatgagcgggatgtggacctgggcgctgggaccagacacgtggccgtcgaaccggaggttgctaacctcgatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacatgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacaccgccggctgggatacacgcatcaccgaagacgatctccagaacgaggcgaagatcacagacattatggaacctgagcacgccctgcttgctaagtctatcttcaaactgacctatcagaataaggtcgtgagagttcaacggcccgccaaaaacgggacggtgatggatgtcattagccgcagagaccagcggggctccggacaggtgggcacctacgggctcaatacatttaccaacatggaagctcagctgatccgccaaatggagagcgagggaattttctctccttccgaactggagacacccaacctcgccggcagagtgctggattggcttgaaaagcatggggttgagcggctgaaaagaatggcgatcagcggagacgactgtgtggtcaagccgatcgatgaccgctttgccaccgctctcacggccctgaatgatatgggcaaggtgcggaaagacgttcctcagtgggaaccctctaaggggtggaacgattggcaacaggtgcctttctgctcccaccactttcatcaacttattatgaaagacggcagagagatcgtcgtgccctgtcgcaatcaggatgagctggtcggacgggctagagtgagccagggcgccgggtggtccctccgcgaaacagcttgcctgggaaagtcttatgcccagatgtggcaactgatgtacttccaccggagagacctccgcctggcggccaacgctatttgtagcgccgttcctgtggattgggtccccacctcccggacaacctggagcatccatgcccaccatcagtggatgacgaccgaggacatgctttctgtgtggaatagagtttggattgaagagaacccgtggatggaagataaaacacacatctccagctggggcgacgtgccttatctggggaagcgcgaggaccagtggtgcggatctctcattggcctgaccgctcgggccacatgggcgaccaatatccaagtcgctatcaaccaggtgagacggcttattgggaatgagaactacctggattacatgacaagcatgaagagatttaaaaatgaatccgaccccgagggcgccctctggtga

SEQ ID NO: 19270 - RNA, 9879 nt, synthetic construct
  misc_feature 1..9879: note = derived and/or modified CDS sequence (opt5) from DENV-1__EU482799__SS-prME
  source 1..9879: mol_type = other RNA
agcgtgaccatgctgctcatgctgatgcccacagctcttgctttccacctgacgaccagaggcggggaacctcatatgatcgtgtccaagcaggaacgggggaaatctctcctgtttaagacaagcgccggcgttaacatgtgcacccttattgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagaggccacactggtggaagaacaagacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgctacgattacaccccaagcccctaccaccgagatccagctcacagactacggcgctctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagcccacgctaagaagcaggaagtggttgtgctgggaagccaagagggcgcgatgcacacggccctgaccggggctacagaaattcagacctccggaacaaccacgatctttgccggccatctcaaatgcagactgaagatggataaacttacactgaaggggatgagctatgtcatgtgtaccggctctttcaaactcgagaaggaagtggccgagacccagcacggaacagttctggtgcagattaagtacgagggcaccgacgctccgtgcaaaatccctttctccacacaagatgaaaagggggtcacgcagaacggacggctgatcaccgccaatcccattgtgacagacaaagagaagcctgtgaacatcgaagcggagccgccctttggcgagagctatattatcattggggctggagagaagacccttaagctctcttggttcaagaaaggcagctccatcgggaagatgtttgaggccacagccagaggcgctcgccggatggccatcctgggagataccgcttgggacttcggctctattgggggagtttttacgagcgtcggcaaactggtgcatcagatcttcgggaccgcctacggagtgctcttttccggcgtcagctggacaatgaagattgggatcggcgtgctgcttacctggctgggactcaattctagatccacaagcctgtctatgacctgtattgcggttggcctggtgacactttacctcggggtcatggtgcaggccgattccggatgcgttatcaactggaaaggccgcgaactgaagtgtgggagcggaattttcgtgaccaatgagatccacacgtggacagaacaatataagtttcaggctgactcccctaaacggctgtctgccgctatcggcaaggcctgggaggagggggtctgcggcattagaagcgcgacccgcctcgaaaacatcatgtggaaacagatttccaacgagctgaatcatatccttctggaaaacgacatgaagttcaccgtggttgtgggagatgtcgccggcattctcgctcaggggaaaaagatgatccggccgcaacccatggagtacaaatattcttggaaaagctggggaaaggccaagatcattggcgctgacgtgcagaatacaacctttatcattgatgggcctaacacgcccgaatgtcctgacgatcagagagcctggaatatctgggaggtggaggactacggattcggcatttttacaaccaacatctggctgaagctgcgcgattcctatacacaggtctgcgaccaccggcttatgagcgccgctatcaaagattctaaggcggttcacgccgacatgggctactggattgaatccgagaaaaatgaaacctggaagctcgctagagccagcttcatcgaggtgaagacatgtatttggcccaaatctcataccctgtggtccaacggggtgctggaaagcgagatgatcattccgaagatctatggaggccctatctctcaacacaattaccgccccgggtacttcacgcagaccgccggaccttggcatctcggcaaactggagcttgattttgacctgtgcgaagggacaaccgtcgtggttgatgagcactgcggaaaccggggccccagcctcagaacaaccacggtgacaggcaagattatccacgaatggtgttgccggtcctgtaccctgcctcccctgcgcttcagaggggaggacggatgctggtatggcatggagattcggccggtcaaagaaaaggaggaaaatcttgtcaagagcatggtttctgctgggtccggagaggtggacagcttttccctcggcctgctgtgtatctctattatgatcgaagaggtcatgagaagccgctggtcccggaaaatgctcatgacagggaccctggccgtgttctttcttctgattatgggacagctcacctggaacgatctgatcagactgtgcatcatggttggcgcgaatgcttctgaccgcatgggcatggggacaacgtaccttgccctgatggccaccttcaagatgagacctatgtttgctgtgggactcctgttccggcgcctcacaagcagagaggtcctgcttctgaccattggcctctccctggtggcctctgtggaactgcccaacagccttgaggaactgggggatggactcgcgatgggcatcatgattctgaaactcctgacagactttcaatcccatcagctttgggctaccctgctcagcctgacgttcatcaagacaaccttttctctgcactatgcctggaaaaccatggccatggtcctttccattgttagcctgttccccctctgtctgtctacaacctcccagaagacaacgtggctccctgtgctgcttgggagcctgggatgcaagccgctgaccatgtttctcatcgctgagaataaaatctggggccggcgctcttggcccctgaacgaaggcattatggccgtggggatcgtctccattcttctgagctccctcctgaagaacgatgtgcctctcgctggacccctgatcgccggcgggatgcttattgcgtgttacgttatcagcggatctagcgccgacctgtccctggagaaagctgccgaggtgtcttgggaagaggaagctgagcatagcggcgcctcccacaatatcctcgtcgaagtgcaggatgacgggacaatgaagattaaagatgaggagagagacgataccctgacaatccttctgaaggccaccctcctggctgtttctggagtgtatcctctcagcattcccgcgacgctgttcgtctggtacttctggcagaaaaagaagcagcggtccggcgtgctttgggacaccccttctcccccggaagtcgagcgcgccgtgctggatgacggcatctatagaattatgcagcgggggctgctcggacgcagccaggttggcgtgggggtctttcaagaaaacgtgttccatacaatgtggcacgttaccagaggagctgtgctgatgtaccagggcaaacggcttgagccttcctgggccagcgtcaagaaagacctgatctcttacgggggaggctggagactccagggctcctggaatacaggggaggaagtccaggtgattgccgttgagcccggaaagaaccctaaaaatgtccaaaccgctcccggcacatttaagacgccggaaggggaggtgggagccatcgcgctggatttcaagcctggcaccagcgggtctcccatcgtgaaccgcgaaggaaaaattgtcggcctctatggcaatggggtggttacaacctccggaacctacgtgagcgctatcgcccaggccaaggcttcccaggagggccctctgcccgagattgaagacgaggtctttcggaaaagaaaccttacaatcatggatctgcaccccgggtctggaaagacgcgccggtatctgcctgccattgtgagagaagcgatcaaacgcaagctccggaccctgatccttgctccgacaagagttgtggccagcgagatggccgaagctctgaagggcatgcccattcgctaccaaaccacagccgtcaaatccgagcataccgggaaggagatcgtggacctcatgtgccacgctacgttcacaatgcggctgctgagccctgttagagtgcccaattataacatgattatcatggatgaagcccattttaccgacccttcttccattgcggcccggggctacatcagcacccgcgtcggaatgggcgaggctgccgctatcttcatgacagccacaccccctgggtctgtggaagcctttccgcagagcaatgctgtgattcaggatgaggaaagagacatccccgagcggtcctggaactctggatatgagtggattaccgatttccctggcaaaaccgtctggtttgttcccagcatcaagtccgggaatgacattgcgaactgtctccgcaaaaatggaaagagagtgatccagctttctcggaagacgttcgatacagaataccagaaaaccaagaacaacgactgggactacgtggtcacaaccgatattagcgagatgggcgccaatttcagagctgaccgcgtgatcgatcctcggagatgcctgaaacccgttatcctgaaggacgggccggaacgcgtgattctcgccggccctatgcccgtcacggtggcctccgctgcccagcggagaggacgcatcggccggaaccacaataaagagggggatcagtatatttacatgggacagcccctgaacaatgacgaggatcatgcgcactggaccgaagctaagatgcttctggacaacatcaatacacctgagggcattatccccgccctctttgaacctgagagagaaaagagcgccgctatcgatggggagtatcgcctgagaggagaggcccggaaaaccttcgttgaactgatgcgcagaggcgacctcccggtgtggctttcttacaaggtcgcgtccgaggggtttcaatatagcgatcggcgctggtgcttcgacggcgaaagaaacaatcaggtgctggaggaaaacatggatgtcgagatttggacaaaagagggagaacggaagaaactgagaccccgctggctcgacgcccggacctactccgaccctctggctcttagagagtttaaggagttcgccgctggccgccggtctgtgagcggggatctgatcctcgagattggaaaactgccccagcacctgacacagagagcccaaaatgctctcgacaaccttgttatgctgcataattccgaacagggcgggcgggcctatcgccacgcgatggaggagctgcctgataccatcgaaacgctcatgctgcttgccctgattgctgtgctcacaggaggcgtgaccctgtttttcctgtctggcagagggctcggaaagaccagcatcggccttctgtgtgtcatggcctccagcgttctgctctggatggcttctgtggagccccattggatcgccgcctccattatcctggaatttttccttatggtgctgctcattccggagcctgaccggcagcgcacaccccaggataaccaactggcttacgtcgtgatcgggctgctctttatgattcttaccgttgcggccaatgagatgggactgctggaaacaacgaagaaagacctcggcatcgggcacgtggctgtcgagaaccaccatcacgccgccatgctggatgtggaccttcatcctgctagcgcctggaccctgtacgcggtcgccacaaccattatcacacccatgatgagacacaccatcgaaaacacgaccgctaatatttctctcacagccatcgctaaccaggccgcgattctgatgggactggataagggctggcctatctccaaaatggacattggcgtgcccctccttgccctggggtgctatagccaggttaatccgctgaccctcacagctgccgtgctgatgcttgtcgctcattacgccatcatcggacctggcctgcaagctaaggccacccgggaggcgcagaaacgcacggccgctgggattatgaagaaccccacagtggatggaatcgttgccattgacctcgatcccgtggtctatgacgctaagttcgaaaaacagctgggccagatcatgctgctcattctttgtacctctcaaatcctgctgatgagaacaacctgggccctctgcgagagcatcaccctggccacagggcctcttacgaccctgtgggagggatccccgggcaagttttggaatacaaccattgcggtgtctatggctaacatcttccggggcagctacctcgccggggctggactggccttctccctgatgaaaagcctcggcgggggacgcagaggcacaggggcccagggagaaacccttggcgagaagtggaaacggcagctgaatcagctgtccaagtctgaatttaacacgtataagagaagcggcattatggaggtggaccgctccgaagctaaagaggggctcaagcggggagagacaaccaaacacgccgtttctagaggcaccgcgaagctgcgctggttcgtcgaacggaatcttgtgaaacccgaggggaaggtgatcgatctgggatgtggcagagggggatggagctactattgcgccggcctcaagaaagtcacagaagttaagggctacaccaaagggggacctggccacgaggaacccattcctatggctacatacgggtggaacctggtgaagctgcattccggaaaagacgtgtttttcattccccctgagaagtgtgatacgctcctttgcgacattggcgagtctagcccgaatcccaccatcgaagaggggcgcacactgcgggtcctgaaaatggtggaaccttggctcagaggaaaccaattttgtatcaagattctgaatccctatatgccttccgttgtggagacccttgagcagatgcagcgcaagcacggcggcatgctggtccggaaccccctcagcagaaattctacacatgaaatgtactgggtgtcctgcgggaccggaaacatcgttagcgccgtgaatatgacgtctcgcatgctgctgaaccggttcaccatggctcacagaaaaccgacatatgagcgcgatgtcgacctcggcgccgggaccagacacgtggcggtggaacctgaggtcgccaacctggatattatcggacagcggattgaaaatatcaagcatgagcacaaatccacatggcattacgacgaggataacccctataagacctgggcttaccacggcagctatgaagttaaaccctctgggtccgccagctccatggtgaatggagtggtcaaacttctgacaaagccttgggacgtgatccccatggttacccaaattgctatgacggatacaaccccttttggccagcagcgcgtgttcaaagagaaggtcgacaccagaacaccgaaagccaagcggggcacggctcaaatcatggaagtgaccgccaaatggctctgggggtttctgagcagaaacaagaagccccggatttgtacacgcgaggagttcaccagaaaagttcggtctaatgcggccatcggagctgtgtttgtcgacgagaaccagtggaatagcgccaaggaggctgtggaagatgagcgcttctgggaccttgttcatagagaacgggagctgcacaaacagggcaagtgcgccacatgcgtgtacaacatgatggggaaacgcgaaaagaagctcggagagtttggcaaagccaaggggtccagagcgatttggtacatgtggctgggcgctcggttcctggagttcgaagccctcggatttatgaatgaggatcactggttctctcgcgaaaacagcctgtccggcgtcgagggggagggacttcataaactgggctatatcctcagagacatctctaagattcctgggggaaatatgtacgccgatgacaccgctggctgggatacacggatcaccgaagacgatctgcagaacgaggcccgcattacggacatcatggaacccgagcacgcccttctggccaaaagcatttttaagctcacctatcaaaataaagtggtcagagtgcagcggcctgcgaagaacgggacagttatggatgtgatctcccgcagagaccagcggggctctggacaggtcggcacctacgggctgaatacattcaccaacatggaagcccaactgatcagacagatggagagcgagggaatcttttcccccagcgaactcgagacgccgaacctggctgaacgcgtgcttgattggctggagaagtatggcgtggaacggctcaaaagaatggccatctctggggacgactgtgttgtgaagcctattgatgaccgcttcgctacagccctgaccgcgcttaatgatatgggaaaagtccggaaggacatcccccagtgggagccttccaaaggctggaacgattggcagcaagtgcccttttgcagccatcacttccaccagctgattatgaaggacgggagagagatcgttgtgccttgtcgcaatcaggatgaactcgtcggccgggccagagtgtctcagggagctggctggtccctgcgcgagacagcctgcctgggaaagagctacgctcaaatgtggcagctcatgtattttcatcggagagacctgcgccttgccgctaacgccatttgttccgcggtccccgtggattggatcccgacctctcggacgacctggagcatccacgcccatcaccagtggatgacaaccgaagacatgctgtccgtttggaatagagtgtggattgaggaaaacccttggatggaggataaaacacatatcagctcttggggagacgtcccctacctcggcaagcgggaggaccaatggtgcgggtccctgattggacttaccgctagagccacatgggccaccaatatccaggtggctattaaccaggttcgccggctgatcggcaatgaaaactacctcgattatatgacgagcatgaaaagattcaagaatgagtctgaccccgaaggggccctgtggtga

SEQ ID NO: 19271 - RNA, 9879 nt, synthetic construct
  misc_feature 1..9879: note = derived and/or modified CDS sequence (opt5) from DENV-1__EU482800__SS-prME
  source 1..9879: mol_type = other RNA
agcgtgaccatgctgctgatgctgatgcccacagcccttgctttccacctgacgaccagaggcggggagcctcatatgatcgtctccaagcaagaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggccagcacagacgggacaagcgctctgtcgccctcgctcctcatgtggggctgggactggagacaagaaccgagacgtggatgagctccgaaggcgcctggaaacagattcagcgggttgagacatgggctctccgccaccccggctttaccgtgatcgccctgttccttgcgcatgccattgggacatctatcacccaaaagggaatcatttttatcctgctcatgctggtcacccctagcatggctatgagatgcgtgggcattgggtcccgggatttcgttgaaggacttagcggcgccacatgggtggacgtcgtgctggagcacgggtcttgtgtgacgaccatggctaaggataaacccacactcgacatcgagctgctgaagaccgaagtcacaaaccctgccgttctccgcaaactgtgcattgaggcgaagatctccaataccacgattgatagcagatgtccgacacagggagaagccacccttgtggaggaacaggacgctaactttgtgtgccggcgcaccttcgtcgatagaggctggggcaatgggtgtggactgtttggcaaagggtctctcatcacatgcgccaagttcaagtgcgtgaccaaactggagggaaagacagttcagtacgagaaccttaaatattccgtgatcgtcacggtgcacaccggcgaccaacatcaggttgggaatgaaagcacagagcacggaaccacagctaccattacgccccaggccccttctaccgaaatccagctgacagactacggcgccctcaccctggattgtagcccccggacaggcctggactttaacgagatggtgctcctgaccatgaaggagaagtcctggcttgtccataagcaatggttcctggatctccctctgccctggacgtccggggcttctacaagccaggagacctggaatcgcaaagaccttctggtgacatttaagaccgcgcacgccaagaaacaggaggtcgtggttctcggatcccaagaaggcgctatgcacaccgccctgacaggggccacggagattcagaccagcggaacaaccacaatcttcgctggccatctgaagtgcagactcaaaatggataagctgacccttaaagggatgtcttatgtgatgtgtacgggctccttcaagctggaaaaggaggtcgccgaaacacagcacggaaccgtgctcgttcagattaaatacgagggcaccgacgcgccgtgcaagatcccttttagcacacaagatgagaaaggggtgacccagaacggacggctgatcacagctaatcccattgtcacggacaaggaaaaacctgtgaacatcgaggccgaaccgcccttcggcgagtcttatattgtgatcggggccggagagaaggctctgaaacttagctggtttaaaaagggctcctctattgggaaaatgttcgaagccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgagctcaagtgtgggtccggaatctttgtgacaaatgaagtccacacctggacagagcaatataaattccaggccgactctcctaagcggctgagcgcggccattggcaaggcttgggaagagggggtgtgcggcatcagatccgttacccgcctggagaacatcatgtggaagcagatttctaacgaactcaatcatatcctgcttgagaacgacatgaaatttacggtggtcgtgggagatgtggccggcattctggctcaggggaagaaaatgatccggccgcaacccatggaatacaagtatagctggaagtcctggggaaaagccaagattatcggcgccgacgtccagaatacaaccttcatcattgatgggcctaacacccccgagtgtcctgacgatcagagagcttggaatatctgggaagttgaggactacggatttggcattttcacaaccaacatctggctcaaactgcgcgatagctatacacaggtgtgcgaccaccggctgatgtctgcggccattaaggattccaaagctgtgcacgccgacatgggctactggatcgagagcgaaaagaatgagacgtggaaacttgccagagcttctttcatcgaagtcaaaacctgtatttggcccaagtcccatacactctggagcaacggggtgctggagtctgaaatgatcattccgaaaatctatggaggccctattagccaacacaattaccgccccgggtactttacccagacagccggaccttggcatctgggcaagctcgagctggatttcgacctttgcgaggggaccacggttgtggtcgatgaacactgcggaaaccggggcccctccctgagaaccacaaccgtgacaggcaaaatcatccacgagtggtgttgccggagctgtaccctccctcccctgcgctttaagggggaagacggatgctggtatggcatggagattagaccggttaaggagaaagaagagaatctggtgaagtctatggtctccgcggggagcggagaagtggactccttctctcttggcctcctgtgtatcagcattatgatcgaggaagttatgcggtccagatggtctcgcaaaatgctgatgacggggacactcgctgtgtttttcctgcttattatgggacagctgacctggaacgatctcatccggctgtgcattatggtcggcgccaatgccagcgacagaatgggcatggggacaacctacctggctcttatggccacctttaagatgcgccctatgttcgcggtgggactgctctttagacggctgacatcccgcgaggtgctcctgcttacgatcggcctgtctctcgtcgctagcgttgagctgcccaactccctggaggaacttggggatggactggccatgggcatcatgattctcaaactgctcaccgacttccaaagccatcagctgtgggccacacttctgtctctcacctttatcaagacaaccttctccctgcactatgcttggaagacgatggccatggtgctgagcattgtgtctctttttcccctgtgtctctccacaaccagccagaaaaccacatggctgcctgtcctcctggggtctcttggatgcaagccgctgaccatgttcctgatcgctgaaaataaaatttggggcagaaagtcctggcccctcaacgagggcatcatggccgtggggatcgttagcattctgctttccagcctgctcaaaaacgatgtgcctctggcgggacccctcatcgccggcgggatgctgattgcttgttacgtcatctctggaagctccgccgacctttctctggaaaaggctgccgaggtgagctgggaggaagaggccgaacattccggcgcttctcacaatattctggttgaggtgcaggatgacgggacaatgaaaatcaaggatgaagaacgggacgatacgctcaccatcctgcttaaggcgacactgctcgccgtcagcggagtgtatcctctgtccattcccgctaccctcttcgtctggtacttttggcagaagaagaaacagcgctctggcgtgctgtgggacacacctagccctcccgaggttgaaagagccgtgcttgatgacggcatctatcggattatgcagcgcgggctgctgggaagatcccaggtcggcgtgggggttttccaagagaacgtgtttcataccatgtggcacgtcacgcggggagccgtgctcatgtaccagggcaagcgcctggaacccagctgggcttctgtgaaaaaggaccttatctcctacgggggaggctggagactgcagggcagctggaataccggggaggaggttcaggtcattgccgtggaacccggaaagaaccctaaaaatgtgcaaacagcgcccggcaccttcaagacatctgagggggaagtcggagctatcgccctcgattttaaaccgggcacctccgggagccctattgtgaaccgggagggaaagatcgttggcctgtatggcaatggggtggtcacaacgtccggaacctacgtgtctgccatcgctcaggccaaagcgagccaggaaggccccctccctgagattgaggacgaagttttcagaaagcgcaacctgacaatcatggatcttcaccccgggtccggaaagacccggagatatctgcccgctattgtgcgcgaggccatcaaacggaagctgagaaccctcattctggcccctacacgcgtcgtggctagcgaaatggccgaggctcttaaaggcatgccgatccggtaccaaacgaccgccgttaagtctgaacatacagggaaagagatcgtggacctgatgtgccacgcgacctttacaatgagactcctgtcccccgtccgcgtgcctaattataacatgattatcatggatgaggcccatttcaccgaccccagctctattgctgcccggggctacatcagcacgagagtgggaatgggcgaagctgccgccatttttatgacagctacccctcccgggtccgtcgaggcgttccctcagtctaatgccgttatccaggatgaagaacgggacatcccggaacgcagctggaactccggatatgagtggattaccgattttcccggcaagacagtgtggttcgtgccttctatcaagagcgggaatgacattgctaactgtctgcgcaagaatggaaagcgggtcatccagctctcccgcaaaaccttcgatacagagtaccaaaagaccaaaaacaacgactgggactacgtggttacgacagatattagcgaaatgggcgccaattttagagccgaccgggtgatcgatcccagacgctgccttaagcctgtcattctgaaggacgggcccgagcgggtgatcctggctggcccgatgcctgttaccgtggcctctgcggctcagagacgcggacggatcggcagaaaccacaataaagaaggggatcagtatatttacatgggacagcccctcaacaatgacgaggatcatgcccactggacagaggccaagatgctgcttgacaacatcaatacccccgaaggcattatccctgctctgttcgagcccgaacgcgagaaatccgccgcgattgatggggaatatcggctcagaggagaggcccgcaagacgtttgtcgagctgatgagacggggcgacctgcctgtgtggctcagctacaaagtcgcttccgaagggttccaatattctgatcgcagatggtgctttgacggcgagcggaacaatcaggtgcttgaagagaacatggatgttgaaatctggaccaaggagggagagcgcaaaaagctgagaccgcggtggctggacgccagaacatacagcgaccccctcgctctgcgcgagttcaaggagtttgccgctggccggagatccgtgtctggggatcttatcctggaaattggaaaactccctcagcacctgacccagcgcgcccaaaatgcgctggacaacctcgtgatgcttcataatagcgagcagggcgggcgggcctatagacacgctatggaagaactgcccgatacaatcgagaccctgatgctcctggcccttattgctgtcctgacaggaggcgttaccctcttctttctgtccggccgggggctgggaaagacgagcatcggcctcctttgtgtgatggcctcttccgtgctgctgtggatggccagcgtcgaacctcattggattgctgcgtctatcatcctcgagttctttctgatggtgcttctgattcccgaaccggaccgccagagaacacctcaggataaccaactcgcctacgttgtgatcgggctgctgttcatgattctcaccgtcgctgccaatgagatgggacttctggagaccaccaaaaaggacctgggcatcgggcacgtggccgtcgaaaaccaccatcacgctgccatgctcgatgtggacctgcatcccgcgtccgcctggaccctttacgctgttgccacaacgattatcacccctatgatgcggcacacaattgagaacaccacagctaatatcagcctgaccgccatcgcgaaccaggccgctattctcatgggactggataaaggctggcccatctctaagatggacattggcgtgcctctgctcgcccttgggtgctatagccaggtcaatcccctgacgctgaccgctgccgtgctcatgctggttgctcattacgccatcattggaccgggccttcaagcgaaggccacacgcgaagctcagaaaagaaccgccgctgggatcatgaagaaccctacagtggatggaatcgtcgccattgacctggatcccgtggtgtatgacgccaaatttgagaagcagctcggccagatcatgctgctgattctctgtacctcccaaatccttctgatgcggacgacatgggcgctgtgcgaatctattaccctcgctacagggcccctgaccaccctttgggagggaagccctggcaaattctggaatacaacgatcgccgtttccatggctaacatcttccgcggcagctacctggccggggccggactcgctttttccctgatgaagtctctgggcgggggaagacggggcaccggggcccagggagagacactcggcgaaaagtggaaacgccagcttaatcagctgagcaagtccgagttcaacacctataaaagatctggcattatggaagtcgaccggagcgaggcgaaggaagggctgaaaagaggagagacaaccaagcacgccgtgtcccgcggcacggctaagctccggtggtttgtggagagaaatctggtcaaaccggaagggaaggttatcgatcttggatgtggccgcgggggatggtcttactattgcgccggcctgaaaaaggtgacagaggtgaaaggctacaccaaagggggacccggccacgaggaacctattcccatggctacctacgggtggaacctcgtcaaactgcatagcggaaaggacgtgttctttatccctcccgaaaagtgtgatacactgctctgcgacattggcgagtccagccctaatccgaccatcgaggaagggcggacacttagagttctgaaaatggtggagccctggctgcgcggaaaccaattctgtattaagatcctcaatccttatatgccctctgtcgtggaaacgctggagcagatgcagcggaaacacggcggcatgcttgttagaaaccctctgtcccgcaatagcacccatgagatgtactgggtgtcttgcgggacaggaaacatcgtctccgccgtgaatatgaccagccggatgctcctgaacagatttacaatggtgcaccgcaagcccacctatgaacgggatgtcgacctgggcgcggggacgagacacgttgccgtggagccggaagtggctaacctcgatattatcggacagcgcattgagaatatcaaacatgaacacaagtctacctggcattacgacgaggataacccttataagacatgggcctaccacggctcctatgaggtcaaacccagcgggtccgctagctctatggtgaatggagttgtgaagctgcttaccaaaccctgggacgtcattcctatggtgacacaaatcgccatgaccgatacaacccccttcggccagcagagagtttttaaggaaaaagtggacacgcggacacctaaggctaagcgcggcaccgcccaaatcatggaggtcaccgcgaaatggctgtgggggttcctcagcagaaacaagaaaccgcggatttgtacaagagaagagtttacgcggaaggtgcgctccaatgccgctatcggagccgttttcgtggacgaaaaccagtggaactctgctaaagaggccgtcgaggatgaaagattttgggacctggtgcatcgggagcgcgaacttcacaagcagggcaagtgcgccacatgcgtctacaacatgatggggaaaagagagaagaaactgggagagttcggcaaggcgaaagggagccgggctatttggtacatgtggctcggcgcccgcttcctggagtttgaggccctgggattcatgaatgaagatcactggttttccagagagaactctctcagcggcgtggaaggggagggactgcataaacttggctatatcctgcgggacatttccaaaatccccgggggaaatatgtacgctgatgacacagccggctgggatacccgcatcacagaggacgatctccagaacgaagctaagattaccgacatcatggagcctgaacacgccctgcttgcgaagtctattttcaaactgacatatcaaaataaggttgtgagagtccagcggcccgccaaaaacgggaccgtgatggatgtgatcagccgcagagaccagcggggctccggacaggttggcacgtacgggctcaatacctttacaaacatggaggctcaactgattcgccagatggaaagcgagggaatcttctctccttccgagctggaaacccccaacctcgccggcagagtgtttgattggctggagaagcatggggtcgaacggcttaaaagaatggctatcagcggagacgactgtgtggttaagccgattgatgaccgcttcgccacagcgctgaccgccctcaatgatatgggcaaggtgcggaaagacatccctcagtgggagccctctaaggggtggaacgattggcagcaagtccctttttgctcccaccacttccatcagctgattatgaaagacggcagagaaatcgtggtcccctgtcgcaatcaggatgagcttgtgggacgggctagagttagccagggcgccgggtggtccctgcgcgagacggcttgcctcggaaagtcttatgcccaaatgtggcagctgatgtactttcaccggagagacctgcgcctcgctgccaacgcgatttgtagcgccgtgcctgtcgattgggtgcccacatcccggaccacatggagcatccatgctcaccatcagtggatgaccacggaagacatgctgtctgtttggaatagagtgtggattgaggaaaacccgtggatggaggataaaacccacatctccagctggggcgacgtcccttatcttgggaagcgcgaagaccaatggtgcggatctctgatcggcctcacagcccgggccacctgggctacaaatattcaggtggccatcaaccaggtgagacggctgattgggaatgagaactaccttgattacatgaccagcatgaagagattcaaaaatgagtccgaccccgaaggcgcgctgtggtga

SEQ ID NO: 19272 - RNA, 9879 nt, synthetic construct
  misc_feature 1..9879: note = derived and/or modified CDS sequence (opt5) from DENV-1__EU482801__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgctatagccaggtgaatccgctgacactcaccgctgccgtcctgatgcttgtggctcattacgccatcattggccctgggctgcaagcgaaggccacacgggaagctcagaaacgcaccgccgctggaatcatgaagaaccccacggttgatggcatcgtggccattgacctcgatcccgtcgtgtatgacgccaagttcgagaaacagctggggcagatcatgctgctcattctttgtacatctcaaatcctgctgatgagaaccacatgggcgctctgcgaaagcattaccctggctaccggacctcttacaacgctgtgggagggctccccgggcaagttttggaataccacaatcgccgtgtctatggctaacatcttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcatcgatctgggctgtgggagaggaggctggagctactattgcgccggcctcaagaaagttaccgaggtgaaggggtacacaaaaggaggccctgggcacgaggagcccattcctatggctacctacggatggaacctggtgaagctgcattccggcaaagacgtctttttcattccccctgaaaagtgtgatacactcctttgcgacattggggagtctagcccgaatcccacgatcgaggaaggacgcaccctgcgggtgctgaaaatggttgagccttggctcagaggcaaccaattttgtattaagatcctgaatccctatatgccttccgtggtcgaaacacttgagcagatgcagcgcaagcacggcgggatgctggtgcggaaccccctcagcagaaattctacccatgagatgtactgggtttcctgcggaacaggcaacatcgtgagcgccgtcaatatgacctctcgcatgctgctgaaccggttcacgatggcgcacagaaaaccgacctatgaacgcgatgtggacctcggggccggaacaagacacgtggctgtcgagcctgaagttgccaacctggatattatcggccagcggattgagaatatcaagcatgaacacaaatccacctggcattacgacgaggataacccctataagacatgggcttaccacgggagctatgaggtgaaaccctctggatccgccagctccatggtgaatggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgagcagaaacaagaagccccggatttgtacccgcgaagagttcacaagaaaagtgcggtctaatgctgccatcggcgctgtctttgtggacgaaaaccagtggaatagcgccaaggaggccgttgaggatgaacgcttctgggaccttgtgcatagagagcgggaactgcacaaacaggggaagtgcgcgacctgcgtctacaacatgatgggaaaacgcgagaagaagctcggcgaatttgggaaagctaagggctccagagccatttggtacatgtggctgggagcccggttcctggagttcgaggctctcggctttatgaatgaagatcactggttctctcgcgagaacagcctgtccggggtggaaggagagggccttcataaactggggtatatcctcagagacatttctaatatccctggaggcaacatgtacgccgatgacacagctgggtgggatacccggatcacagaggacgatctgcagaatgaagcccgcattaccgacatcatggagcccgaacacgcgcttctggccaagagcatttttaaactcacgtatcaaaacaaggtcgtgagagttcagcggcctgctaaaaatggcaccgtgatggatgtcatctcccgcagagaccagcggggatctggccaggtggggacatacggactgaacaccttcacaaacatggaggcccaactgattagacagatggaaagcgagggcatcttttcccccagcgagctcgaaaccccgaatctggctgagcgcgtgcttgattggctggaaaagtatggggttgagcggctcaagagaatggccatctctggagacgactgtgtggtcaaacctattgatgaccgcttcgcgacggccctgacagctcttaacgatatgggcaaggtgcggaaagacatcccccagtgggaaccttccaaggggtggaatgattggcagcaagttcccttttgcagccatcacttccaccagctgattatgaaagacggcagagagatcgtggtcccttgtcgcaaccaggatgagctcgtgggacgggccagagtctctcagggcgctgggtggtccctgcgcgaaaccgcctgcctgggaaagagctacgctcaaatgtggcagctcatgtattttcatcggagagacctgcgccttgccgcgaatgccatttgttccgctgtgcccgttgattggatcccgacatctcggaccacgtggagcattcacgcccatcaccagtggatgaccacagaggacatgctgtccgtgtggaacagagtctggatcgaagagaatccttggatggaagataagacccatatcagctcttggggcgacgtgccctacctcgggaaacgggaggaccaatggtgcggatccctgattggccttacagccagagctacctgggccacaaacatccaggttgcgattaatcaggtgcgccggctgatcgggaacgagaattacctcgattatatgaccagcatgaagagattcaaaaacgaatctgaccccgagggcgctctgtggtga

SEQ ID NO: 19273 - RNA, 9879 nt, synthetic construct
  misc_feature 1..9879: note = derived and/or modified CDS sequence (opt5) from DENV-1__EU482802__SS-prME
  source 1..9879: mol_type = other RNA
agcgtgaccatgctgctgatgctgatgcccaccgcccttgctttccacctgacgacccggggcggggaacctcatatgattgtctccaagcaggaacggggaaaatctctcctgtttaagacaagcgccggcgttaacatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctcttctgcccctctgtctgtccaccaccagccagaaaacaacctggctccctgtgctgcttgggtctctgggatgcaagccgctgacaatgtttctcattgccgagaataaaatctggggcagaaagtcctggcccctgaacgaaggcattatggcggtcgggatcgtgagcatccttctgtccagcctcctgaaaaacgatgttcctctcgccggacccctgattgctggcgggatgcttatcgcctgttacgtgatttctggaagctccgctgacctgtctctggagaaggccgccgaggtcagctgggaagaggaagctgagcattccggcgcgtctcacaatatcctcgtggaagttcaggatgacgggacgatgaaaattaaggatgaggagcgggacgataccctgacaatccttctgaaggccaccctcctggctgtgagcggagtctatcctctctccatccccgccacactgttcgtgtggtacttctggcagaaaaagaaacaacgctctggcgtcctttgggacaccccttcccctcccgaagtggagagagccgttctggatgacggcatttatcggatcatgcagcgcgggctgctcggaagatcccaggtgggcgtcggggtgtttcaggaaaacgttttccatacgatgtggcacgtgacccggggagctgtcctgatgtaccaaggcaagcgccttgagcccagctgggcctctgtgaaaaaggacctgatttcctacgggggaggctggagactccagggcagctggaatacaggggaggaagtgcaggttatcgcggtcgagcccggaaagaaccctaaaaatgtgcagaccgctcccggcacatttaagacctctgaaggggaggtgggagccattgccctggatttcaaaccgggcacatccgggagccctatcgtcaaccgggaaggaaagattgtgggcctctatggcaatggggttgtgacgacctccggaacatacgtctctgctatcgcccaagcgaaagctagccaggagggccccctgcctgagatcgaagacgaggtgtttagaaagcgcaaccttaccattatggatctgcaccccgggtccggaaagacccggagatatctgcccgccatcgttcgcgaagccattaaacggaagctcagaacactgatccttgctcctacgcgcgtggtcgccagcgagatggctgaagccctgaaaggcatgccgattcggtaccagaccacagcggtgaagtctgagcataccgggaaagagatcgttgacctcatgtgccacgccacattcaccatgagactgctgtcccccgtgcgcgtccctaattataacatgatcattatggatgaagctcattttacggaccccagctctatcgccgctcggggctacattagcacaagagtgggaatgggcgaggccgccgctatcttcatgaccgcgacccctcccgggtccgtggaagcctttcctcaatctaatgctgtcattcaggatgaggaacgggacatcccggagcgcagctggaactccggatatgagtggatcacagatttccccggcaagaccgtttggtttgtgccttctattaagagcgggaatgacatcgccaactgtctccgcaagaatggaaagcgggtgattcagctttcccgcagaacattcgataccgaataccagaaaacgaagaacaacgactgggactacgtcgtgacaaccgatatcagcgagatgggcgccaatttccgggctgacagagttattgatccccgccggtgcctgaaacctgtgatcctgaaggacgggcccgaaagagtcattctcgccggcccgatgcctgtgacagttgcgtctgctgcccaacgccggggaagaatcggccgcaaccacaataaggagggggatcagtatatctacatgggacagcccctgaacaatgacgaggatcatgcccactggaccgaagctaaaatgcttctggacaacattaatacgcccgagggcatcattcctgccctctttgaacccgagcgggaaaagtccgcggccatcgatggggagtatagactgcgcggagaggctagaaaaaccttcgtggaactgatgcggcgcggcgacctccctgtctggcttagctacaaggtggcctccgaggggtttcagtattctgatagacggtggtgcttcgacggcgaacgcaacaatcaagtcctggaggaaaacatggatgtggagatttggacaaaagagggagaaagaaagaaactgcggccgagatggctcgacgctcgcacctacagcgaccccctggcccttcgggagtttaaggagttcgctgccggcagacgctccgtttctggggatctgatcctcgagatcggaaagctgcctcagcacctgacacagcgggcgcagaatgccctcgacaaccttgtgatgctgcataatagcgaacaaggcgggagagcttatcggcacgccatggaggagctgcccgataccattgaaacactcatgctgcttgctctgatcgccgtgctcaccggaggcgtcacgctgtttttcctgtccggccgcgggctcggaaaaacaagcattggccttctgtgtgttatggcctcttccgctctgctctggatggcgagcgtggagcctcattggatcgccgcttctattatcctggaatttttccttatggtgctgctcatccccgagccggacagacagcggacccctcaggataaccagctggcctacgtcgtgattgggctgctctttatgatccttaccgttgccgctaatgagatgggactgctggaaacaaccaagaaagacctcggcattgggcacgtggccgtcgagaaccaccatcacgcggccatgctggatgtggaccttcatcccgcttccgcctggacactgtacgctgtcgccacgaccatcattacacctatgatgcgccacaccatcgaaaacacaaccgcgaatattagcctcacggccatcgctaaccaagccgctatcctgatgggactggataagggctggcccatttctaaaatggacatcggcgtgcctctccttgccctggggtgctatagccaggttaatcccctgaccctcacagctgccgtgctgatgcttgtcgcgcattacgccattatcggaccgggcctgcaggctaaggccaccagagaggctcaaaagcggacagccgccgggattatgaaaaaccctaccgtggatggaatcgttgcgatcgacctcgatcccgtggtctatgacgctaagttcgaaaaacagctgggccagattatgctgctcatcctttgtacgtcccagattctgctgatgcgcacaacctgggccctctgcgagtctatcacactggctaccgggccccttaccacactgtgggagggaagccctggcaagttttggaatacgaccattgccgtgtccatggccaacatcttcagaggcagctacctcgctggggccggactggcgttctccctgatgaaatctctcggcgggggacggcgcggcacaggggcccaaggagaaacccttggcgagaagtggaagagacagctgaatcagctgagcaaatccgaatttaacacatataagcggtctggcatcatggaggtggacagaagcgaagctaaagaggggctcaagcgcggagagaccacgaaacacgccgtttcccggggcacagctaagctgagatggttcgtcgaacgcaatcttgtgaagccggaggggaaagtgattgatctgggatgtggcagagggggatggtcttactattgcgccggcctcaagaaagtcaccgaagttaagggctacaccaaagggggacccggccacgaggaacctatccccatggcgacatacgggtggaacctggtgaagctgcatagcggaaaagacgtgtttttcattcctcccgagaagtgtgataccctcctttgcgacatcggcgagtccagccctaatccgacaattgaagaggggagaacgctgcgcgtcctgaagatggtggaaccctggctccggggaaaccagttttgtatcaaaattctgaatccttatatgccctctgttgtggagacccttgagcaaatgcagagaaagcacggcggcatgctggtccgcaaccctctctcccggaatagcacacatgaaatgtactgggtgtcttgcgggaccggaaacatcgtttccgccgtgaatatgacaagcagaatgctgctgaaccgcttcaccatggctcaccggaaacccacgtatgagagagatgtcgacctcggcgccgggacccgccacgtggctgtggaaccggaggtcgccaacctggatatcattggacagagaatcgaaaatattaagcatgagcacaaatctacatggcattacgacgaggataacccttataagacctgggcttaccacggctcctatgaagttaagcccagcgggtccgccagctctatggtgaatggagtggtcaaacttctgacaaagccctgggacgtgatccctatggttacccagattgcgatgacagataccacgccctttggccaacagcgggtgttcaaagagaaggtcgacacacgcacccctaaaagcaagagaggcaccgcccagatcatggaagtgacagctaagtggctctgggggtttctgtcccggaacaaaaagccgagaatctgtacgcgggaggagttcacccgcaaagttagatctaatgccgctattggagccgtgtttgtcgacgagaaccaatggaatagcgccaaggaggcggtggaagatgagcggttctgggaccttgttcatcgcgaaagagagctgcacaaacagggcaagtgcgctacatgcgtgtacaacatgatggggaagcgggagaaaaagctcggagagtttggcaaagccaaggggtcccgcgccatctggtacatgtggctgggcgctagattcctggagttcgaagccctcggatttatgaatgaggatcactggttctctcgggaaaacagcctgtccggcgtcgagggggagggacttcataaactgggctatattctccgcgacatctctaagattcccgggggaaatatgtacgctgatgacaccgccggctgggatacaagaatcaccgaagacgatctgcagaacgaggcgaaaatcacagacattatggaacctgagcacgcccttctggctaagagcatctttaagctcacctatcagaataaagtggtccgggtgcaacgccccgccaagaacgggacggttatggatgtgatttccagacgggaccagcgcggcagcggacaggtcggcacctacgggctgaatacattcaccaacatggaagctcagctgatcagacaaatggagtctgagggaatcttttcccctagcgaactcgagacacccaacctggccggccgggtgcttgattggctggaaaaacatggggtggagagactcaagcgcatggcgatctctggagacgactgtgttgtgaaaccgatcgatgaccggttcgccaccgctctgacggcccttaatgatatgggcaaggtcagaaaggacattcctcagtgggaaccctccaaagggtggaacgattggcaacaggtgcctttttgcagccaccacttccatcaactgatcatgaaggacggccgcgagattgttgtgccctgtcggaatcaggatgagctcgtcggcagagctcgcgtgtcccagggagccgggtggtctctgcgggaaacagcttgcctgggaaaaagctatgcccagatgtggcaactcatgtactttcacagacgcgacctgcggcttgcggccaacgctatctgttccgccgtccctgtggattgggttcccaccagcagaacaacctggtctattcatgcccaccatcagtggatgacgaccgaggacatgctgtccgtgtggaatcgcgtctggatcgaagagaacccgtggatggaagataagacacacattagctcttggggcgacgtgccttatctcgggaaacgggaggaccagtggtgcggaagcctgatcggccttaccgctagagccacatgggcgaccaatatccaagttgctattaaccaggtgcggagactgatcgggaatgagaactacctcgattacatgacatccatgaagcgcttcaagaatgaatctgaccccgagggcgccctgtggtga

SEQ ID NO: 19274 - RNA, 9879 nt, synthetic construct
  misc_feature 1..9879: note = derived and/or modified CDS sequence (opt5) from DENV-1__EU482804__SS-prME
  source 1..9879: mol_type = other RNA
agcgtgacaatgctgctgatgctgatgcccacagcccttgctttccacctgacgacaagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaaggttgtgcagtacgaaaaccttaaatattccgtcatcgtgacggttcacaccggcgaccagcatcaagtggggaatgagagcacagaacacggaaccacagctaccatcacgccccaggccccttctaccgagattcagctgacagactacggcgccctcaccctggattgtagcccccggacaggcctggactttaacgaaatggtcctcctgaccatgaaggagaaaagctggcttgtgcataagcagtggttcctggatctccctctgccctggacgtccggggcttctacaagccaagagacctggaatcgcaaagaccttctggtcacatttaagaccgcgcacgccaagaaacaggaagtggttgtgctcggatcccaggagggcgctatgcacaccgccctgacaggggccacggaaatccaaaccagcggaacaaccacaattttcgctggccatctgaagtgcagactcaaaatggataagctgacccttaaagggatgtcttatgtcatgtgtacgggctccttcaagctggagaaggaagtggccgagacacagcacggaaccgttctcgtgcagatcaaatacgagggcaccgacgcgccgtgcaagattccttttagcacacaggatgaaaaaggggtcacccaaaacggacggctgatcacagctaatcccatcgtgacggacaaggagaaacctgtgaacattgaagccgagccgcccttcggcgagtcttatatcgttattggggccggagaaaaggctctgaaacttagctggtttaaaaagggctcctctatcgggaaaatgttcgaggccaccgctagaggcgcccgccggatggcgattctcggagatacagcctgggactttggcagcatcgggggagtcttcacctccgtgggcaagctggtgcatcagatctttgggacagcttacggagtcctgttcagcggcgtgtcttggaccatgaaaattgggatcggcgttctcctgacgtggcttggactcaattccagaagcacctctctctccatgacatgtattgccgtgggcctggtcaccctgtaccttggggtgatggttcaggctgatagcggatgcgtgatcaactggaagggccgcgaactcaagtgtgggtccggaatttttgtcacaaatgaggtgcacacctggacagaacagtataaattccaagccgactctcctaagcggctgagcgcggccatcggcaaggcttgggaggagggggtttgcggcattagatccaccacgcgcctggaaaacatcatgtggaagcagatctctaacgagctcaatcatattctgcttgaaaacgacatgaaatttacagtggtcgtgggagatgtggccggcatcctggctcaggggaagaaaatgattcggccgcagcccatggagtacaagtatagctggaagtcctggggaaaagccaagatcattggcgccgacgtccaaaataccaccttcatcatcgatgggcctaacacacccgaatgtcctgacgatcagagagcttggaatatttgggaggttgaggactacggatttggcatcttcaccacgaacatttggctcaaactgcgcgatagctatacacaggtgtgcgaccaccggctgatgtctgcggccatcaaggattccaaagctgtgcacgccgacatgggctactggattgaaagcgagaagaatgaaacctggaaacttgccagagcttctttcatcgaggtcaaaacatgtatctggcccaagtcccataccctctggagcaacggggtgctggaatctgagatgattatcccgaaaatttatggaggccctatcagccagcacaattaccgccccgggtactttacacaaaccgccggaccttggcatctgggcaagctcgagctggatttcgacctttgcgaagggacgaccgttgtggtcgatgagcactgcggaaaccggggcccctccctgagaacaaccacagtgaccggcaaaattatccacgaatggtgttgccggagctgtacgctccctcccctgcgctttaagggggaggacggatgctggtatggcatggagatcagaccggttaaggaaaaagaggaaaatctggtgaagtctatggtctccgcggggagcggagaggtggactccttctctcttggcctcctgtgtattagcatcatgattgaagaggttatgcggtccagatggtctcgcaaaatgctgatgacagggaccctcgctgtgtttttcctgcttatcacaggacagctgacctggaacgatctcattcggctgtgcatcatggtcggcgccaatgccagcgacagaatgggcatggggaccacatacctggctcttatggccacgtttaagatgcgccctatgttcgcggtgggactgctctttagacggctgacctcccgcgaggtgctcctgcttacaattggcctgtctctcgtcgctagcgttgaactgcccaactccctggaggaacttggggatggactggccatgggcatcatgatcctcaaactgctcaccgacttccagagccatcaactgtgggccacacttctgtctctcacctttattaagacgacattctccctgcactatgcttggaagaccatggccatggtgctgagcatcgtgtctctttttcccctgtgtctctccaccacaagccagaaaaccacatggctgcctgtcctcctggggtctcttggatgcaagccgctgacgatgttcctgattgctgagaataaaatctggggcagaaagtcctggcccctcaacgaaggcattatggccgtggggatcgttagcatcctgctttccagcctgctcaaaaacgatgtgcctctggcgggacccctcattgccggcgggatgctgatcgcttgttacgtcatttctggaagctccgccgacctttctctggagaaggctgccgaggtgagctgggaagaggaagccgagcattccggcgcttctcacaatatcctggttgaagtgcaggatgacgggaccatgaaaattaaggatgaggagcgggacgatacactcaccatcctgcttaaggcgacactgctcgccgtcagcggagtgtatcctctgtccatccccgctaccctcttcgtctggtacttttggcagaaaaagaaacaacgctctggcgtgctgtgggacacgccttcccctcccgaagttgagagagccgtgcttgatgacggcatttatcggatcatgcagcgcgggctgctgggaagatcccaggtcggcgtgggggttttccaggaaaacgtgtttcataccatgtggcacgtcacacggggagccgtgctcatgtaccaaggcaagcgcctggagcccagctgggcttctgtgaaaaaggaccttatttcctacgggggaggctggagactgcagggcagctggaataccggggaggaagttcaggtcatcgccgtggagcccggaaagaaccctaaaaatgtgcagacagcgcccggcaccttcaagacatctgaaggggaggtcggagctattgccctcgattttaaaccgggcacgtccgggagccctatcgtgaaccgggaaggaaagattgttggcctgtatggcaatggggtggtcaccacatccggaacctacgtgtctgccatcgctcaagccaaagcgagccaggagggccccctccctgagatcgaagacgaggttttcagaaagcgcaacctgaccattatggatcttcaccccgggtccggaaagacacggagatatctgcccgctatcgtgcgcgaagccattaaacggaagctgagaacgctcatcctggcccctacccgcgtcgtggctagcgagatggccgaagctcttaaaggcatgccgattcggtaccagacaaccgccgttaagtctgagcatacagggaaagagatcgtggacctgatgtgccacgcgacctttacgatgagactcctgtcccccgtccgcgtgcctaattataacatgatcattatggatgaagcccatttcacagaccccagctctatcgctgcccggggctacattagcaccagagtgggaatgggcgaggctgccgccatctttatgaccgctacacctcccgggtccgtcgaagcgttccctcaatctaatgccgttattcaggatgaggaacgggacatcccggagcgcagctggaactccggatatgagtggatcaccgattttcccggcaagacagtgtggttcgtgccttctattaagagcgggaatgacatcgctaactgtctgcgcaagaatggaaagcgggtcattcagctctcccgcaaaaccttcgatacggaataccagaagaccaagaataacgactgggactacgtggttaccacagatatcagcgagatgggcgccaattttagagccgaccgggtgattgatcccagacgctgccttaagcctgtcatcctgaaggacgggcccgaacgggtgattctggctggcccgatgcctgttaccgtggcctctgcggctcaaagacgcggacggatcggcagaaaccacaataaagagggggatcagtatatctacatgggacagcccctcaacaatgacgaggatcatgcccactggacggaagccaagatgctgcttgacaacattaatacccccgagggcatcattcctgctctgttcgaacccgagcgcgaaaaatccgccgcgatcgatggggagtatcggctcagaggagaggcccgcaagacatttgtcgaactgatgagacggggcgacctgcctgtgtggctcagctacaaagtcgcttccgaggggttccagtattctgatcgcagatggtgctttgacggcgaacggaacaatcaagtgcttgaggaaaacatggatgttgagatttggaccaaggagggagaacgcaaaaagctgagaccgcggtggctggacgccagaacatacagcgaccccctcgctctgcgcgagttcaaggaatttgccgctggccggagatccgtgtctggggatcttatcctggagatcggaaaactccctcagcacctgacccagcgcgcccagaatgcgctggacaacctcgtgatgcttcataatagcgaacaaggcgggcgggcctatagacacgctatggaggagctgcccgatacaattgaaaccctgatgctcctggcccttatcgctgtcctgacgggaggcgttacactcttctttctgtccggccgggggctgggaaagaccagcattggcctcctttgtgtgatggcctcttccgtgctgctgtggatggccagcgtcgagcctcattggatcgctgcgtctattatcctcgagttctttctgatggtgcttctgatccccgagccggaccgccagagaacccctcaggataaccagctcgcctacgttgtgattgggctgctgttcatgatcctcacagtcgctgccaatgagatgggacttctggaaaccaccaagaaggacctgggcattgggcacgtggccgctgagaaccaccatcacgccgcgatgctcgatgtcgacctgcatcccgcctccgcttggacgctttacgccgtggctaccacaatcattacccctatgatgcggcacacaatcgaaaacaccacggccaatattagcctgaccgcgatcgccaaccaagctgccatcctcatgggactggataaaggctggcccatttctaagatggacatcggcgttcctctgctcgctcttgggtgctatagccaggtgaatcccctgacactgaccgccgctgtcctcatgctggtggcccattacgcgattatcggaccgggccttcaggccaaggctacacgcgaggcccagaaaagaaccgctgccgggattatgaagaaccctacggttgatggaatcgtggccatcgacctggatcccgtcgtgtatgacgcgaaatttgaaaagcagctcggccagattatgctgctgatcctctgtacatcccagattcttctgatgcggaccacatgggctctgtgcgagtctatcaccctcgccaccgggcccctgacaacgctttgggagggaagccctggcaaattctggaataccacaattgctgtgtccatggccaacatcttccgcggcagctacctggccggggctggactcgccttttccctgatgaagtctctgggcgggggaagacggggcaccggggcgcaaggagaaacactcggcgagaagtggaaacgccagcttaatcagctgagcaagtccgagttcaacacctataaaagatctggcatcatggaggttgaccggagcgaagccaaggaggggctgaaaagaggagagacgacaaagcacgctgtctcccgcggcaccgccaagctccggtggtttgtggaaagaaatctggtgaaaccggaggggaaggtcattgatcttggatgtggccgcgggggatggtcttactattgcgctggcctgaaaaaggttaccgaagtgaaaggctacacaaaagggggacccggccacgaggaacctatccccatggccacctacgggtggaacctcgtgaaactgcatagcggaaaggacgtcttctttattcctcccgagaagtgtgatacactgctctgcgacatcggcgagtccagccctaatccgacgattgaagaggggcggacccttagagtgctgaaaatggttgaaccctggctgcgcggaaaccagttctgtatcaagattctcaatccttatatgccctctgtggtcgagacactggagcaaatgcagcggaaacacggcggcatgcttgtgagaaaccctctgtcccgcaatagcacccatgaaatgtactgggtttcttgcgggacaggaaacatcgtgtccgcggtcaatatgaccagccggatgctcctgaacagatttacgatggcccaccgcaagcccacctatgagcgggatgtggacctgggcgctgggacaagacacgtggccgtcgaaccggaggttgctaacctcgatatcattggacagcgcatcgaaaatattaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttatccctatggtgacacagattgccatgaccgatacgacacccttcggccaacagagagtctttaaggagaaagtggacacccggacccctaaggcgaagcgcggcacagcccagatcatggaagttacggctaaatggctgtgggggttcctcagcagaaacaagaaaccgcggatctgtaccagagaggaatttacacggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacctgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacacagccggctgggatacccgcatcacagaagacgatctccagaacgaggcgaagatcaccgacattatggaacctgagcacgccctgcttgctaagtctatcttcaaactgacgtatcagaataaggtcgtgagagttcaacggcccgccaaaaacgggaccgtgatggatgtcattagccgcagagaccagcggggctccggacaggtgggcacatacgggctcaatacctttacaaacatggaagctcagctgatccgccaaatggagagcgagggaattttctctccttccgaactggagacccccaacctcgccggcagagtgctggattggcttgaaaagcatggggttgagcggctgaaaagaatggcgatcagcggagacgactgtgtggtcaagccgatcgatgaccgctttgccacggctctcacagccctgaatgatatgggcaaggtgcggaaagacattcctcagtgggaaccctctaaggggtggaacgattggcagcaggttcctttctgctcccaccactttcatcaacttatcatgaaagacggcagagagattgtggtcccctgtcgcaatcaggatgagctggtgggacgggctagagtcagccagggcgccgggtggtccctccgcgaaaccgcttgcctgggaaagtcttatgcccagatgtggcaactgatgtacttccaccggagagacctccgcctggcggccaacgctatctgtagcgccgtgcctgttgattgggtgcccacatcccggaccacgtggagcattcatgcccaccatcagtggatgaccacagaggacatgctttctgtctggaatagagtgtggatcgaagagaacccgtggatggaagataaaacccacatttccagctggggcgacgttccttatctggggaagcgcgaggaccagtggtgcggatctctcatcggcctgacagctcgggccacctgggcgacaaatatccaagtggctattaaccaggtcagacggcttatcgggaatgagaactacctggattacatgaccagcatgaagagatttaaaaatgaatccgaccccgagggcgccctctggtga

SEQ ID NO: 19275 - RNA, 9879 nt, synthetic construct
  misc_feature 1..9879: note = derived and/or modified CDS sequence (opt5) from DENV-1__EU482806__SS-prME
  source 1..9879: mol_type = other RNA
agcgtgaccatgctgctcatgctgatgcccaccgcccttgctttccacctgacgacccggggcggggaacctcatatgattgtcaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctggggagcctcggatgcaaaccgctgacaatgtttcttatcgctgagaataagatttggggcagaaaatcttggcccctgaacgaaggcatcatggccgtcggggtggtttccatcctcctgagctccctcctgaagaacgatgtgcctcttgcgggacccctgattgccggcgggatgctgatcgcttgttatgtcattagcggatctagcgccgacctctccctggagaaagctgccgaggtgtcttgggaagaggaagccgagcacagcggcgcttcccataatatccttgttgaagtgcaggatgacgggacgatgaagattaaagatgaggagcgggacgataccctgacaatcctcctgaaggcgaccctcctggccgtctctggagtgtaccctcttagcatccccgctacactgttcgtctggtatttttggcaaaagaaaaagcagcgctccggcgtgctgtgggacaccccttctcccccggaagttgagagagccgtgctcgatgacggcatttaccggatcatgcagcgcgggctgcttggaagaagccaggtcggcgtgggggttttccaagaaaacgtgttccacacgatgtggcacgtcacccggggagccgtgctgatgtatcagggcaaacgcctcgagccttcctgggctagcgtgaagaaagacctgatttcttacgggggaggctggagactccagggctcctggaatacaggggaggaagttcaggtcatcgccgtggagcccggaaagaaccctaagaatgtgcaaaccgcgcccggcacatttaaaaccccggaaggggaggtcggagctattgccctggatttcaagcctggcacaagcgggtctcccatcgtgaaccgggaaggaaaaattgttggcctttacggcaatggggtggtcacgacctccggaacatatgtgagcgccatcgctcaggccaaggcgtcccaggagggccctctgcccgagatcgaagacgaggtttttagaaaacgcaacctgaccattatggatctccatcccgggtctggaaagacccggagatacctgcctgctatcgtgcgcgaagccattaagcggaaacttagaacactgatcctcgccccgacgcgcgtcgtggctagcgagatggccgaagctctgaagggcatgcccattcggtatcaaaccacagccgttaaatccgagcacaccgggaaggagatcgtggacctgatgtgccatgcgacattcaccatgagactccttagccctgtccgcgtgcccaattacaacatgatcattatggatgaagcccactttacggacccttcttccatcgctgcccggggctatattagcacaagagtgggaatgggcgaggctgccgccatcttcatgaccgctacaccccctgggtctgtcgaagcgtttccgcagagcaatgccgttattcaggatgaggaacgggacatccccgagcgctcctggaactctggatacgagtggatcacagatttccctggcaaaaccgtgtggtttgtgcccagcattaagtccgggaatgacatcgctaactgtctgagaaagaatggaaaacgggtcattcagctgtctcgcaagacattcgataccgaatatcagaagacgaagaacaacgactgggactacgtggttacaaccgatatcagcgagatgggcgccaattttagagccgaccgggtgattgatcctagacgctgcctcaaacccgtcatcctgaaggacgggccggaacgggtgattcttgctggccctatgcccgttacagtggcctccgcggctcagagacgcggacggatcggcagaaaccataataaggagggggatcagtacatctatatgggacagcccctgaacaatgacgaggatcacgcccactggaccgaagccaaaatgctcctggacaacattaatacgcctgagggcatcattcccgctctgttcgaacctgagcgcgaaaagagcgccgcgatcgatggggagtaccggctcagaggagaggcccgcaaaaccttcgtcgaacttatgagacggggcgacctgccggtgtggctgtcttataaggtcgcttccgaggggtttcaatacagcgatcgcagatggtgcttcgacggcgaacggaacaatcaggtgctcgaggaaaacatggatgttgagatttggacaaaagagggagaacgcaagaaactgagaccccggtggcttgacgccagaacctattccgaccctctggctctccgcgagtttaaggagttcgccgctggccggagatctgtgagcggggatctgatcctggagatcggaaagctcccccagcatcttacacagcgcgcccaaaatgcgctggacaacctggtgatgctccacaattccgaacagggcgggcgggcctacagacatgctatggaggagctgcctgataccattgaaacacttatgctgctcgccctgatcgctgtcctgaccggaggcgttacgctctttttcctttctggccgggggctgggaaaaacaagcattggcctgctctgtgtgatggcctccagcgtgctgctttggatggcctctgtcgagccccactggatcgctgcgtccattatcctggaatttttcctcatggtgctgctgatcccggagcctgaccgccagagaacaccccaggataaccaactcgcctatgttgtgattgggcttctgtttatgatcctgaccgtcgctgccaatgagatgggactcctggaaacaaccaagaaagaccttggcattgggcacgtggccgtcgagaaccatcaccatgctacaatgctggatgtggacctccaccctgccagcgcgtggacgctgtacgccgttgctaccacaatcattacccccatgatgcggcatacaatcgaaaacaccacggccaatatttctctgaccgctatcgccaaccaggcggccatcctcatgggacttgataagggctggcctatttccaaaatggacatcggcgtgcccctgctggctctcgggtgctacagccaggtcaatccgctgacacttaccgccgctgtgctgatgctcgttgcccactatgctattatcggacctggcctgcaagccaaggcgacacgcgaggcccagaagagaaccgctgccgggattatgaaaaaccccacggtggatggaatcgtcgctatcgacctggatcccgtggtgtacgacgccaagttcgaaaaacagctcggccagattatgcttctgatcctgtgtacatctcaaattctcctgatgcggaccacatgggccctttgcgagagcatcaccctggcgaccgggcctctcacaacgctgtgggagggatccccgggcaagttttggaataccacaattgctgtttctatggccaacatcttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatctacaagagaagcggcattatggaggtcgaccggtccgaagccaaagaggggcttaagagaggagagaccacgcgccacgcggtgtctcggggcacagccaaactgagatggttcgtggaacgcaatctcgtcaagcccgaggggaaggttatcgatctgggatgtggcagagggggatggagctattactgcgctggcctgaaaaaggtgaccgaagtgaaaggctataccaaagggggacctggccatgaggaacccattcctatggccacatacgggtggaacctcgtcaaacttcactccggaaaggacgtgtttttcacaccccctgagaaatgtgatacactgctgtgcgacatcggcgagtctagcccgaatcccacgattgaagaggggagaaccctccgcgttctgaagatggtggaaccttggcttcggggaaaccaattttgtatcaagattctgaatccctacatgccttccgtcgtggagacactcgagcagatgcagagaaaacatggcggcatgctggttcgcaaccccctgagcagaaattctacccacgaaatgtattgggtgtcctgcgggacaggaaacatcgtcagcgctgtgaatatgacctctagaatgctcctgaaccgcttcacgatggcccaccggaagccgacctacgagagagatgtggaccttggcgcggggacacgccatgtcgccgttgaacctgaggtggctaacctggatatcattggacagagaatcgaaaatattaaacacgagcataagtccacctggcactatgacgaggataacccctacaaaacatgggcctatcatggcagctacgaagtgaagccctctgggtccgctagctccatggtcaatggagtggttaagctcctgaccaaaccttgggacgtgatccccatggtcacacaaattgccatgaccgatacgacaccttttggccagcagcgggtgttcaaggagaaagttgacacccgcaccccgaaggctaaaagaggcacagcccaaatcatggaagtgacggcgcggtggctttgggggtttctgagcagaaacaagaagccccggatctgtacccgcgaggagttcacaagaaaagtccggtctaatgccgctattggagccgtgtttgttgacgagaaccagtggaatagcgctaaggaggccgtggaagatgagcgcttctgggacctcgtccagaaagaaagagagctgcacaagcagggcaaatgcgcgacctgcgtgtataacatgatggggaagcgggaaaagaaactgggagagtttggcaaggcgaaagggtcccgcgctatctggtacatgtggctcggcgccagattcctggagtttgaagcccttggattcatgaatgaggatcactggttctctcgggaaaacagcctgtccggcgtcgagggggagggactccataagctgggctacattcttcgcgacatctctaaaattcctgggggaaatatgtatgctgatgacacagccggctgggataccagaatcacagaagacgatctgcaaaacgaggctaagatcaccgacattatggaacccgagcacgccctcctggcgacgagcatctttaaactgacctaccagaataaggtggttcgggtgcagcgccctgccaagaacgggacagtcatggatgtgatttccagacgggaccagcgcggctctggacaagtgggcacctatgggctcaatacattcaccaacatggaagctcagctgatcagacagatggagagcgagggaatcttttccccctgtgaacttgagatcccgaacctggccgaacgggttctcgattggctggagaaatacggcgtggaaagacttaagcgcatggctatcagcggggacgactgcgtcgtgaaacctattgatgaccggttcgccacggcgctgacagccctcaatgatatgggaaaggttagaaaagacgtgccccagtgggagccttctaagggctggaacgattggcaacaggtccccttttgttcccatcacttccaccagctgatcatgaaggacgggcgcgagattgtggtcccttgccggaatcaggatgaactggtgggcagagctcgcgttagccaaggagccggctggtctctccgggagaccgcttgtctggggaaatcctatgcccagatgtggcagcttatgtactttcatagacgcgacctgcggctcgctgccaacgcgatctgcagcgccgtgcccgtcgattgggtgccgacatccagaaccacgtggtctattcacgctcatcaccaatggatgaccacagaagacatgctgagcgtttggaatcgcgtgtggatcgaggaaaacccttggatggaggataagacccatgtctccagctggggagacgtgccctatcttggcaaacgggaggaccagtggtgtgggtctctgattggactcacagccagagccacctgggcttccaatatccaggtggccatcaaccaggttcggagactgattggcaatgaaaactacctggattacatgacaagcatgaagcgcttcaaaaatgagggggaccccgaaggcgcgctctggtga

SEQ ID NO: 19276 - RNA, 9879 nt, synthetic construct
  misc_feature 1..9879: note = derived and/or modified CDS sequence (opt5) from DENV-1__EU482807__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacaagcgccggcgttaatatgtgcacccttgtggcgatggacctgggggagttctgtgaagatacaatgacctacaaatgcccgcgcatcacagaagctgaacccgacgatgtggactgttggtgcaatgccaccgatacgtgggtcacctatggaacatgttcccagaccggcgagcaccggcgggacaagcgctctgtggccctcgctcctcatgttgggctgggactggagacaagaaccgaaacgtggatgagctccgagggcgcctggaaacagatccagcgggtggaaacatgggctctccgccaccccggctttaccgtcattgccctgttccttgcgcatgccatcgggacatctattacccagaagggaatcatctttattctgctcatgctggtgacccctagcatggctatgagatgcgttggcatcgggtcccgggatttcgtggagggacttagcggcgccacatgggtcgacgtggtgctggagcacgggtcttgtgtcacgaccatggctaaggataaacccacactcgacattgaactgctgaagaccgaggttacaaaccctgccgtgctccgcaaactgtgcatcgaagcgaagatttccaataccacgacagatagcagatgtccgacccaaggagaggccacccttgtggaagaacaggacgctaactttgtctgccggcgcacattcgtggatagaggctggggcaatgggtgtggactgtttggcaaagggtctctcattacctgcgccaagttcaagtgcgttacaaaactggagggaaagacggtgcagtacgaaaaccttaaatattccgtcattgtgaccgttcacacaggcgaccagcatcaagtggggaatgagagcaccgaacacggaacaaccgctacgatcacaccccaggccccttctacagagatccagctgaccgactacggcgccctcacactggattgtagcccccggaccggcctggactttaacgaaatggtcctcctgacgatgaaggagaaaagctggcttgtgcataagcagtggttcctggatctccctctgccctggacatccggggcttctaccagccaagagacatggaatcgcaaagaccttctggtcacctttaagaccgcgcacgccaagaaacaggaagtggttgtgctcggatcccaggagggcgctatgcacacagccctgacgggggccaccgaaattcaaacaagcggaaccacaaccatcttcgctggccatctgaagtgcagactcaaaatggataagctgacgcttaaagggatgtcttatgtcatgtgtacaggctccttcaagctggagaaggaagtggccgagacccagcacggaaccgttctcgtgcagattaaatacgagggcacagacgcgccgtgcaagatcccttttagcacccaggatgaaaaaggggtcacacaaaacggacggctgattacggctaatcccatcgtgaccgacaaggagaaacctgtgaacatcgaagccgagccgcccttcggcgagtcttatattgttatcggggccggagaaaaggctctgaaacttagctggtttaaaaagggctcctctattgggaaaatgttcgaggccacagctagaggcgcccgccggatggcgatcctcggagataccgcctgggactttggcagcattgggggagtcttcacatccgtgggcaagctggtgcatcagatctttgggaccgcttacggagtcctgttcagcggcgtgtcttggacgatgaaaatcgggattggcgttctcctgacctggcttggactcaattccagaagcacatctctctccatgacctgtatcgccgtgggcctggtcacactgtaccttggggtgatggttcaggctgatagcggatgcgtgattaactggaagggccgcgaactcaagtgtgggtccggaatctttgtcaccaatgaggtgcacacatggaccgaacagtataaattccaagccgactctcctaagcggctgagcgcggccattggcaaggcttgggaggagggggtttgcggcatcagatccgccacgcgcctggaaaacattatgtggaagcagatctctaacgagctcaatcatatcctgcttgaaaacgacatgaaatttacagtggtcgtgggagatgtggctggcattctggcccaggggaagaaaatgatccggccgcagcccatggagtacaagtatagctggaagtcctggggaaaagccaagattatcggcgctgacgtccaaaataccaccttcattatcgatgggcctaacacacccgaatgtcctgacgatcagagagcgtggaatatctgggaggttgaggactacggatttggcattttcaccacgaacatctggctcaaactgcgcgatagctatacacaggtgtgcgaccaccggctgatgtctgccgctattaaggattccaaagccgtgcacgccgacatgggctactggatcgaaagcgagaagaatgaaacctggaaacttgctagagcctctttcattgaggtcaagacatgtatctggcccaagtcccataccctctggagcaacggggtgctggaatctgagatgatcattccgaaaatctatggaggccctattagccagcacaattaccgccccgggtactttacacaaaccgcgggaccttggcatctgggcaagctcgagctggatttcgacctttgcgaagggacgaccgttgtggtcgatgagcactgcggaaaccggggcccctccctgagaacaaccacagtgaccggcaaaatcattcacgaatggtgttgccggagctgtacgctccctcccctgcgctttaagggggaggacggatgctggtatggcatggagatcagaccggttaaggaaaaagaggaaaatctggtgaagtctatggtctccgctgggagcggagaggtggactccttctctcttggcctcctgtgtatcagcattatgatcgaagaggttatgcggtccagatggtctcgcaaaatgctgatgacagggaccctcgccgtgtttttcctgcttattatcggacagctgacatggaacgatctcattcggctgtgcatcatggtcggcgccaatgctagcgacagaatgggcatggggaccacctacctggcccttatggcgacatttaagatgcgccctatgttcgctgtgggactgctctttagacggctgacgtcccgcgaggtgctcctgcttaccattggcctgtctctcgtcgccagcgttgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggtgctgagcatcgtgtctctttttcccctgtgtctctccaccaccagccagaaaacaacctggctgcctgtcctcctggggtctcttggatgcaagccgctgacaatgttcctgattgccgagaataaaatctggggcagacggtcctggcccctcaacgaaggcattatggcggtggggatcgttagcatcctgctttccagcctgctcaagaacgatgtgcctctggccggacccctcattgctggcgggatgctgatcgcctgttacgtcatttctggaagctccgctgacctttctctggagaaagccgccgaggtgagctgggaagaggaagctgagcattccggcgcgtctcacaatatcctggttgaagtgcaggatgacgggacgatgaagattaaagatgaggagcgcgacgataccctcacaatcctgcttaaggccaccctgctcgctgtcagcggagtgtatcctctgtccatccccgccacactcttcgtctggtacttttggcagaagaaaaagcaaagatctggcgtgctgtgggacaccccttcccctcccgaagttgagcgggccgtgcttgatgacggcatttatcgcatcatgcagagagggctgctgggacggtcccaggtcggcgtgggggttttccaggaaaacgtgtttcatacgatgtggcacgtcacccgcggagctgtgctcatgtaccaaggcaaaagactggagcccagctgggcctctgtgaagaaagaccttatttcctacgggggaggctggcggctgcagggcagctggaatacaggggaggaagttcaggtcatcgcggtggagcccggaaagaaccctaagaatgtgcagaccgctcccggcacattcaaaacctctgaaggggaggtcggagccattgccctcgattttaagccgggcacatccgggagccctatcgtgaacagagaaggaaaaattgttggcctgtatggcaatggggtggtcacgacctccggaacatacgtgtctgctatcgcccaagcgaaggctagccaggagggccccctccctgagatcgaagacgaggttttccgcaaacggaacctgaccattatggatcttcaccccgggtccggaaagaccagacgctatctgcccgccatcgtgcgggaagccattaagagaaaactgcgcacactcatcctggctcctacgcgggtcgtggccagcgagatggctgaagcccttaagggcatgccgattagataccagaccacagcggttaaatctgagcataccgggaaggagatcgtggacctgatgtgccacgccacatttaccatgcgcctcctgtcccccgtccgggtgcctaattataacatgatcattatggatgaagctcatttcacggaccccagctctatcgccgctagaggctacattagcacacgggtgggaatgggcgaggccgccgctatctttatgaccgcgacccctcccgggtccgtcgaagccttccctcaatctaatgctgttattcaggatgaggaacgcgacatcccggagagaagctggaactccggatatgagtggatcacagattttcccggcaaaaccgtgtggttcgtgccttctattaagagcgggaatgacatcgccaactgtctgcggaagaatggaaaacgcgtcattcagctctccagaaagacattcgataccgaataccagaaaacgaagaacaacgactgggactacgtggttacaaccgatatcagcgagatgggcgccaattttcgggctgacagagtgattgatccccgccggtgccttaaacctgtcatcctgaaggacgggcccgaaagagtgattctggccggcccgatgcctgttacagtggcgtctgctgcccaacgccggggaagaatcggccgcaaccacaataaggagggggatcagtatatctacatgggacagcccctcaacaatgacgaggatcatgcccactggaccgaagctaaaatgctgcttgacaacattaatacgcccgagggcatcattcctgccctgttcgaacccgagcgggaaaagtccgcggccatcgatggggagtatagactccgcggagaggctagaaaaacctttgtcgaactgatgcggcgcggcgacctgcctgtgtggctcagctacaaggtcgcctccgaggggttccagtattctgatagacggtggtgctttgacggcgaacgcaacaatcaagtgcttgaggaaaacatggatgttgagatttggacaaaagagggagaaagaaagaaactgcggccgagatggctggacgctcgcacctacagcgaccccctcgccctgcgggagttcaaggaatttgctgccggcagacgctccgtgtctggggatcttatcctggagatcggaaagctccctcagcacctgacacagcgggcgcagaatgccctggacaacctcgtgatgcttcataatagcgaacaaggcgggagagcttatcggcacgccatggaggagctgcccgataccattgaaacactgatgctcctggctcttatcgccgtcctgaccggaggcgttacgctgttctttctgtccggccgcgggctgggaaaaacaagcattggcctcctttgtgtgatggcctcttccgtgctgctgtggatggctagcgtcgagcctcattggatcgcggcctctattatcctcgagttctttctgatggtgcttctgatccccgagccggacagacagcggacccctcaggataaccagctcgcttacgttgtgattgggctgctgttcatgatcctcaccgtcgccgccaatgagatgggacttctggaaacaaccaagaaagacctgggcattgggcacgtggctgtcgagaaccaccatcacgccgcgatgctcgatgtggacctgcatcccgcctccgcttggacactttacgccgttgctacgaccatcattacacctatgatgcgccacaccatcgaaaacacaaccgccaatattagcctgacggcgatcgccaaccaagctgccatcctcatgggactggataagggctggcccatttctaaaatggacatcggcgtgcctctgctcgctcttgggtgctatagccaggtcaatcccctgaccctgacagccgctgtgctcatgctggttgcccattacgcgattatcggaccgggccttcaggccaaggctaccagagaggcccaaaagcggacagctgccgggattatgaaaaaccctaccgtggatggaatcgtcgccatcgacctggatcccgtggtgtatgacgcgaagtttgaaaaacagctcggccagattatgctgctgatcctctgtacgtcccagattcttctgatgcgcacaacctgggctctgtgcgagtctatcacactcgccaccgggcccctgaccacactttgggagggaagccctggcaagttctggaatacgaccattgctgtttccatggccaacatcttcagaggcagctacctggccggggctggactcgccttttccctgatgaaatctctgggcgggggacggcgcggcacaggggcgcaaggagaaaccctcggcgagaagtggaagagacagcttaatcagctgagcaaatccgagttcaacacatataagcggtctggcatcatggaggtcgacagaagcgaagccaaagaggggctgaagcgcggagagaccacgaaacacgctgtgtcccggggcacagccaagctcagatggtttgtggaacgcaatctggtcaagccggaggggaaagttattgatcttggatgtggcagagggggatggtcttactattgcgctggcctgaagaaagtgaccgaagtgaagggctacaccaaagggggacccggccacgaggaacctatccccatggccacatacgggtggaacctcgtcaagctgcatagcggaaaagacgtgttctttattcctcccgagaagtgtgataccctgctctgcgacatcggcgagtccagccctaatccgacaattgaagaggggagaacgcttcgcgttctgaagatggtggaaccctggctgcggggaaaccagttctgtatcaaaattctcaatccttatatgccctctgtcgtggagaccctggagagaatgcaacgcaagcacggcggcatgcttgttcggaaccctctgtccagaaatagcacacatgaaatgtactgggtgtcttgcgggaccggaaacatcgtctccgcggtgaatatgacaagccgcatgctcctgaaccggtttaccatggcccacagaaaacccacgtatgagcgcgatgtggacctgggcgctgggaccagacacgtcgccgttgaaccggaggtggctaacctcgatatcattggacagcggatcgaaaatattaagcatgagcacaaatctacatggcattacgacgaggataacccttataagacctgggcctaccacggctcctatgaagtgaagcccagcgggtccgctagctctatggtcaatggagtggttaaactgcttacaaagccctgggacgtgatccctatggtcacccagattgccatgacagataccacgcccttcggccagcaacgcgtgtttaaagagaaggttgacacaagaacccctaaagcgaagcggggcaccgcccagatcatggaagtgacagctaagtggctgtgggggttcctcagcagaaacaaaaagccgcggatctgtacgcgcgaggaatttaccagaaaagtccggtccaatgccgctattggagccgtgttcgttgacgagaaccagtggaactctgccaaggaggcggtggaagatgagcgcttttgggacctggtccatagagaacgggagcttcacaaacaaggcaagtgcgctacatgcgtgtacaacatgatggggaagcgcgagaaaaagctgggagagttcggcaaagccaaggggagcagagccatctggtacatgtggctcggcgctcggttcctggagtttgaagccctgggattcatgaatgaggatcactggttttcccgcgaaaactctctcagcggcgtcgagggggagggactgcataaacttggctatattctgagagacatctccaagattcccgggggaaatatgtacgctgatgacaccgccggctgggatacacggatcaccgaagacgatctccagaacgaggcgaaaatcacagacattatggaacctgagcacgccctgcttgctaagtctatcttcaagctgacctatcagaataaagtggttcgcgtgcagagacccgccaagaacgggacggtcatggatgtgattagccggcgcgaccaaagaggctccggacaggtgggcacctacgggctcaatacatttaccaacatggaagctcagctgatccggcagatggagagcgagggaattttctctccttccgaactggagacacccaacctcgccggcagagttctggattggcttgaaaaacatggggtggagcgcctgaagcggatggcgatcagcggagacgactgtgtcgtgaaaccgatcgatgacagatttgccaccgctctcacggccctgaatgatatgggcaaggttcgcaaggacattcctcaatgggaaccctctaaagggtggaacgattggcaacaggtgcctttctgctcccaccactttcatcagcttatcatgaaggacggccgggagattgtcgtgccctgtagaaatcaagatgagctggtcggacgcgctcgggtgagccagggcgccgggtggtccctcagagaaacagcttgcctgggaaaatcttatgcccagatgtggcagctgatgtacttccaccgccgggacctcagactggcggccaacgctatctgtagcgccgttcctgtggattgggtccccacctcccgcacaacctggagcattcatgcccaccatcaatggatgacgaccgaggacatgctttctgtgtggaatcgggtttggatcgaagagaacccgtggatggaagataagacacacatttccagctggggcgacgtgccttatctggggaaaagagaggaccagtggtgcggatctctcatcggcctgaccgctcgggccacatgggcgaccaatatccaggtcgctattaaccaagtgagacgccttatcgggaatgagaactacctggattacatgacaagcatgaagcggtttaagaatgaatccgaccccgagggcgccctctggtga

SEQ ID NO: 19277 - RNA, 9879 nt, synthetic construct
  misc_feature 1..9879: note = derived and/or modified CDS sequence (opt5) from DENV-1__EU482808__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttactattgcgctggcctgaaaaaggttaccgaagtgaaaggctacaccaaagggggacccggccacgaggaacctatccccatggccacatacgggtggaacctcgtgaaactgcatagcggaaaggacgtcttctttacccctcccgagaagtgtgatacactgctctgcgacattggcgagtccagccctaatccgacgatcgaagaggggcggacccttagagtgctgaaaatggttgaaccctggctgcgcggaaaccagttctgtattaagatcctcaatccttatatgccctctgtggtcgagacactggagcaaatgcagcggaaacacggcggcatgcttgtgagaaaccctctgtcccgcaatagcacccatgaaatgtactgggtttcttgcgggacaggaaacattgtgtccgcggtcaatatgaccagccggatgctcctgaacagatttacgatggcccaccgcaagcccacctatgagcgggatgtggacctgggcgctgggacaagacacgtggccgtcgaaccggaggttgctaacctcgatatcatcggacagcgcattgaaaatatcaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttattcctatggtgacacagatcgccatgaccgatacgacacccttcggccaacagagagtctttaaggagaaagtggacacccggacccctaaggcgaagcgcggcacagcccagattatggaagttacggctaaatggctgtgggggttcctcagcagagacaagaaaccgcggatctgtaccagagaggaatttacacggaaggtgcgctccaacgccgctatcggagccgtcttcgtggatgagaatcaatggaactctgccaaagaggcggttgaagacgagagattttgggatctggtgcatcgggaacgcgagcttcacaagcagggcaagtgcgctacctgcgtctacaatatgatggggaaaagagaaaagaaactgggagagttcggcaaggccaaagggagccgggccatttggtacatgtggctcggcgctcgcttcctggagtttgaagccctgggattcatgaacgaggaccactggttttccagagaaaattctctcagcggcgtggagggggagggactgcataaacttggctatatcctgcgggatatttccaaaatccccgggggaaacatgtacgctgacgatacagccggctgggacacccgcattacagaagatgacctccagaatgaggcgaagatcaccgatatcatggaacctgagcacgccctgcttgctaagtctattttcaaactgacgtatcagaacaaggtcgtgagagttcaacggcccgccaaaaatgggaccgtgatggacgtcatcagccgcagagatcagcggggctccggacaggtgggcacatacgggctcaacacctttacaaatatggaagctcagctgattcgccaaatggagagcgagggaatcttctctccttccgaactggagacccccaacctcgccggcagagtgctggactggcttgaaaagcatggggttgagcggctgaaaagaatggcgattagcggagacgattgtgtggtcaagccgatcgacgatcgctttgccacggctctcacagccctgaacgacatgggcaaggtgcggaaagatatccctcagtgggaaccctctaaggggtggaatgactggcagcaggttcctttctgctcccaccactttcatcaacttattatgaaagatggcagagagatcgtggtcccctgtcgcaaccaggacgagctggtgggacgggctagagtcagccagggcgccgggtggtccctccgcgaaaccgcttgcctgggaaagtcttatgcccagatgtggcaactgatgtacttccaccggagagatctccgcctggcggccaatgctatttgtagcgccgtgcctgttgactgggtgcccacatcccggaccacgtggagcatccatgcccaccatcagtggatgaccacagaggatatgctttctgtctggaacagagtgtggattgaagagaatccgtggatggaagacaaaacccacatctccagctggggcgacgttccttatctggggaagcgcgaggatcagtggtgcggatctctcattggcctgacagctcgggccacctgggcgacaaacatccaagtggctatcaatcaggtcagacggcttattgggaacgagaattacctggactacatgaccagcatgaagagatttaaaaacgaatccgatcccgagggcgccctctggtga

SEQ ID NO: 19278 - RNA, 9879 nt, synthetic construct
  misc_feature 1..9879: note = derived and/or modified CDS sequence (opt5) from DENV-1__EU482809__SS-prME
  source 1..9879: mol_type = other RNA
agcgtgaccatgctgctgatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaagccatcagctttgggctacactgctctctctgaccttcatcagaacaaccttttccctgcactatgcctggaaaacgatggctatggttcttagcattgtgtctctgttccccctctgtctgtccacaaccagccagaagaccacatggctccctgtgctgcttgggtctctgggatgcaagccgctgaccatgtttctcatcgccgagaataaaatttggggccggaagtcctggcccctgaacgaaggcatcatggcggtcgggatcgtgagcattcttctgtccagcctcctgaaaaacgatgttcctctcgccggacccctgatcgctggcgggatgcttattgcctgttacgtgatctctggaagctccgctgacctgtctctggagaaggccgccgaggtcagctgggaagaggaagctgagcattccggcgcgtctcacaatattctcgtggaagttcaggatgacgggacaatgaaaatcaaggatgaggagcgcgacgatacgctgaccatccttctgaaagccacactcctggctgtgagcggagtctatcctctctccattcccgccaccctgttcgtgtggtacttctggcaaaagaagaaacagagatctggcgtcctttgggacacaccttcccctcccgaagtggagcgggccgttctggatgacggcatctatcgcattatgcagagagggctgctcggacggtcccaggtgggcgtcggggtgtttcaagaaaacgttttccataccatgtggcacgtgacgcgcggagctgtcctgatgtaccagggcaagagacttgagcccagctgggcctctgtgaaaaaggacctgatctcctacgggggaggctggcggctccagggcagctggaataccggggaggaagtgcaggttattgcggtcgagcccggcaagaatcctaagaatgtgcaaacagctcccggcacctttaagacatctgaaggggaggtgggagccatcgccctggatttcaaaccgggcacctccgggagccctattgtcaacagagaaggaaagatcgtgggcctctatggcaatggggttgtgacaacgtccggaacctacgtctctgctatcgcccaggcgaaagctagccaggagggccccctgcctgagattgaagacgaggtgtttcgcaagcggaaccttacaatcatggatctgcaccccgggtccggaaaaaccagacgctatctgcccgccattgttcgggaagccatcaagagacgcctccggaccctgattcttgctcctacaagagtggtcgccagcgagatggctgaagccctgaagggcatgccgatccgctaccaaacgaccgcggtgaaatctgagcatacagggaaggagatcgttgacctcatgtgccacgccaccttcacaatgcggctgctgtcccccgtgagagtccctaattataacatgattatcatggatgaagctcattttaccgaccccagctctattgccgctcggggctacatcagcacgcgcgtgggaatgggcgaggccgccgctattttcatgacagcgacccctcccgggtccgtggaagcctttcctcagtctaatgctgtcatccaggatgaggaaagagacatcccggagcggagctggaactccggatatgagtggattaccgatttccccggcaaaacagtttggtttgtgccttctatcaagagcgggaatgacattgccaactgtctccgcaaaaatggaaagagagtgatccagctttcccggaagaccttcgatacagaataccagaagaccaagaacaacgactgggactacgtcgtgacgacagatattagcgagatgggcgccaatttcagagctgaccgcgttatcgatccccggagatgcctgaaacctgtgattctgaaggacgggcccgaacgcgtcatcctcgccggcccgatgcctgtgaccgttgcgtctgctgcccagcggagaggacgcatcggccggaaccacaataaagagggggatcagtatatttacatgggacagcccctgaacaatgacgaggatcatgcccactggacagaagctaagatgcttctggacaacatcaatacccccgagggcattatccctgccctctttgaacccgagagagaaaagtccgcggccattgatggggagtatcgcctgagaggagaggctcggaaaacgttcgtggaactgatgcgcagaggcgacctccctgtctggcttagctacaaggtggcctccgaggggtttcaatattctgatcggcgctggtgcttcgacggcgaaagaaacaatcaggtcctggaggaaaacatggatgtggagatctggaccaaagagggagaacggaagaaactgagaccgcgctggctcgacgctcggacatacagcgaccccctggcccttagagagtttaaggagttcgctgccggccgccggtccgtttctggggatctgatcctcgagattggaaaactgcctcagcacctgacccagagagcgcaaaatgccctcgacaaccttgtgatgctgcataatagcgaacagggcgggcgggcttatcgccacgccatggaggagctgcccgatacaatcgaaaccctcatgctgcttgctctgattgccgtgctcacaggaggcgtcaccctgtttttcctgtccggcagagggctcggaaagacgagcatcggccttctgtgtgttatggcctcttccgtgctgctctggatggctagcgtggagcctcattggattgcggcctctatcatcctggaatttttccttatggtcctgctcattcccgagccggaccggcagcgcacacctcaggataaccaactggcttacgtggttatcgggctgctctttatgattcttaccgtggccgccaatgagatgggactgctggaaaccacaaagaaagacctcggcatcgggcacgtcgctgtggagaaccaccatcacgccgcgatgctggatgtcgaccttcatcccgcctccgcttggaccctgtacgccgtggctacaacgattatcacccctatgatgagacacacaattgaaaacaccacagccaatatcagcctcaccgcgatcgccaaccaggctgccattctgatgggactggataagggctggcccatctctaaaatggacattggcgttcctctccttgctctggggtgctatagccaggtgaatcccctgacgctcaccgccgctgtcctgatgcttgtggcccattacgcgatcattggaccgggcctgcaagccaaggctacacgggaggcccagaaacgcaccgctgccgggatcatgaagaaccctacagttgatggaatcgtggccattgacctcgatcccgtcgtgtatgacgcgaagttcgaaaaacagctgggccagatcatgctgctcattctttgtacctcccaaatcctgctgatgagaacgacatgggctctctgcgagtctattaccctggccacagggccccttaccaccctgtgggagggaagccctggcaagttttggaatacaacgatcgctgtgtccatggccaacatcttccggggcagctacctcgccggggctggactggccttctccctgatgaaatctctcggcgggggacgcagaggcaccggggcgcagggagaaacacttggcgagaagtggaaacggcagctgaatcagctgagcaagtccgaatttaacacctataagagatctggcattatggaggttgaccgcagcgaagccaaagaggggctcaagcggggagagacaaccaaacacgctgtctccagaggcacggccaagctgcgctggttcgtggaacggaatcttgtgaaaccggaggggaaggtcatcgatctgggatgtggcagagggggatggtcttactattgcgctggcctcaagaaagttacagaagtgaagggctacaccaaagggggacccggccacgaggaacctattcccatggccacctacgggtggaacctggtgaagctgcatagcggaaaagacgtctttttcatccctcccgagaagtgtgatacactcctttgcgacattggcgagtccagccctaatccgaccatcgaagaggggcgcacactgcgggtgctgaaaatggttgaaccctggctcagaggaaaccaattttgtattaagatcctgaatccttatatgccctctgtggtcgagacgcttgagcagatgcagcgcaagcacggcggcatgctggtgcggaaccctctctccagaaatagcacccatgaaatgtactgggtttcttgcgggacaggaaacatcgtgtccgcggtcaatatgaccagccgcatgctgctgaaccggttcacaatggcccacagaaaacccacctatgagcgcgatgtggacctcggcgctgggacgagacacgtggccgtcgaaccggaggttgctaacctggatattatcggacagcggattgaaaatatcaagcatgagcacaaatctacctggcattacgacgaggataacccttataagacatgggcctaccacggctcctatgaagtgaaacccagcgggtccgctagctctatggtgaatggagtcgtgaaacttctgaccaagccctgggacgttattcctatggtgacacaaatcgccatgaccgatacaaccccctttggccagcagcgcgtcttcaaagagaaggtggacacgagaacacctaaagcgaagcggggcaccgcccaaatcatggaagttaccgctaaatggctctgggggtttctgagcagaaacaagaagccgcggatttgtacacgcgaggagttcacgagaaaagtgcggtccaatgccgctatcggagccgtctttgtggacgagaaccagtggaactctgccaaggaggcggttgaagatgagcgcttctgggaccttgtgcatagagaacgggagctgcacaaacagggcaagtgcgctacctgcgtctacaacatgatggggaaacgcgaaaagaagctcggagagtttggcaaagccaaggggagcagagccatttggtacatgtggctgggcgctcggttcctggagttcgaagccctcggatttatgaatgaggatcactggttctcccgcgaaaactctctgagcggcgtggagggggagggacttcataaactgggctatatcctcagagacatttccaagatccccgggggaaatatgtacgctgatgacacagccggctgggatacccggatcacagaagacgatctgcagaacgaggcgaaaattaccgacatcatggaacctgagcacgcccttctggctaagtctatttttaaactcacatatcaaaataaggtcgtgcgcgttcagagacccgccaagaacgggaccgtgatggatgtcatcagccggcgcgaccagagaggctccggacaggtgggcacgtacgggctgaataccttcacaaacatggaagctcaactgattcggcagatggagagcgagggaatcttttctccttccgaactcgagacccccaacctggccggcagagtgcttgattggctggaaaaacatggggttgagcgcctcaagcggatggcgatcagcggagacgactgtgtggtcaaaccgattgatgacagattcgccacagctctgaccgcccttaatgatatgggcaaggtgcgcaaagacatccctcagtgggaaccctctaaggggtggaacgattggcagcaagttcctttttgctcccaccacttccatcagctgattatgaaggacggccgggagatcgtggtcccctgtagaaatcaggatgagctcgtgggacgcgctcgggtcagccagggcgccgggtggtccctgagagaaacggcttgcctgggaaaatcttatgcccaaatgtggcagctcatgtactttcaccgccgggacctgagacttgcggccaacgctatttgtagcgccgtgcctgttgattgggtgcccacatcccgcaccacatggagcatccatgcccaccatcagtggatgaccacggaggacatgctgtctgtctggaatcgggtgtggattgaagagaacccgtggatggaagataagacccacgtttccagctggggcgacgtgccttatctcgggaaaagagaggaccaatggtgcggatctctgatcggccttacagctcgggccacctgggcgacaaatatccaggtcgctattaaccaggtgagacgcctgctcgggaatgagaactacctggattacatgaccagcatgaagcggttcaaaaatgaatccgaccccgagggcgccctgtggtga

SEQ ID NO: 19279 - RNA, 9879 nt, synthetic construct
  misc_feature 1..9879: note = derived and/or modified CDS sequence (opt5) from DENV-1__EU482810__SS-prME
  source 1..9879: mol_type = other RNA
agcgtgacaatgctgctgatgctgatgcccacagcccttgctttccacctgacgacccggggaggggagcctcatatgatcgtctccaagcaggaacgggggaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcagatgtgcgaccaccggcttatgtctgccgctattaaagattccaaggccgttcacgccgacatgggctactggatcgaaagcgagaaaaatgaaacatggaagctcgctagagcctctttcatcgaggtgaagacctgtatttggcccaaatcccatacactgtggagcaacggggtgctggaatctgagatgatcattccgaagatctatggaggccctattagccaacacaattaccgccccgggtacttcacccagacagcgggaccttggcatctcggcaaactggagcttgattttgacctgtgcgaagggaccacggtcgtggttgatgagcactgcggaaaccggggcccctccctcagaaccacaaccgtgacaggcaagatcatccacgaatggtgttgccggagctgtaccctgcctcccctgcgcttcaaaggggaggacggatgctggtatggcatggagattagaccggtcaaggaaaaggaggaaaatcttgtgaaatctatggtttccgctgggagcggagaggtggactccttttctctcggcctgctgtgtatcagcattatgatcgaagaggtcatgcggtccagatggtctcgcaagatgctcatgacggggacactggccgtgttctttcttctgattatgggacagctcacctggaacgatctgatccggctgtgcattatggttggcgccaatgctagcgacagaatgggcatggggacaacctaccttgccctgatggcgaccttcaaaatgcgccctatgtttgctgtgggactcctgttcagacggctcacatcccgcgaggtcctgcttctgacgatcggcctctctctggtggccagcgtggaactgcccaactcccttgaggaactgggggatggactcgccatgggcatcatgattctgaagctcctgaccgactttcaaagccatcagctttgggctacactgctctctatgaccttcatcagaacaaccttttccctgcactatgcctggaaaacgatggctatggtcctgagcattgtttctcttttccccctgtgtctctccacaaccagccagaagaccacatggctgcctgtgctcctggggtctcttggatgcaagccgctgaccatgtttctgatcgccgagaataaaatttggggccggaagtcctggcccctcaacgaaggcatcatggcggtggggatcgtcagcattctgctttccagcctgctcaaaaacgatgtgcctctggccggacccctcatcgctggcgggatgctgattgcctgttacgttatctctggaagctccgctgacctttctctggagaaggccgccgaggtgagctgggaagaggaagctgagcattccggcgcgtctcacaatattctggtcgaagtgcaggatgacgggacaatgaaaatcaaggatgaggagcgcgacgatacgctcaccatcctgcttaaagccacactgctcgctgttagcggagtgtatcctctgtccattcccgccaccctcttcgtctggtacttctggcaaaagaagaaacagagatctggcgtgctgtgggacacaccttcccctcccgaagtccagcgggccgtgcttgatgacggcatctatcgcattatgcagagagggctgctgggacggtcccaagttggcgtgggggtctttcaggagaacgtgttccataccatgtggcacgttacgcgcggagctgtgctcatgtaccagggcaagagactggaacccagctgggcctctgtcaaaaaggaccttatctcctacgggggaggctggcggctgcagggcagctggaataccggggaggaggtgcaagtgattgcggttgaacccggcaagaaccctaagaatgtccagacagctcccggcacctttaagacatctgagggggaagtgggagccatcgccctcgatttcaaaccgggcacctccgggagccctattgtgaacagagagggaaagatcgtcggcctgtatggcaatggggtggttacaacgtccggaacctacgtgtctgctatcgcccaggcgaaagctagccaagaaggccccctccctgagattgaggacgaagtctttcgcaagcggaacctgacaatcatggatcttcaccccgggtccggaaaaaccagacgctatctgcccgccattgtgcgggaggccatcaagagaaagctgcgcaccctcattctggctcctacacgggttgtggccagcgaaatggctgaggcccttaaaggcatgccgatcagataccagacgaccgcggtcaagtctgaacatacagggaaagagatcgtggacctgatgtgccacgccaccttcacaatgcgcctcctgtcccccgttcgggtgcctaattataacatgattatcatggatgaggctcattttaccgaccccagctctattgccgctagaggctacatcagcacgcgggtcggaatgggcgaagccgccgctattttcatgacagcgacccctcccgggtccgtggaggcctttcctcagtctaatgctgtgatccaggatgaagaaagagacatcccggaaagaagctggaactccggatatgagtggattaccgatttccccggcaagacagtctggtttgttccttctatcaaaagcgggaatgacattgccaactgtctgcggaagaatggaaagcgcgtgatccaactctccagaaaaaccttcgatacagagtaccagaagaccaaaaacaacgactgggactacgtggtcacgacagatattagcgaaatgggcgccaatttccgggctgacagagtgatcgatccccgccggtgccttaagcctgttattctgaaagacgggcccgagagagtgatcctggccggcccgatgcctgtcaccgtggcgtctgctgcccagcgccggggaagaatcggccgcaaccacaataaggaaggggatcagtatatttacatgggacaacccctcaacaatgacgaggatcatgcccactggacagaggctaagatgctgcttgacaacatcaatacccccgaaggcattatccctgccctgtttgagcccgaacgggagaaatccgcggccattgatggggaatatagactccgcggagaggctagaaagacgttcgttgagctgatgcggcgcggcgacctgcctgtgtggctcagccacaaagtcgcctccgaagggtttcagtactctgatagacggtggtgcttcgacggcgagcgcaacaatcaggtgcttgaagagaacatggatgtcgaaatctggaccaaggagggagagcgcaagaagctgcggccgagatggctggacgctcgcacatatagcgaccccctcgccctgcgggaatttaaagagttcgctgccggcagacgctccgtgtctggggatcttatcctggaaattggaaagctccctcagcatctgacccaacgggcgcagaatgccctggacaacctcgttatgcttcacaatagcgagcagggcgggagagcttaccggcatgccatggaggaactgcccgatacaatcgagaccctgatgctcctggctcttattgccgtgctgacaggaggcgtgaccctctttttcctgtccggccgcgggctgggaaagacgagcatcggcctcctttgtgtcatggcctcttccgttctgctgtggatggctagcgtggaacctcactggattgcggcctctatcatcctcgagtttttcctgatggtgcttctgattcccgaaccggacagacagcggacacctcaagataaccagctcgcttatgtcgtgatcgggctgctgtttatgattctcaccgttgccgccaatgagatgggacttctggagaccaccaaaaaggacctgggcatcgggcacgtggctgtcgaaaaccatcaccatgccgcgatgctcgatgtggacctgcaccccgcctccgcttggaccctttacgccgtcgctacaacgattatcacccctatgatgcgccatacaattgagaacaccacagccaatatcagcctgaccgcgatcgccaaccaggctgccattctcatgggactggataaaggctggcccatctctaagatggacattggcgtgcctctgctcgctcttgggtgctacagccaagttaatcccctgacgctgaccgccgctgtgctcatgctggtcgcccactatgcgatcattggaccgggccttcaggccaaagctacaagagaagcccagaagcggaccgctgccgggatcatgaagaaccctacagtggatggaatcgttgccattgacctggatcccgtggtctacgacgcgaaattcgagaagcagctcggccaaatcatgctgctgattctctgtacctcccagatccttctgatgcgcacgacatgggctctgtgcgaatctattaccctcgccacagggcccctgaccaccctttgggagggaagccctggcaaattttggaatacaacgatcgctgtgtccatggccaacatcttcagaggcagctatctggccggggctggactcgccttctccctgatgaagtctctgggcgggagccggcgcggaaccggcgcgcagggggagacactcggagaaaaatggaagagacagcttaatcaactgtccaagtctgagtttaacacctacaaacggagcggcattatggaagtggacagatccgaggccaaggaaggcctgaaacgcggggagacaaccaagcacgctgtttctcggggaacggccaaactcagatggttcgtcgagcgcaatctggtgaagccggaaggcaaggtgatcgatcttgggtgtggacggggcgggtggagctattactgcgctggactgaaaaaggtcacagaggttaaaggctataccaagggcgggcccggacatgaggagcctattcccatggccacctacggctggaacctcgtgaaactgcactccgggaaggacgtgtttttcatccctcccgaaaaatgtgatacactgctctgcgacattggagagagctctcctaatccgaccatcgaggaaggcagaacacttcgcgtcctgaagatggtggagccctggctgcgggggaaccagttttgtattaagatcctcaatccttacatgccctccgttgtggaaacgctggagcagatgcagagaaaacatggaggcatgcttgtccgcaaccctctgagcagaaattctacccacgagatgtattgggtgtcctgcggcacagggaacatcgttagcgcggtgaatatgacctctagaatgctcctgaaccgcttcacaatggcccaccggaagcccacctacgaaagagatgtcgacctgggagctggcacgcgccatgtggccgtggagccggaagtcgctaacctcgatattatcgggcaaagaattgagaatatcaaacacgaacataagtccacctggcactatgacgaggataacccttacaaaacatgggcctatcatggaagctacgaggttaagccctccggcagcgcttctagcatggtgaatggggtggtcaagctgcttaccaaaccctgggacgtgattcctatggttacacagatcgccatgaccgatacaaccccctttggacagcaacgggtgttcaaggaaaaagtcgacacgcgcacacctaaggcgaaaagaggcaccgcccagatcatggaggtgaccgctaagtggctgtggggctttctctcccggaacaagaaaccgagaatttgtacacgggaagagttcacgcgcaaggttagatctaatgccgctatcggggccgtgtttgtcgacgaaaaccagtggaatagcgccaaagaggcggtggaggatgaacggttctgggacctggttcaccgcgagagagaacttcacaagcagggaaaatgcgctacctgcgtgtataacatgatgggcaagcgggagaagaaactgggggaatttggaaaggccaaaggctcccgcgccatttggtacatgtggctcggggctagattcctggagttcgaggccctgggctttatgaatgaagatcattggttctctcgggagaacagcctctccggagtcgaaggcgaggggctgcacaaacttggatacatcctgcgcgacatttctaaaatccccggcgggaatatgtatgctgatgacacagccggatgggataccagaatcacagaggacgatctccaaaacgaagcgaagattaccgacatcatggagcctgaacatgccctgcttgctaaaagcatttttaagctgacataccagaataaggtggtccgggtgcagcgccccgccaaaaacggcaccgttatggatgtgatctccagacgggaccagcgcgggagcggccaagtcggaacgtatggcctcaataccttcacaaacatggaggctcagctgattagacagatggaatctgaggggatcttttcccctagcgagctggatacccccaacctcgccggacgggtgctggactggcttgaaaagcacggcgtggagagactgaaacgcatggcgatctctggggacgattgtgttgtgaagccgattgacgatcggttcgccacagctctcaccgccctgaatgacatgggaaaagtcagaaaggatatccctcagtgggaaccctccaagggctggaacgactggcaacaggtgcctttttgcagccaccatttccaccagcttattatgaaagatgggcgcgagatcgttgtgccctgtcggaatcaggacgaactggtcggcagagctcgcgtgtcccaaggagccggctggtctctccgggagacggcttgcctgggaaagagctacgcccagatgtggcagctgatgtattttcatagacgcgatctccggctggcggccaacgctatttgttccgccgtccctgtggactgggttcccacaagcagaaccacatggtctatccacgcccatcaccaatggatgaccacggaggatatgctttccgtgtggaatcgcgtctggattgaagagaacccgtggatggaagacaaaacccacatcagctcttggggagacgtgccttacctgggcaagcgggaggatcagtggtgcgggagcctcatcggactgacagctagagccacctgggcgacaaatattcaggttgctatcaaccaggtgcggagacttctgggcaatgaaaactatctcgactacatgacctccatgaaacgcttcaagaatgagtctgggcccgagggcgccctgtggtga

SEQ ID NO: 19280 - RNA, 9879 nt, synthetic construct
  misc_feature 1..9879: note = derived and/or modified CDS sequence (opt5) from DENV-1__EU482811__SS-prME
  source 1..9879: mol_type = other RNA
agcgtgaccatgctgctcatgctgatgcccacggcccttgctttccacctgacgaccagaggaggggagcctcatatgatcgtctccaagcaggaacggggaaaatctctcctgtttaagaccagcgccggagttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgactccggatgcgttatcaactggaaaggccgcgagctgaagtgtgggagcggaattttcgtgaccaatgaagtccacacatggaccgagcaatataagtttcaggccgattcccctaaacggctctctgcggccatcggcaaggcttgggaggaaggggtgtgcggcattagaagcgccacgcgcctggagaacatcatgtggaaacagatctccaacgaacttaatcatattctgctcgagaacgacatgaagttcacagttgtggtcggagacgtggctggcatcctggtgcaggggaaaaagatgattcggccgcaacccatggaatacaaatattcttggaaaagctggggaaaggccaaaatcattggcgccgatgtccaaaattccacctttatcatcgacgggcctaacacccccgagtgtcctgatgaccagagagcttggaatatttgggaggttgaagattacggattcggcatctttacaaccaacatttggctgaaacttcgcgacagctatacacaggtgtgcgatcaccggctcatgtctgcggccatcaaagactccaaggctgtgcacgccgatatgggctactggattgagagcgagaagaatgagacatggaagctggccagagcttctttcatcgaagtcaagacctgtatctggcccaaatcccatacactgtggagcaacggggtgctcgagtctgagatgattatcccgaagattcacggaggccctatcagccaacataattatcgccccgggtacttcacccagacagccggaccttggcacctgggcaaacttgaactggactttgatctctgcgaggggaccacggttgtggtcgacgaacactgcggaaaccggggcccctccctgagaaccacaaccgtgacaggcaagattatccatgagtggtgttgccggagctgtaccctgcctccccttcgcttcagaggggaggatggatgctggtacggcatggaaatccggccggttaaagagaaggaagagaatctcgtgaagtctatggtctccgcggggagcggagaagtggactccttttctctgggcctgctctgtattagcatcatgattgaggaggttatgagatcccgctggtctcggaaaatgctgatgacggggacacttgctgtgttctttctgctcatcatgggacagctgacctggaacgacctgattagactttgcatcatggtcggcgccaatgccagcgatcgcatgggcatggggacaacctatctggctctcatggccaccttcaagatgagacctatgtttgcggtgggactgctgttccggcgcctgacatccagagaagtgcttctgctcacgattggcctgtctctggtcgctagcgttgagcttcccaactccctggaagaactcggggacggactggccatgggcatcatgatcctcaaactgcttaccgattttcaaagctaccagctgtgggccacactcctgtctctgaccttcattaagacaaccttttcccttcactatgcttggaaaacgatggccatggtgctgagcatcgtgtctctcttccccctgtgtctctccacaaccagccagaagaccacatggctgcctgtccttctggggtctctgggatgcaagccgctcaccatgtttctgattgctgaaaataaaatctggggccggaagtcctggccccttaacgagggcattatggccgtggggatcgttagcatcctgctctccagcctgctcaaaaacgacgtgcctctggcgggaccccttattgccggcgggatgctgatcgcttgttacgtcatttctggaagctccgccgatctgtctctcgagaaggctgccgaagtgagctgggaggaagaggccgaacattccggcgcttctcacaatatcctggttgaggtgcaggacgatgggacaatgaaaattaaggacgaggaacgcgatgacacgcttaccatcctgctcaaagcgacactgctcgccgtcagcggagtgtatcctctgtccatccccgctacccttttcgtctggcatttctggcaaaagaagaaacagagatctggcgtgctgtgggatacacctagccctcccgaggttgaacgggccgtgctggacgatggcatttaccgcatcatgcagagagggctcctgggacggtcccaggtcggcgtgggggtttttcaagagaacgtgttccacaccatgtggcacgtcacgcgcggagccgtgcttatgtatcagggcaagagactggagcccagctgggcttctgtgaaaaaggacctcatttcctacgggggaggctggcggctgcagggcagctggaataccggggaagaggttcaggtcatcgccgtggaacccggcaagaaccctaagaatgtgcaaacagcgcccggcacctttaagacaccggagggggaagtcggagctattgccctcgacttcaaacctggcacctctgggtcccccatcgtgaacagagagggaaagattgttggcctgtacggcaatggggtggtcacaacgagcggaacctatgtgtccgccatcgctcaggccaaagcgtctcaggagggccctcttcccgaaatcgaggatgaagtttttcgcaagcggaacctgacaattatggacctgcatcccgggagcggaaaaaccagacgctacctccctgctatcgtgcgggaggccattaagagaaagctgcgcacccttatcctggccccgacacgggtcgtggcttccgaaatggccgaggctctcaaaggcatgcccattagatatcaaacgaccgccgttaagagcgagcacacagggaaagaaatcgtggatctgatgtgccatgcgaccttcacaatgcgcctgctctctcctgtccgggtgcccaattacaacatgatcattatggacgaggcccactttaccgatccttccagcatcgctgccagaggctatatttctacgcgggtgggaatgggcgaagctgccgccatcttcatgacagctacaccccctgggagcatggaggcgtttccgcagtccaatgccgtcattcaggacgaagaaagagatatccccgagagatcttggaacagcggatacgaatggatcaccgacttccctggcaagacagtttggtttgtgccctccattaaagctgggaatgatatcgccaactgtcttcggaagaatggaaagcgcgtgattcagctgtctagaaaaaccttcgacacagagtatcaaaagaccaaaaacaacgattgggactacgtcgtgacgacagacatcagcgaaatgggcgccaatttccgggctgatagagttattgaccctcgccggtgcctgaagcccgtgatcctcaaagatgggccggagagagtcattctggccggccctatgcccgtgaccgttgcgtccgctgcccagcgccggggaagaatcggccgcaaccataataaggagggggaccagtacatctatatgggacagccccttaacaatgatgaagaccacgcccactggacagaggctaagatgctgctcgataacattaatacccctgaaggcatcattcccgccctgtttgagcctgaacgggagaaaagcgcggccatcgacggggagtacagactgcgcggagaagctagaaagacgttcgtggagctcatgcggcgcggcgatcttccggtctggctgtcttataaagtggcctccgaagggtttcaatacagcgacagacggtggtgcttcgatggcgagcgcaacaatcaggtcctggaagagaacatggacgtggagatttggaccaaggaaggagagcgcaagaagctccggcccagatggctggatgctcgcacatattccgaccctcttgccctgcgggaatttaaagagttcgctgccggcagacgctctgttagcggggacctcatcctggaaatcggaaagctgccccagcatctcacccagcgggcgcaaaatgcccttgataacctggtgatgctgcacaattccgagcagggcgggagagcttaccggcatgccatggaggaactccctgacacaattgagaccctgatgcttctggctctcatcgccgtgctgacaggaggcgtcaccctgtttttcctctctggcaaggggcttggaaaaacgagcattggcctgctgtgtgttatggcctccagcgtgctcctgtggatggcttctgtggaaccccactggatcgcggcctccattatccttgagtttttcctgatggtcctcctgatcccggagcctgatcgccagagaacaccccaggacaaccaactggcttatgtggttattgggctcctttttatgatcctgaccgtggccgccaatgaaatgggactgctcgagaccacaaagaaagatctgggcattgggcacgtcgctgtggaaaaccatcaccatgccgcgatgcttgacgtcgatctgcaccctgccagcgcttggaccctctacgccgtggctacaacgatcattacccccatgatgcggcatacaatcgagaacaccacagccaatatttctctgaccgcgatcgccaaccaggctgccatcctgatgggactcgacaagggctggcctatttccaaaatggatatcggcgttccccttctggctctggggtgctacagccaggtgaatccgctcacgctgaccgccgctgtccttatgctggtggcccactatgcgattatcggacctggcctccaagccaaggctacacgcgaagcccagaagagaaccgctgccgggattatgaaaaaccccacaatcgacggaatcgttgccattgatctggaccccgtggtctacgatgcgaagttcgagaaacagctgggccagatcatgctccttattctgtgtacctctcaaatcctgctcatgcggacgacatgggctctgtgcgagagcattacccttgccacagggcctctgaccaccctctgggaaggatccccgggcaagttttggaatacaacgatcgctgtgtctatggccaacatcttccgcggcagctatctggccggggctggactggccttctccctcatgaaaagccttggcgggggaagacggggcaccggggcgcagggagagacactgggcgaaaagtggaagcgccagctgaatcagctctccaaatctgagtttaacacctacaagagaagcggcattatggaagtggaccggtccgaggccaaagaggggctgaagagaggagaaacaaccaaacacgctgtttctcgcggcacggccaaacttcggtggttcgtcgagagaaatctggtgaagcccgaagggaaagtgatcgacctcggatgtggccgcgggggatggagctattactgcgctggcctgaagaaagtcacagaggttaagggctataccaaagggggacctggccatgaggagcccattcctatggccacctacgggtggaacctggtgaagctccactccggaaaagatgtgtttttcattccccctgagaagtgtgacacacttctgtgcgatatcggcgaatctagcccgaatcccaccatcgaggaagggcggacactgagagtcctcaagatggtggagccttggctgcgcggaaaccaattttgtattaaaatccttaatccctacatgccttccgttgtggagacgctggaacagatgcagcggaagcatggcggcatgctcgtcagaaaccccctgagccgcaattctacccacgagatgtattgggtgtcctgcgggacaggaaacatcgttagcgcggtgaatatgacctctcggatgctgctcaacagattcacaatggcccaccgcaaaccgacctacgaacgggacgtcgatctgggcgctgggacgagacatgtggccgtggagcctgaagtcgctaaccttgacattatcggacagcgcattgagaatatcaagcacgagcataaatccacctggcactatgatgaagacaacccctacaagacatgggcctatcatggcagctacgaggttaagccctctgggtccgctagctccatggtgaatggagtggtcaaactgctcaccaagccttgggatgtgattcccatggttacacaaatcgccatgaccgacacaaccccttttggccagcagagagtgttcaaagaaaaggtcgatacgcggacaccgaaagcgaagcgcggcaccgcccaaatcatggaggtgaccgctagatggctgtgggggtttcttagccggaacaagaaacccagaatttgtacacgggaagagttcacgcgcaaggttagatctaatgccgctatcggagccgtgtttgtcgacgagaaccagtggaatagcgccaaagaagcggtggaggacgatcggttctgggacctggttcaccgcgaaagagagctccacaagcagggcaaatgcgctacctgcgtgtataacatgatggggaagcgggaaaagaaactgggagagtttggcaaggccaaagggtcccgcgccatttggtacatgtggctgggcgctagattcctcgagttcgaagccctgggatttatgaatgaggatcattggttctctcgggaaaacagcctttccggcgtcgagggggagggactgcacaagctcggctacatcctgcgcgacatttctaaaatccctgggggaaatatgtatgctgatgacacagccggctgggataccagaatcacagaagacgatcttcagaacgaggcgaagattaccgacatcatggaacccgagcatgccctgctcgctaaaagcatttttaagctgacataccaaaataaggtggtccgggtgcagcgccctgccaaaaacgggaccgttatggatgtgatctccagacgggaccagcgcggctctggacaggtcggcacgtatgggctgaataccttcacaaacatggaagctcaactcattagacagatggagagcgagggaatctttctgcccaacgaacttgagaccccgaatctggccggccgggtgctcgattggctggaaaagtacggggtggagagacttaaacgcatggcgatctccggagacgactgtgttgtgaagcctattgatgaccggttcgccacagctctgaccgccctcaacgatatgggcaaagtcagaaaggacatcccccagtgggaacctagcaaggggtggaatgattggcagcaagtgcccttttgctctcaccacttccatcagctgattatgaaagacggccgcgagatcgttgtgccttgtcggaaccaggatgagctggtcggcagagctcgcgtgtcccagggcgccgggtggagcctccgggaaacggcttgcctgggaaagtcttatgcccaaatgtggcagcttatgtactttcacagacgcgacctgcggctcgcggccaatgctatttgttccgccgtccccgtggattgggttccgacaagcagaaccacatggtccatccatgcccaccatcagtggatgaccacggaggacatgctgtctgtgtggaaccgcgtctggattgaagagaatccttggatggaagataaaacccggatcagctcctgggaggacgtgccctatcttggcaagagagaggaccaatggtgcgggagcctgatcggactcacagctcgggccacctgggcgacaaacattcaggttgctatcaatcaggtgagacgcctgattggcaacgaaaattactctgattacatgacctccatgaaacggttcaagaacgagagcgaacccgagggggccctgtggtga

SEQ ID NO: 19281 - RNA, 9879 nt, synthetic construct
  misc_feature 1..9879: note = derived and/or modified CDS sequence (opt5) from DENV-1__EU482812__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggcgacgcagaacggacggctgatcaccgctaatcccattgtgacagacaaagagaagcctgtcaacatcgaagccgagccgccctttggcgagagctatattgtgatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtgtttaccagcgttggcaaactggtccatcagattttcgggacggcttacggagtgctcttttccggcgtgagctggaccatgaagatcgggattggcgtcctgcttacatggctgggactcaattctagatccaccagcctgtctatgacatgtatcgccgtgggcctggttaccctttacctcggggtgatggtccaggctgattccggatgcgtgattaactggaaaggccgcgaactgaagtgtgggagcggaatcttcgttacaaatgaggtgcacacctggacggaacaatataagtttcaggccgactcccctaaacggctgtctgcggccattggcaaggcttgggaggagggggtctgcggcatcagaagcgccacacgcctcgaaaacatcatgtggaaacagatttccaacgagctgaatcatatccttctggaaaacgacatgaagttcaccgtggttgtgggagatgtcgctggcattctcgcccaggggaaaaagatgatccggccgcaacccatggagtacaaatattcttggaaaagctggggaaaggccaagattatcggcgctgacgtgcagaataccacatttatcattgatgggcctaacacccccgaatgtcctgacgatcagagagcgtggaatatctgggaggtggaggactacggattcggcatttttacgacaaacatctggctgaagctgcgcgattcctatacccaggtctgcgaccaccggcttatgagcgccgctattaaagattctaaggccgttcacgccgacatgggctactggatcgaatccgagaaaaatgaaacatggaagctcgctagagccagcttcatcgaggtgaagacctgtatttggcccaaatctcatacactgtggtccaacggggtgctggaaagcgagatgatcattccgaagatctatggaggccctatttctcaacacaattaccgccccgggtacttcacccagacggcgggaccttggcatctcggcaaactggagcttgattttgacctgtgcgaagggaccacagtcgtggttgatgagcactgcggaaaccggggccccagcctcagaaccacaaccgtgacgggcaagatcatccacgaatggtgttgccggtcctgtacactgcctcccctgcgcttcagaggggaggacggatgctggtatggcatggagattcggccggtcaaagaaaaggaggaaaatcttgtcaagagcatggtttctgctgggtccggagaggtggacagcttttccctcggcctgctgtgtatctctattatgatcgaagaggtcatgagaagccgctggtcccggaaaatgctcatgaccgggacactggccgtgttctttcttctgattatgggacagctcacctggaacgatctgatcagactgtgcattatggttggcgccaatgcttctgaccgcatgggcatggggaccacataccttgccctgatggcgacgttcaagatgagacctatgtttgctgtgggactcctgttccggcgcctcaccagcagagaggtcctgcttctgacaatcggcctctccctggtggcctctgtggaactgcccaacagccttgaggaactgggggatggactcgccatgggcatcatgattctgaaactcctgaccgactttcaatcccatcagctttgggctacactgctcagcctgaccttcatcaagacgacattttctctgcactatgcctggaaaaccatggctatggtcctttccattgttagcctgttccccctctgtctgtctaccacatcccagaagaccacatggctccctgtgctgcttgggagcctgggatgcaagccgctgacgatgtttctcatcgccgagaataaaatttggggccggcgctcttggcccctgaacgaaggcatcatggcggtggggatcgtctccattcttctgagctccctcctgaagaacgatgtgcctctcgccggacccctgatcgctggcgggatgcttattgcctgttacgttatcagcggatctagcgctgacctgtccctggagaaagccgccgaggtgtcttgggaagaggaagctgagcatagcggcgcgtcccacaatattctcgtcgaagtgcaggatgacgggaccatgaagatcaaagatgaggagagagacgatacactgaccatccttctgaaggccacactcctggctgtttctggagtgtatcctctcagcattcccgccaccctgttcgtctggtacttctggcagaagaagaagcagcggtccggcgtgctttgggacacgccttctcccccggaagtcgagcgcgccgtgctggatgacggcatctatagaattatgcagcgggggctgctcggacgcagccaggttggcgtgggggtctttcaagaaaacgtgttccataccatgtggcacgttacaagaggagctgtgctgatgtaccagggcaaacggcttgagccttcctgggccagcgtcaagaaagacctgatctcttacgggggaggctggagactccagggctcctggaataccggggaggaagtccaggtgattgcggttgagcccggaaagaaccctaaaaatgtccaaacagctcccggcacctttaagacaccggaaggggaggtgggagccatcgccctggatttcaagcctggcacgagcgggtctcccattgtgaaccgcgaaggaaaaatcgtcggcctctatggcaatggggtggttaccacatccggaacctacgtgagcgctatcgcccaggcgaaggcttcccaggagggccctctgcccgagattgaagacgaggtctttcggaaaagaaaccttaccatcatggatctgcaccccgggtctggaaagacacgccggtatctgcctgccattgtgagagaagccatcaaacgcaagctccggacgctgattcttgctccgaccagagttgtggccagcgagatggctgaagccctgaagggcatgcccatccgctaccaaacaaccgcggtcaaatccgagcatacagggaaggagatcgtggacctcatgtgccacgccaccttcacgatgcggctgctgagccctgttagagtgcccaattataacatgattatcatggatgaagctcattttacagacccttcttccattgccgctcggggctacatcagcacccgcgtcggaatgggcgaggccgccgctattttcatgaccgcgacaccccctgggtctgtggaagcctttccgcagagcaatgctgtgatccaggatgaggaaagagacatccccgagcggtcctggaactctggatatgagtggattaccgatttccctggcaaaacagtctggtttgttcccagcatcaagtccgggaatgacattgccaactgtctccgcaaaaatggaaagagagtgatccagctttctcggaagaccttcgatacggaataccagaaaaccaagaacaacgactgggactacgtggtcaccacagatattagcgagatgggcgccaatttcagagctgaccgcgtgatcgatcctcggagatgcctgaaacccgttattctgaaggacgggccggaacgcgtgatcctcgccggccctatgcccgtcaccgtggcgtccgctgcccagcggagaggacgcatcggccggaaccacaataaagagggggatcagtatatttacatgggacagcccctgaacaatgacgaggatcatgcccactggacggaagctaagatgcttctggacaacatcaatacccctgagggcattatccccgccctctttgaacctgagagagaaaagagcgcggccattgatggggagtatcgcctgagaggagaggctcggaaaacattcgttgaactgatgcgcagaggcgacctcccggtgtggctttcttacaaggtcgcctccgaggggtttcaatatagcgatcggcgctggtgcttcgacggcgaaagaaacaatcaggtgctggaggaaaacatggatgtcgagatctggaccaaagagggagaacggaagaaactgagaccccgctggctcgacgctcggacatactccgaccctctggcccttagagagtttaaggagttcgctgccggccgccggtctgtgagcggggatctgatcctcgagattggaaaactgccccagcacctgacccagagagcgcaaaatgccctcgacaaccttgttatgctgcataattccgaacagggcgggcgggcttatcgccacgccatggaggagctgcctgatacaatcgaaaccctcatgctgcttgctctgattgccgtgctcacgggaggcgtgacactgtttttcctgtctggcagagggctcggaaagaccagcatcggccttctgtgtgtcatggcctccagcgttctgctctggatggcttctgtggagccccattggattgcggcctccatcatcctggaatttttccttatggtgctgctcattccggagcctgaccggcagcgcacaccccaggataaccaactggcttacgtcgtgatcgggctgctctttatgattcttacagttgccgccaatgagatgggactgctggaaaccacaaagaaagacctcggcatcgggcacgtggctgtcgagaaccaccatcacgccgcgatgctggatgtggaccttcatcctgccagcgcttggacgctgtacgccgtcgctaccacaattatcacccccatgatgagacacacaattgaaaacaccacggccaatatctctctcaccgcgatcgccaaccaggctgccattctgatgggactggataagggctggcctatctccaaaatggacattggcgtgcccctccttgctctggggtgctatagccaggttaatccgctgacactcaccgccgctgtgctgatgcttgtcgcccattacgcgatcattggacctggcctgcaagccaaggctacacgggaggcccagaaacgcaccgctgccgggatcatgaagaaccccacggtggatggaatcgttgccattgacctcgatcccgtggtctatgacgcgaagttcgaaaaacagctgggccagatcatgctgctcattctttgtacatctcaaatcctgctgatgagaaccacatgggctctctgcgagagcattaccctggccaccgggcctcttacaacgctgtgggagggatccccgggcaagttttggaataccacaatcgctgtgtctatggccaacatcttccggggcagctacctcgccggggctggactggccttctccctgatgaaaagcctcggcgggggacgcagaggcaccggggcgcagggagaaacacttggcgagaagtggaaacggcagctgaatcagctgtccaagtctgaatttaacacctataagagaagcggcattatggaggtggaccgctccgaagccaaagaggggctcaagcggggagagacgacaaaacacgctgtttctagaggcaccgccaagctgcgctggttcgtcgaacggaatcttgtgaaacccgaggggaaggtgatcgatctgggatgtggcagagggggatggagctactattgcgctggcctcaagaaagtcaccgaagttaagggctacacaaaagggggacctggccacgaggaacccattcctatggccacctacgggtggaacctggtgaagctgcattccggaaaagacgtgtttttcattccccctgagaagtgtgatacactcctttgcgacattggcgagtctagcccgaatcccacgatcgaagaggggcgcaccctgcgggtcctgaaaatggtggaaccttggctcagaggaaaccaattttgtattaagatcctgaatccctatatgccttccgttgtggagacacttgagcagatgcagcgcaagcacggcggcatgctggtccggaaccccctcagcagaaattctacccatgaaatgtactgggtgtcctgcgggacaggaaacatcgttagcgcggtgaatatgacctctcgcatgctgctgaaccggttcacgatggcccacagaaaaccgacctatgagcgcgatgtcgacctcggcgctgggacaagacacgtggccgtggaacctgaggtcgctaacctggatattatcggacagcggattgaaaatatcaagcatgagcacaaatccacctggcattacgacgaggataacccctataagacatgggcctaccacggcagctatgaagttaaaccctctgggtccgctagctccatggtgaatggagtggtcaaacttctgaccaagccttgggacgtgattcccatggttacacaaatcgccatgaccgatacgacaccttttggccagcagcgcgtgttcaaagagaaggtcgacaccagaaccccgaaagcgaagcggggcacagcccaaatcatggaagtgacggctaaatggctctgggggtttctgagcagaaacaagaagccccggatttgtacccgcgaggagttcacaagaaaagttcggtctaatgccgctatcggagccgtgtttgtcgacgagaaccagtggaatagcgccaaggaggcggtggaagatgagcgcttctgggaccttgttcatagagaacgggagctgcacaaacagggcaagtgcgctacctgcgtgtacaacatgatggggaaacgcgaaaagaagctcggagagtttggcaaagccaaggggtccagagccatttggtacatgtggctgggcgctcggttcctggagttcgaagccctcggatttatgaatgaggatcactggttctctcgcgaaaacagcctgtccggcgtcgagggggagggacttcataaactgggctatatcctcagagacatttctaagatccctgggggaaatatgtacgctgatgacacagccggctgggatacccggatcacagaagacgatctgcagaacgaggcgcgcattaccgacatcatggaacccgagcacgcccttctggctaaaagcatttttaagctcacgtatcaaaataaagtggtcagagtgcagcggcctgccaagaacgggaccgttatggatgtgatctcccgcagagaccagcggggctctggacaggtcggcacatacgggctgaataccttcacaaacatggaagctcaactgattagacagatggagagcgagggaatcttttcccccagcgaactcgagaccccgaacctggccgaacgcgtgcttgattggctggagaagtatggcgtggaacggctcaaaagaatggcgatctctggggacgactgtgttgtgaagcctattgatgaccgcttcgccacggctctgacagcccttaatgatatgggaaaagtccggaaggacatcccccagtgggagccttccaaaggctggaacgattggcagcaagtgcccttttgcagccatcacttccaccagctgattatgaaggacgggagagagatcgttgtgccttgtcgcaatcaggatgaactcgtcggccgggctagagtgtctcagggagccggctggtccctgcgcgagaccgcttgcctgggaaagagctacgcccaaatgtggcagctcatgtattttcatcggagagacctgcgccttgcggccaacgctatttgttccgccgtccccgtggattggatcccgacatctcggaccacgtggagcattcacgcccatcaccagtggatgaccacagaagacatgctgtccgtttggaatagagtgtggatcgaggaaaacccttggatggaggataaaacccatatcagctcttggggagacgtcccctacctcggcaagcgggaggaccaatggtgcgggtccctgattggacttacagctagagccacctgggcgacaaatatccaggtggctattaaccaggttcgccggctgatcggcaatgaaaactacctcgattatatgaccagcatgaaaagattcaagaatgagtctgaccccgaaggggccctgtggtga

SEQ ID NO: 19282 - RNA, 9879 nt, synthetic construct
  misc_feature 1..9879: note = derived and/or modified CDS sequence (opt5) from DENV-1__EU482813__SS-prME
  source 1..9879: mol_type = other RNA
agcgtgaccatgctgctcatgctgatgcccaccgcccttgctttccacctgacgaccagaggcggggagcctcatatgatcgtctccaagcaggaacggggaaagtctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaagaggctctgaaacttagctggtttaagaaaggctcctctatcgggaagatgttcgaagccacagctagaggcgcccgccggatggcgattctcggagataccgcctgggactttggcagcatcgggggagttttcacatccgtcggcaaactggtgcatcagatctttgggaccgcttacggagtgctgttcagcggcgtctcttggacgatgaagattgggatcggcgtgctcctgacctggcttggactcaattccagaagcacatctctctccatgacctgtattgccgttggcctggtgacactgtaccttggggtcatggtgcaggctgatagcggatgcgttatcaactggaaaggccgcgagctcaagtgtgggtccggaatttttgtgaccaatgaagtccacacatggaccgagcagtataagttccaagccgactctcctaaacggctgagcgcggccatcggcaaggcttgggaggaaggggtgtgcggcattagatccgccacgcgcctggagaacatcatgtggaaacagatctctaacgaactcaatcatattctgcttgagaacgacatgaagtttacagttgtggtcggagatgtggctggcatcctggcccaggggaaaaagatgattcggccgcagcccatggaatacaaatatagctggaagtcctggggaaaggccaaaatcattggcgctgacgtgcaaaataccaccttcatcatcgatgggcctaacacacccgagtgtcctgacgatcagagagcgtggaatatttgggaggtcgaagactacggatttggcatcttcaccacgaacatttggctcaagctgcgcgatagctatacacaggtttgcgaccaccggctgatgtctgccgctatcaaagattccaaggccgtgcacgccgacatgggctactggattgagagcgagaagaatgagacctggaaacttgctagagcctctttcatcgaagtgaagacatgtatctggcccaaatcccataccctctggagcaacggggtcctggagtctgagatgattatcccgaagatttatggaggccctatcagccagcacaattaccgccccgggtactttacacaaaccgcgggaccttggcatctgggcaaactcgaactggatttcgacctttgcgaggggacgaccgtggttgtggatgaacactgcggaaaccggggcccctccctgagaacaaccacagtcaccggcaagattatccacgagtggtgttgccggagctgtacgctccctcccctgcgctttaaaggggaggacggatgctggtatggcatggaaatcagaccggtgaaggagaaggaagagaatctggttaaatctatggtgtccgctgggagcggagaagtcgactccttctctcttggcctcctgtgtattagcatcatgattgaggaggtgatgcggtccagatggtctcgcaagatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaaaatgcgccctatgttcgctgtcggactgctctttagacggctgacgtcccgcgaagtgctcctgcttaccattggcctgtctctcgtggccagcgtcgagctgcccaactccctggaagaacttggggatggactggccatgggcatcatgatcctcaagctgctcacagacttccagagccatcaactgtgggctacccttctgtctctcacatttattaaaaccacgttctccctgcactatgcctggaagacaatggctatggttctgagcatcgtgtctctttttcccctgtgtctctccaccaccagccagaagacaacctggctgcctgtgctcctggggtctcttggatgcaaaccgctgacaatgttcctgattgccgaaaataagatctggggcagaaaatcctggcccctcaacgagggcattatggcggtcgggatcgtgagcatcctgctttccagcctgctcaagaacgatgttcctctggccggacccctcattgctggcgggatgctgatcgcctgttacgtgatttctggaagctccgctgacctttctctggagaaagccgccgaagtcagctgggaggaagaggctgaacattccggcgcgtctcacaatatcctggtggaggttcaggatgacgggacgatgaagattaaagatgaggaacgggacgataccctcacaatcctgcttaaggccaccctgctcgctgtgagcggagtctatcctctgtccatccccgccacactcttcgtgtggtacttttggcagaagaaaaagcaacgctctggcgtcctgtgggacaccccttcccctcccgaggtggaaagagccgttcttgatgacggcatttatcggatcatgcagcgcgggctgctgggaagatcccaggtgggcgtcggggtgttccaggagaacgtttttcatacgatgtggcacgtgacccggggagctgtcctcatgtaccaaggcaaacgcctggagcccagctgggcctctgtgaagaaagaccttatttcctacgggggaggctggagactgcagggcagctggaatacaggggaagaggtgcaggttatcgcggtcgaacccggaaagaaccctaagaatgtgcagaccgctcccggcacattcaaaacctctgagggggaagtgggagccattgccctcgattttaagccgggcacatccgggagccctatcgtcaaccgggagggaaaaattgtgggcctgtatggcaatggggttgtgacgacctccggaacatacgtctctgctatcgcccaagcgaaggctagccaggagggccccctccctgaaatcgaggacgaagtgttcagaaaacgcaacctgaccattatggatcttcaccccgggtccggaaagacccggagatatctgcccgccatcgttcgcgaggccattaagcggaaactgagaacactcatcctggctcctacgcgcgtggtcgccagcgaaatggctgaggcccttaagggcatgccgattcggtaccagaccacagcggtgaaatctgagcataccgggaaggaaatcgttgacctgatgtgccacgccacatttaccatgagactcctgtcccccgtgcgcgtccctaattataacatgatcattatggatgaggctcatttcacggaccccagctctatcgccgctcggggctacattagcacaagagtgggaatgggcgaagccgccgctatctttatgaccgcgacccctcccgggtccgtggaggccttccctcaatctaatgctgtcattcaggatgaggaacgggacatcccggagcgcagctggaactccggatatgaatggatcacagattttcccggcaaaaccgtttggttcgtgccttctattaagagcgggaatgacatcgccaactgtctgagaaagaatggaaaacgggtgattcagctctcccgcaagacattcgataccgagtaccagaaaacgaagaacaacgactgggactacgtcgtgacaaccgatatcagcgaaatgggcgccaattttagagctgaccgggttattgatcccagacgctgccttaaacctgtgatcctgaaggacgggcccgagcgggtcattctggccggcccgatgcctgtgacagttgcgtctgctgcccaaagacgcggacggatcggcagaaaccacaataaggagggggatcagtatatctacatgggacagcccctcaacaatgacgaagatcatgcccactggaccgaggctaaaatgctgcttgacaacattaatacgcccgaaggcatcattcctgccctgttcgagcccgaacgcgagaagtccgcggccatcgatggggagtatcggctcagaggagaagctcgcaaaacctttgtggagctgatgagacggggcgacctgcctgtctggctcagctacaaggtggcctccgaagggttccagtattctgatcgcagatggtgctttgacggcgagcggaacaatcaagtccttgaagagaacatggatgtggagatttggacaaaagaaggagagcgcaagaaactgagaccgcggtggctggacgctagaacctacagcgaccccctcgccctgcgcgagttcaaggagtttgctgccggccggagatccgtttctggggatcttatcctggaaatcggaaagctccctcagcacctgacacagcgcgcgcagaatgccctggacaacctcgtgatgcttcataatagcgagcaaggcgggcgggcttatagacacgccatggaggaactgcccgataccattgagacactgatgctcctggctcttatcgccgtgctgaccggaggcgtcacgctgttctttctgtccggccgggggctgggaaaaacaagcattggcctcctttgtgttatggcctcttccgtgctgctgtggatggctagcgtggaacctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgaaatgggacttctggagacaaccaagaaagacctgggcattgggcacgtcgctgtggaaaaccaccatcacgccgcgatgctcgatgtcgacctgcatcccgcctccgcttggacactttacgccgtggctacgaccatcattacacctatgatgcggcacaccatcgagaacacaaccgccaatattagcctgacggcgatcgccaaccaagctgccatcctcatgggactggataagggctggcccatttctaaaatggacatcggcgttcctctgctcgctcttgggtgctatagccaggtgaatcccctgaccctgacagccgctgtcctcatgctggtggcccattacgcgattatcggaccgggccttcaggccaaggctacccgcgaagcccaaaagagaacagctgccgggattatgaaaaaccctaccgttgatggaatcgtggccatcgacctggatcccgtcgtgtatgacacgaagtttgagaaacagctcggccagattatgctgctgatcctctgtacatcccagattcttctgatgcggaccacatgggcgctgtgcgagtctatcaccctcgctaccgggcccctgacaacgctttgggaaggaagccctggcaagttctggaataccacaattgccgtgtccatggctaacatcttccgcggcagctacctggccggggccggactcgctttttccctgatgaaatctctgggcgggggaagacggggcaccggggcccaaggagagacactcggcgaaaagtggaagcgccagcttaatcagctgagcaaatccgagttcaacacctataagagatctggcatcatggaagttgaccggagcgaggcgaaagaggggctgaagagaggagaaacgacaaaacacgccgtctcccgcggcaccgctaagctccggtggtttgtggagagaaatctggtgaagccggaagggaaagtcattgatcttggatgtggccgcgggggatggtcttactattgcgccggcctgaagaaagttaccgaggtgaagggctacacaaaagggggacccggccacgaggaacctatccccatggctacctacgggtggaacctcgtgaagctgcatagcggaaaagacgtcttctttattcctcccgagaagtgtgatacactgctctgcgacatcggcgaatccagccctaatccgacgattgaggaagggcggacccttagagtgctgaagatggttgagccctggctgcgcggaaaccagttctgtatcaaaattctcaatccttatatgccctctgtggtcgagacactggaacaaatgcagcggaagcacggcggcatgcttgtgagaaaccctctgtcccgcaatagcacccatgagatgtactgggtttcttgcgggacaggaaacatcgtgtccgccgtcaatatgaccagccggatgctcctgaacagatttacgatggcgcaccgcaaacccacctatgaacgggatgtggacctgggcgccgggacaagacacgtggctgtcgagccggaagttgccaacctcgatatcattggacagcgcatcgagaatattaagcatgagcacaaatctacctggcattacgacgaagataacccttataagacatgggcttaccacggctcctatgaggtgaagcccagcgggtccgccagctctatggtgaatggagtcgtgaaactgcttaccaagccctgggacgttatccctatggtgacacagattgctatgaccgatacgacacccttcggccaacagagagtctttaaagaaaaggtggacacccggacccctaaagccaagcgcggcacagcgcagatcatggaggttacggccaagtggctgtgggggttcctcagcagaaacaaaaagccgcggatctgtaccagagaagagtttacacggaaagtgcgctccaatgctgccattggagctgtcttcgtggacgagaaccaatggaactctgccaaggaagccgttgaggatgaaagattttgggacctggtgcatcgggagcgcgaacttcacaaacagggcaagtgcgcgacctgcgtctacaacatgatggggaagagagagaaaaagctgggagagttcggcaaagctaaggggagccgggccatctggtacatgtggctcggcgcccgcttcctggaatttgaggctctgggattcatgaatgaagatcactggttttccagagagaactctctcagcggcgtggagggggaaggactgcataaacttggctatattctgcgggacatctccaagattcccgggggaaatatgtacgccgatgacacagctggctgggatacccgcatcacagaggacgatctccagaacgaagccaaaatcaccgacattatggagcctgaacacgcgctgcttgccaagtctatcttcaagctgacgtatcagaataaagtcgtgagagttcaacggcccgctaagaacgggaccgtgatggatgtcattagccgcagagaccagcggggctccggacaggtgggcacatacgggctcaatacctttacaaacatggaggcccagctgatccgccaaatggagagcgaaggaattttctctccttccgagctggaaacccccaacctcgctggcagagtgctggattggcttgagaaacatggggttgaacggctgaagagaatggccatcagcggagacgactgtgtggtcaaaccgatcgatgaccgctttgcgacggccctcacagctctgaatgatatgggcaaggtgcggaaggacattcctcagtgggagccctctaaagggtggaacgattggcagcaggttcctttctgctcccaccactttcatcaacttatcatgaaggacggcagagagattgtggtcccctgtcgcaatcaggatgaactggtgggacgggccagagtcagccagggcgctgggtggtccctccgcgagaccgcctgcctgggaaaatcttatgctcagatgtggcaactgatgtacttccaccggagagacctccgcctggccgcgaacgccatctgtagcgctgtgcctgttgattgggtgcccacatcccggaccacgtggagcattcatgcccaccatcagtggatgaccacagaagacatgctttctgtctggaatagagtgtggatcgaggaaaacccgtggatggaggataagacccacatttccagctggggcgacgttccttatctggggaaacgcgaggaccagtggtgcggatctctcatcggcctgacagcccgggctacctgggccacaaatatccaagtggcgattaaccaggtcagacggcttatcgggaatgaaaactacctggattacatgaccagcatgaagagatttaagaatgagtccgaccccgaaggcgctctctggtga

SEQ ID NO: 19283 - RNA, 9879 nt, synthetic construct
  misc_feature 1..9879: note = derived and/or modified CDS sequence (opt5) from DENV-1__EU482814__SS-prME
  source 1..9879: mol_type = other RNA
agcgtgaccatgctgctcatgctgatgcccaccgcccttgctttccacctgacgaccagaggcggggaacctcatatgattgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggtttggactggagacaagaaccgaaacgtggatgagctccgagggcgcctggaaacagattcagcgggttgaaacatgggctctgcgccaccccggcttcaccgtgatcgccctctttctggcgcatgccattgggacatctatcacccagaagggaatcattttcatccttctgatgctcgtcacccctagcatggctatgagatgcgtgggcattgggtcccgggattttgttgagggactgagcggcgccacatgggtggacgtcgtgcttgagcacgggtcttgtgtgacgaccatggctaaggataaacccacactggacatcgaactcctgaagaccgaggtcacaaaccctgccgttctgcgcaaactctgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggacttttcggcaaagggtctctgattacctgcgccaagtttaagtgcgtgacaaaactcgagggaaagacggttcagtacgaaaacctgaaatattccgtgatcgtcaccgtgcacacaggcgaccagcatcaagttgggaatgagagcaccgaacacggaacaaccgctacgatcacaccccaggccccttctacagagattcagcttaccgactacggcgccctgacactcgattgtagcccccggaccggcctggacttcaacgaaatggtgctgctcacgatgaaggagaaaagctggctggtccataagcagtggtttcttgatctgcctctcccctggacatccggggcttctaccagccaagagacatggaatcgcaaagacctgcttgtgaccttcaagaccgcgcacgccaagaaacaggaagtcgtggttctgggatcccaggagggcgctatgcacacagccctcacgggggccaccgaaatccaaacaagcggaaccacaaccattttcgctggccatctgaagtgcagactgaaaatggataagctcacgctgaaagggatgtcttatgtgatgtgtacaggctcctttaaacttgagaaggaagtcgccgagacccagcacggaaccgtgctggttcagatcaaatacgagggcacagacgcgccgtgcaagattcctttcagcacccaggatgaaaaaggggtgacacaaaacggacggctcatcacggctaatcccatcgtcaccgacaaggagaaacctgtgaacattgaagccgagccgccctttggcgagtcttatatcgtgattggggccggagaaaaggctctgaagctgagctggttcaaaaagggctcctctatcgggaaaatgtttgaggccacagctagaggcgcccgccggatggcgattcttggagataccgcctgggacttcggcagcatcgggggagtttttacatccgtcggcaagctcgtgcatcagatcttcgggaccgcttacggagtgctgtttagcggcgtctcttggacgatgaaaattgggatcggcgtgctgctcacctggctgggacttaattccagaagcacatctctgtccatgacctgtattgccgttggcctcgtgacactgtacctgggggtcatggtgcaggctgatagcggatgcgttatcaactggaagggccgcgaacttaagtgtgggtccggaattttcgtgaccaatgaggtccacacatggaccgaacagtataaatttcaagccgactctcctaagcggctcagcgcggccatcggcaaggcttgggaggagggggtgtgcggcattagatccgccacgcgcctggaaaacatcatgtggaagcagatctctaacgagctgaatcatattctcctggaaaacgacatgaaattcacagttgtggtcggagatgtggctggcatccttgcccaggggaagaaaatgattcggccgcagcccatggagtacaagtatagctggaagtcctggggaaaagccaagatcattggcgctgacgtgcaaaataccacctttatcatcgatgggcctaacacacccgaatgtcctgacgatcagagagcgtggaatatttgggaggtcgaggactacggattcggcatcttcaccacgaacatttggctgaaactccgcgatagctatacacaggtttgcgaccaccggctgatgtctgccgctatcaaggattccaaagccgtgcacgccgacatgggctactggattgaaagcgagaagaatgaaacctggaagctggctagagcctcttttatcgaggtgaaaacatgtatctggcccaagtcccataccctttggagcaacggggtcctcgaatctgagatgattatcccgaaaatttatggaggccctatcagccagcacaattaccgccccgggtacttcacacaaaccgcgggaccttggcatctgggcaagctggagctcgattttgacctgtgcgaagggacgaccgtggttgtggatgagcactgcggaaaccggggcccctcccttagaacaaccacagtcaccggcaaaattatccacgaatggtgttgccggagctgtacgctgcctcccctccgcttcaagggggaggacggatgctggtatggcatggagatcagaccggtgaaggaaaaagaggaaaatctggttaagtctatggtgtccgctgggagcggagaggtcgactccttttctctgggccttctctgtattagcatcatgattgaagaggtgatgcggtccagatggtctcgcaaaatgctgatgacagggaccctggccgttttctttctcctgatcatgggacagcttacatggaacgatctgattcggctctgcatcatggtgggcgccaatgctagcgacagaatgggcatggggaccacctacctggccctgatggcgacattcaagatgcgccctatgtttgctgtcggacttctgttcagacggctcacgtcccgcgaggtgctgctcctgaccattggcctttctctggtggccagcgtcgaactccccaactccctggaggaactgggggatggacttgccatgggcatcatgatcctgaaactcctgacagactttcagagccatcaactctgggctaccctgctttctctgacattcattaagaccacgttttccctccactatgcctggaagacaatggctatggttctgagcatcgtgtctctgttccccctttgtctgtccaccaccagccagaaaacaacctggctccctgtgctgctcgggtctctgggatgcaagccgcttacaatgttcctgattgccgagaataaaatctggggcagaaagtcctggcccctgaacgaaggcattatggcggtcgggatcgtgagcatcctcctgtccagccttctgaaaaacgatgttcctctcgccggacccctgattgctggcgggatgctcatcgcctgttacgtgatttctggaagctccgctgacctgtctcttgagaaggccgccgaggtcagctgggaagaggaagctgagcattccggcgcgtctcacaatatcctggtggaagttcaggatgacgggacgatgaaaattaaggatgaggagcgggacgataccctgacaatcctcctgaaggccacccttctggctgtgagcggagtctatcctctctccatccccgccacactgtttgtgtggtacttctggcagaaaaagaaacaacgctctggcgtcctctgggacaccccttcccctcccgaagtggagagagccgttctggatgacggcatttatcggatcatgcagcgcgggcttctgggaagatcccaggtgggcgtcggggtgtttcaggaaaacgttttccatacgatgtggcacgtgacccggggagctgtcctgatgtaccaaggcaagcgcctcgagcccagctgggcctctgtgaaaaaggacctgatttcctacgggggaggctggagacttcagggcagctggaatacaggggaggaagtgcaggttatcgcggtcgagcccggaaagaaccctaaaaatgtgcagaccgctcccggcacatttaagacctctgaaggggaggtgggagccattgccctggatttcaaaccgggcacatccgggagccctatcgtcaaccgggaaggaaagattgtgggcctctatggcaatggggttgtgacgacctccggaacatacgtctctgctatcgcccaagcgaaagctagccaggagggccccctgcctgagatcgaagacgaggtgtttagaaagcgcaacctcaccattatggatctgcaccccgggtccggaaagacccggagatatcttcccgccatcgttcgcgaagccattaaacggaagctgagaacactgatcctcgctcctacgcgcgtggtcgccagcgagatggctgaagccctgaaaggcatgccgattcggtaccagaccacagcggtgaagtctgagcataccgggaaagagatcgttgaccttatgtgccacgccacattcaccatgagactgctctcccccgtgcgcgtccctaattataacatgatcattatggatgaagctcattttacggaccccagctctatcgccgctcggggctacattagcacaagagtgggaatgggcgaggccgccgctatcttcatgaccgcgacccctcccgggtccgtggaagcctttcctcaatctaatgctgtcattcaggatgaggaacgggacatcccggagcgcagctggaactccggatatgagtggatcacagatttccccggcaagaccgtttggttcgtgccttctattaagagcgggaatgacatcgccaactgtctgcgcaagaatggaaagcgggtgattcagctgtcccgcaaaacatttgataccgaataccagaagacgaaaaacaacgactgggactacgtcgtgacaaccgatatcagcgagatgggcgccaatttcagagctgaccgggttattgatcccagacgctgcctcaagcctgtgatccttaaggacgggcccgaacgggtcattctggccggcccgatgcctgtgacagttgcgtctgctgcccaaagacgcggacggatcggcagaaaccacaataaagagggggatcagtatatctacatgggacagcccctgaacaatgacgaggatcatgcccactggaccgaagctaagatgctcctggacaacattaatacgcccgagggcatcattcctgccctttttgaacccgagcgcgaaaaatccgcggccatcgatggggagtatcggctgagaggagaggctcgcaagaccttcgtggaactcatgagacggggcgacctgcctgtctggctgagctacaaagtggcctccgaggggtttcagtattctgatcgcagatggtgcttcgacggcgaacggaacaatcaagtcctcgaggaaaacatggatgtggagatttggacaaaggagggagaacgcaagaaacttagaccgcggtggctggacgctagaacctacagcgaccccctggccctccgcgagtttaaagagttcgctgccggccggagatccgtttctggggatctgatccttgagatcggaaaactgcctcagcacctcacacagcgcgcgcagaatgccctggacaacctggtgatgctccataatagcgaacaaggcgggcgggcttatagacacgccatggaggagcttcccgataccattgaaacactgatgctgctcgctctgatcgccgtgcttaccggaggcgtcacgctgtttttcctctccggccgggggctgggaaagacaagcattggcctgctctgtgttatggcctcttccgtgcttctgtggatggctagcgtggagcctcattggatcgcggcctctattatcctggaatttttcctcatggtcctgcttatccccgagccggaccgccagagaacccctcaggataaccagctggcttacgtggttattgggctcctgtttatgatcctgaccgtggccgccaatgagatgggactccttgaaacaaccaaaaaggacctgggcattgggcacgtcgctgtggagaaccaccatcacgccgcgatgctggatgtcgacctccatcccgcctccgcttggacactgtacgccgtggctacgaccatcattacacctatgatgcggcacaccatcgaaaacacaaccgccaatattagccttacggcgatcgccaaccaagctgccatcctgatgggactcgataaaggctggcccatttctaagatggacatcggcgttcctctgctggctctcgggtgctatagccaggtgaatccccttaccctgacagccgctgtcctgatgctcgtggcccattacgcgattatcggaccgggcctgcaggccaaggctacccgcgaggcccagaagagaacagctgccgggattatgaagaaccctaccgttgatggaatcgtggccatcgaccttgatcccgtcgtgtatgacgcgaaattcgaaaagcagctgggccagattatgctcctgatcctgtgtacgtcccagattctccttatgcggacaacctgggctctgtgcgagtctatcacactggccaccgggcccctcaccacactgtgggagggaagccctggcaaattctggaatacgaccattgctgtgtccatggccaacatctttcgcggcagctaccttgccggggctggactggccttctccctcatgaagtctctgggcgggggaagacggggcacaggggcgcaaggagaaaccctgggcgagaagtggaaacgccagctcaatcagcttagcaagtccgaatttaacacatataaaagatctggcatcatggaggttgaccggagcgaagccaaggaggggctgaaaagaggagagaccacgaagcacgctgtctcccgcggcacagccaagctgcggtggttcgtggaaagaaatctcgtgaaaccggaggggaaggtcattgatctgggatgtggccgcgggggatggtcttactattgcgctggccttaaaaaggttaccgaagtgaaaggctacaccaaagggggacccggccacgaggaacctatccccatggccacatacgggtggaacctggtgaaactccatagcggaaaggacgtctttttcattcctcccgagaagtgtgataccctgctgtgcgacatcggcgagtccagccctaatccgacaattgaagaggggcggacgctcagagtgcttaaaatggttgaaccctggctgcgcggaaaccagttttgtatcaagattctgaatccttatatgccctctgtggtcgagaccctcgagcaaatgcagcggaaacacggcggcatgctggtgagaaaccctctttcccgcaatagcacacatgaaatgtactgggtttcttgcgggaccggaaacatcgtgtccgcggtcaatatgacaagccggatgctgctcaacagattcaccatggcccaccgcaagcccacgtatgagcgggatgtggacctgggcgctgggaccagacacgtggccgtcgaaccggaggttgctaacctggatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctcctgacaaaaccctgggacgttatccctatggtgacccagattgccatgacagataccacgccctttggccaacagagagtcttcaaggagaaagtggacacacggacccctaaggcgaagcgcggcaccgcccagatcatggaagttacagctaaatggctttgggggtttctgagcagaaacaagaaaccgcggatctgtacgagagaggagttcacccggaaggtgcgctccaatgccgctattggagccgtctttgtggacgagaaccaatggaactctgccaaagaggcggttgaagatgagagattctgggacctcgtgcatcgggaacgcgagctgcacaagcagggcaagtgcgctacatgcgtctacaacatgatggggaaaagagaaaagaaacttggagagttcggcaaggccaaagggagccgggccatctggtacatgtggctgggcgctcgctttctcgagttcgaagccctgggatttatgaatgaggatcactggttctccagagaaaactctctgagcggcgtggagggggagggactccataagctgggctatattcttcgggacatctccaaaattcccgggggaaatatgtacgctgatgacaccgccggctgggatacacgcatcaccgaagacgatctgcagaacgaggcgaagatcacagacattatggaacctgagcacgccctcctggctaagtctatctttaaacttacctatcagaataaggtcgtgagagttcaacggcccgccaaaaacgggacggtgatggatgtcattagccgcagagaccagcggggctccggacaggtgggcacctacgggctgaatacattcaccaacatggaagctcagctcatccgccaaatggagagcgagggaatcttttctccttccgaactggagacacccaacctggccggcagagtgctcgattggctggaaaagcatggggttgagcggcttaaaagaatggcgatcagcggagacgactgtgtggtcaagccgatcgatgaccgcttcgccaccgctctgacggccctcaatgatatgggcaaggtgcggaaagacattcctcagtgggaaccctctaaggggtggaacgattggcagcaggttcctttttgctcccaccacttccatcaactgatcatgaaagacggcagagagattgtggtcccctgtcgcaatcaggatgagcttgtgggacgggctagagtcagccagggcgccgggtggtccctgcgcgaaacagcttgcctcggaaagtcttatgcccagatgtggcaactgatgtactttcaccggagagacctgcgcctcgcggccaacgctatctgtagcgccgtgcctgttgattgggtgcccacctcccggacaacctggagcattcatgcccaccatcagtggatgacgaccgaggacatgctgtctgtctggaatagagtgtggatcgaagagaacccgtggatggaagataaaacacacatttccagctggggcgacgttccttatcttgggaagcgcgaggaccagtggtgcggatctctgatcggcctcaccgctcgggccacatgggcgaccaatatccaagtggctattaaccaggtcagacggctgatcgggaatgagaactaccttgattacatgacaagcatgaagagattcaaaaatgaatccgaccccgagggcgccctgtggtga

SEQ ID NO: 19284 - RNA, 9879 nt, synthetic construct
  misc_feature 1..9879: note = derived and/or modified CDS sequence (opt5) from DENV-1__EU482815__SS-prME
  source 1..9879: mol_type = other RNA
agcgtgaccatgctgctgatgctgatgcccgccgctcttgccttccacctgaccacgagaggcggggaacctcatatgatcgtctccaagcaggaacggggaaagtctctcctgtttaagaccagcgcgggcgttaatatgtgcacacttattgctatggacctgggggagttctgtgaagataccatgacatacaagtgcccgagaatcaccgaggccgaacccgacgatgtggactgttggtgcaatgccacagatacctgggtgacgtatggaacctgttcccagacaggcgagcacagacgggacaagcgctctgttgctctcgcccctcatgtggggctgggactggagaccagaacagaaacctggatgagctccgagggcgcttggaaacagattcagcgggttgaaacgtgggccctccgccaccccggctttacagtgatcgcgctgttccttgcccatgctattgggacctctatcacacagaagggaatcatttttatcctgctcatgctggtcacccctagcatggccatgagatgcgtgggcattgggtcccgggatttcgttgagggacttagcggcgctacctgggtggacgtcgtgctggagcacgggtcttgtgtgacaacgatggccaaggataaacccaccctcgacatcgaactgctgaagacagaggtcaccaaccctgcggttctccgcaaactgtgcattgaagccaagatctccaatacaaccacggatagcagatgtccgacacaaggagaggctacccttgtggaagaacaagacgccaactttgtgtgccggcgcaccttcgtcgatagaggctggggcaatgggtgtggactgtttggcaaagggtctctcattacatgcgctaagttcaagtgcgtgaccaaactggagggaaagacagttcagtacgaaaaccttaaatattccgtgacggtcaccgtgcacacaggcgaccagcatcaagttgggaatgagagcaccgaacacggaacaaccgccacgatcacaccccaggccccttctacagagatccagctgaccgactacggcgctctcacactggattgtagcccccggaccggcctggactttaacgaaatggtgctcctgacgatgaaggagaaaagctggcttgtccataagcagtggttcctggatctccctctgccctggacatccggggcgtctaccagccaagagacatggaatcgcaaagaccttctggtgacctttaagaccgcccacgctaagaaacaggaagtcgtggttctcggatcccaggagggcgccatgcacacagccctgacgggggctaccgaaattcaaacaagcggaaccacaaccatcttcgccggccatctgaagtgcagactcaaaatggataagctgacgcttaaagggatgtcttatgtgatgtgtacaggctccttcaagctggagaaggaagtcgcggagacccagcacggaaccgtgctcgttcagattaaatacgagggcacagacgctccgtgcaagatcccttttagcacccaggatgaaaaaggggtgacacaaaacggacggctgattacggccaatcccatcgtcaccgacaaggagaaacctgtgaacatcgaagccgagccgcccttcggcgagtcttatattgtgatcggggctggagaaaaggccctgaaacttagctggtttaaaaagggctcctctattgggaaaatgttcgaggctacagccagaggcgcgcgccggatggccatcctcggagataccgcttgggactttggcagcattgggggagttttcacatccgtcggcaagctggtgcatcagatctttgggaccgcctacggagtgctgttcagcggcgtctcttggacgatgaaaatcgggattggcgtgctcctgacctggcttggactcaattccagaagcacatctctctccatgacctgtatcgctgttggcctggtgacactgtaccttggggtcatggtgcaggccgatagcggatgcgttattaactggaagggccgcgaactcaagtgtgggtccggaatctttgtgaccaatgaggtccacacatggaccgaacagtataaattccaagcggactctcctaagcggctgagcgccgctattggcaaagcctgggaggagggggtgtgcggcatcagatccgctacgcgcctggaaaacattatgtggaagcagatctctaacgagctcaatcatatcctgcttgaaaacgacatgaaatttacagttgtggtcggagatgtggccggcattctggcccaggggaagaaaatgatccggccgcagcccatggagtacaagtatagctggaagtcctggggaaaagctaagattatcggcgcggacgtgcaaaataccaccttcattatcgatgggcctaacacacccgaatgtcctgacgatcagagagcctggaatatctgggaggtcgaggactacggatttggcattttcaccacgaacatctggctcaaactgcgcgatagctatacacaggtttgcgaccaccggctgatgtctgctgccattaaggattccaaagccgtgcacgctgacatgggctactggatcgaaagcgagaagaatgaaacctggaaacttgccagagcgtctttcattgaggtgaaaacatgtatctggcccaagtcccataccctctggagcaacggggtcctggaatctgagatgatcattccgaaaatctatggaggccctattagccagcacaattaccgccccgggtactttacacaaaccgctggaccttggcatctgggcaagctcgagctggatttcgacctttgcgaagggacgaccgtggttgtggatgagcactgcggaaaccggggcccctccctgagaacaaccacagtcaccggcaaaatcattcacgaatggtgttgccggagctgtacgctccctcccctgcgctttaagggggaggacggatgctggtatggcatggagatcagaccggtgaaggaaaaagaggaaaatctggttaagtctatggtgtccgccgggagcggagaggtcgactccttctctcttggcctcctgtgtatcagcattatgatcgaagaggtgatgcggtccagatggtctcgcaaaatgctgatgacagggaccctcgccgtctttttcctgcttattatgggacagctgacatggaacgatctcatccggctgtgcattatggtgggcgctaatgccagcgacagaatgggcatggggaccacctacctggcgcttatggctacatttaagatgcgccctatgttcgccgtcggactgctctttagacggctgacgtcccgcgaggtgctcctgcttaccatcggcctgtctctcgtggccagcgtcgaactgcccaactccctggaggaacttggggatggactggctatgggcattatgatcctcaaactgctcacagacttccagagccatcaactgtgggccacccttctgtctctcacatttatcaagaccacgttctccctgcactatgcttggaagacaatggccatggttctgagcattgtgtctctttttcccctgtgtctctccaccaccagccagaaaacaacctggctgcctgtgctcctggggtctcttggatgcaagccgctgacaatgttcttcatcgcggagaataaaatttggggcagaaagtcctggcccctgaacgaaggcatcatggccgtcgggattgtgagcatcctcctgtccagccttctgaaaaacgatgttcctctcgctggacccctgatcgccggcgggatgctcattgcttgttacgtgatctctggaagctccgccgacctgtctcttgagaaggccgctgaggtcagctgggaagaggaagcggagcattccggcgcctctcacaatattctggtggaagttcaggatgacgggacgatgaaaatcaaggatgaggagcgggacgataccctgacaattctcctgaaggctacccttctggccgtgagcggagtctatcctctctccatccccgccacactgtttgtgtggtacttctggcagaaaaagaaacaacgctctggcgtcctctgggacaccccttcccctcccgaagtggagagagctgttctggatgacggcatctatcggattatgcagcgcgggcttctgggaagatcccaggtgggcgtcggggtgtttcaggaaaacgttttccatacgatgtggcacgtgacccggggagccgtcctgatgtaccaaggcaagcgcctcgagcccagctgggcgtctgtgaaaaaggacctgatctcctacgggggaggctggagacttcagggcagctggaatacaggggaggaagtgcaggttattgctgtcgagcccggaaagaaccctaaaaatgtgcagaccgcccccggcacatttaagacctctgaaggggaggtgggagccatcgctctggatttcaaaccgggcacatccgggagccctattgtcaaccgggaaggaaagatcgtgggcctctatggcaatggggttgtgacgacctccggaacatacgtctctgccattgcgcaagctaaagccagccaggagggccccctgcctgagatcgaagacgaggtgtttagaaagcgcaacctcaccatcatggatctgcaccccgggtccggaaagacccggagatatcttcccgccattgttcgcgaagctatcaaacggaagctgagaacactgattctcgcccctacgcgcgtggtcgctagcgagatggccgaagcgctgaaaggcatgccgatccggtaccagaccacagccgtgaagtctgagcataccgggaaagagattgttgaccttatgtgccacgctacattcaccatgagactgctctcccccgtgcgcgtccctaattataacatgatcatcatggatgaagcccattttacggaccccagctctattgctgcccggggctacatcagcacaagagtgggaatgggcgaggccgctgcgattttcatgaccgccacccctcccgggtccgtggaggcttttcctcaatctaatgccgtcatccaggatgaagaacgggacattccggagcgcagctggaactccggatatgagtggatcacagatttccccggcaagaccgtttggttcgtgccttctatcaagagcgggaatgacattgccaactgtctgcgcaagaatggaaagcgggtgatccagctgtcccgcaaaacatttgataccgaataccagaagacgaaaaacaacgactgggactacgtcgtgacaaccgatattagcgagatgggcgctaatttcagagccgaccgggttatcgatcccagacgctgcctcaagcctgtgattcttaaggacgggcccgaacgggtcatcctggcgggcccgatgcctgtgacagttgcttctgccgcccaaagacgcggacggattggcagaaaccacaataaagagggggatcagtatatctacatgggacagcccctgaacaatgacgaggatcatgctcactggaccgaagccaagatgctcctggacaacatcaatacgcccgagggcattatccctgcgctttttgaacccgagcgcgaaaaatccgccgctattgatggggagtatcggctgagaggagaggcccgcaagaccttcgtggaactcatgagacggggcgacctgcctgtctggctgagctacaaagtggcttccgaggggtttcagtattctgatcgcagatggtgcttcgacggcgaacggaacaatcaagtcctcgaggaaaacatggatgtggagatctggacaaaggagggagaacgcaagaaacttagaccgcggtggctggacgccagaacctacagcgaccccctggctctccgcgagtttaaagagttcgccgcgggccggagatccgtttctggggatctgattcttgagatcggaaaactgcctcagcacctcacacagcgcgcccagaatgctctggacaacctggtgatgctccataatagcgaacaaggcgggcgggcctatagacacgctatggaggagcttcccgataccatcgaaacactgatgctgctcgccctgattgccgtgcttaccggaggcgtcacgctgtttttcctctccggccgggggctgggaaagacaagcatcggcctgctctgtgttatggcttcttccgcgcttctgtggatggccagcgtggagcctcattggattgctgcctctatcattctggaatttttcctcatggtgctgcttatccccgagccggaccgccagagaacccctcaggataaccagctggcctacgtcgtgatcgggctcctgtttatgattctgaccgttgctgccaatgagatgggactccttgaaacaaccaaaaaggacctgggcatcgggcacgtggcggtcgagaaccaccatcacgccgctatgctggatgtggacctccatcccgcctccgcttggacactgtacgccgtcgcgacgaccattatcacacctatgatgcggcacaccattgaaaacacaaccgccaatatcagccttacggctattgccaaccaagctgccatcctgatgggactcgataaaggctggcccatctctaagatggacattggcgtgcctctgctggctctcgggtgctatagccaggttaatccccttaccctgacagccgcggtgctgatgctcgtcgcccattacgctatcattggaccgggcctgcaggccaaggctacccgcgaggcccagaagagaacagccgcggggatcatgaagaaccctaccgtggatggaattgttgctatcgaccttgatcccgtggtctatgacgccaaattcgaaaagcagctgggccagatcatgctcctgattctgtgtacgtcccagatcctccttatgcggacaacctgggctctgtgcgagtctattacactggccaccgggcccctcaccacactgtgggagggaagccctggcaaattctggaatacgaccatcgccgtgtccatggctaacatttttcgcggcagctaccttgccggggcgggactggccttctccctcatgaagtctctgggcgggggaagacggggcacaggggctcaaggagaaaccctgggcgagaagtggaaacgccagctcaatcagcttagcaagtccgaatttaacacatataaaagatctggcatcatggaggtggaccggagcgaagccaaggaggggctgaaaagaggagagaccacgaagcacgctgtttcccgcggcacagccaagctgcggtggttcgtcgaaagaaatctcgtgaaaccggaggggaaggtgatcgatctgggatgtggccgcgggggatggtcttactattgcgcgggccttaaaaaggtcaccgaagttaaaggctacaccaaagggggacccggccacgaggaacctattcccatggccacatacgggtggaacctggtgaaactccatagcggaaaggacgtgtttttcatccctcccgagaagtgtgataccctgctgtgcgacattggcgagtccagccctaatccgacaatcgaagaggggcggacgctcagagtccttaaaatggtggaaccctggctgcgcggaaaccagttttgtattaagatcctgaatccttatatgccctctgttgtggagaccctcgagcaaatgcagcggaaacacggcggcatgctggtcagaaaccctctttcccgcaatagcacacatgaaatgtactgggtgtcttgcgggaccggaaacattgtttccgctgtgaatatgacaagccggatgctgctcaacagattcaccatggcccaccgcaagcccacgtatgagcgggatgtcgacctgggcgctgggaccagacacgtggccgtggaaccggaggtcgctaacctggatatcatcggacagcgcattgaaaatatcaaacatgagcacaagtctacatggcattacgacgaggataacccttataagacctgggcctaccacggctcctatgaagttaaacccagcgggtccgcgagctctatggtgaatggagtggtcaagctcctgacaaaaccctgggacgtgattcctatggttacccagatcgccatgacagataccacgccctttggccaacagagagtgttcaaggagaaagtcgacacacggacccctaaggctaagcgcggcaccgcccagattatggaagtgacagctaaatggctttgggggtttctgagcagaaacaagaaaccgcggatctgtacgagagaggagttcacccggaaggttcgctccaatgccgccatcggagcggtgtttgtcgacgagaaccaatggaactctgctaaagaggccgtggaagatgagagattctgggacctcgttcatcgggaacgcgagctgcacaagcagggcaagtgcgccacatgcgtgtacaacatgatggggaaaagagaaaagaaacttggagagttcggcaaggctaaagggagccgggccatttggtacatgtggctgggcgctcgctttctcgagttcgaagccctgggatttatgaatgaggatcactggttctccagagaaaactctctgagcggcgtcgagggggagggactccataagctgggctatatccttcgggacatttccaaaatccccgggggaaatatgtacgcggatgacaccgccggctgggatacacgcattaccgaagacgatctgcagaacgaggctaagatcacagacatcatggaacctgagcacgccctcctggctaagtctatttttaaacttacctatcagaataaggtggtcagagtgcaacggcccgccaaaaacgggacggttatggatgtgatcagccgcagagaccagcggggctccggacaggtcggcacctacgggctgaatacattcaccaacatggaagcgcagctcattcgccaaatggagagcgagggaatcttttctccttccgaactggagacacccaacctggccggcagagtgctcgattggctggaaaagcatggggtggagcggcttaaaagaatggctattagcggagacgactgtgttgtgaagccgatcgatgaccgcttcgccaccgctctgacggccctcaatgatatgggcaaggtccggaaagacatccctcagtgggaaccctctaaggggtggaacgattggcaacaggtgcctttttgctcccaccacttccatcaactgattatgaaagacggcagagagatcgttgtgccctgtcgcaatcaggatgagcttgtcggacgggctagagtgagccagggcgccgggtggtccctgcgcgaaacagcgtgcctcggaaagtcttatgcccagatgtggcaactgatgtactttcaccggagagacctgcgcctcgctgccaacgccatttgtagcgctgtccctgtggattgggttcccacctcccggacaacctggagcatccatgcccaccatcagtggatgacgaccgaggacatgctgtctgtgtggaatagagtctggattgaagagaacccgtggatggaagataaaacacacatctccagctggggcgacgtgccttatcttgggaagcgcgaggaccagtggtgcggatctctgattggcctcaccgcgcgggctacatgggccaccaatatccaagttgccatcaaccaggtgagacggctgattgggaatgagaactaccttgattacatgacaagcatgaagagattcaaaaatgaatccgaccccgagggcgctctgtggtga

SEQ ID NO: 19285 - RNA, 9879 nt, synthetic construct
  misc_feature 1..9879: note = derived and/or modified CDS sequence (opt5) from DENV-1__EU482816__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttactattgcgctggcctgaaaaaggttaccgaagtgaaaggctacaccaaagggggacccggccacgaggaacctatccccatggccacatacgggtggaacctcgtgaaactgcatagcggaaaggacgtcttctttacccctcccgagaagtgtgatacactgctctgcgacattggcgagtccagccctaatccgacgatcgaagaggggcggacccttagagtgctgaaaatggttgaaccctggctgcgcggaaaccagttctgtattaagatcctcaatccttatatgccctctgtggtcgagacactggagcaaatgcagcggaaacacggcggcatgcttgtgagaaaccctctgtcccgcaatagcacccatgaaatgtactgggtttcttgcgggacaggaaacattgtgtccgcggtcaatatgaccagccggatgctcctgaacagatttacgatggcccaccgcaagcccacctatgagcgggatgtggacctgggcgctgggacaagacacgtggccgtcgaaccggaggttgctaacctcgatatcatcggacagcgcattgaaaatatcaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttattcctatggtgacacagatcgccatgaccgatacgacacccttcggccaacagagagtctttaaggagaaagtggacacccggacccctaaggcgaagcgcggcacagcccagattatggaagttacggctaaatggctgtgggggttcctcagcagaaacaagaaaccgcggatctgtaccagagaggaatttacacggaaggtgcgctccaatgccgctatcggagccgtcttcgtggacgagaaccaatggaactctgccaaagaggcggttgaagatgagagattttgggacctggtgcatcgggaacgcgagcttcacaagcagggcaagtgcgctacctgcgtctacaacatgatggggaaaagagaaaagaaactgggagagttcggcaaggccaaagggagccgggccatttggtacatgtggctcggcgctcgcttcctggagtttgaagccctgggattcatgaatgaggatcactggttttccagagaaaactctctcagcggcgtggagggggagggactgcataaacttggctatatcctgcgggacatttccaaaatccccgggggaaatatgtacgctgatgacacagccggctgggatacccgcattacagaagacgatctccagaacgaggcgaagatcaccgacatcatggaacctgagcacgccctgcttgctaagtctattttcaaactgacgtatcagaataaggtcgtgagagttcaacggcccgccaaaaacgggaccgtgatggatgtcatcagccgcagagaccagcggggctccggacaggtgggcacatacgggctcaatacctttacaaacatggaagctcagctgattcgccaaatggagagcgagggaatcttctctccttccgaactggagacccccaacctcgccggcagagtgctggattggcttgaaaagcatggggttgagcggctgaaaagaatggcgattagcggagacgactgtgtggtcaagccgatcgatgaccgctttgccacggctctcacagccctgaatgatatgggcaaggtgcggaaagacatccctcagtgggaaccctctaaggggtggaacgattggcagcaggttcctttctgctcccaccactttcatcaacttattatgaaagacggcagagagatcgtggtcccctgtcgcaatcaggatgagctggtgggacgggctagagtcagccagggcgccgggtggtccctccgcgaaaccgcttgcctgggaaagtcttatgcccagatgtggcaactgatgtacttccaccggagagacctccgcctggcggccaacgctatttgtagcgccgtgcctgttgattgggtgcccacatcccggaccacgtggagcatccatgcccaccatcagtggatgaccacagaggacatgctttctgtctggaatagagtgtggattgaagagaacccgtggatggaagataaaacccacatctccagctggggcgacgttccttatctggggaagcgcgaggaccagtggtgcggatctctcattggcctgacagctcgggccacctgggcgacaaatatccaagtggctatcaaccaggtcagacggcttattgggaatgagaactacctggattacatgaccagcatgaagagatttaaaaatgaatccgaccccgagggcgccctctggtga

SEQ ID NO: 19286 - RNA, 9879 nt, synthetic construct
  misc_feature 1..9879: note = derived and/or modified CDS sequence (opt5) from DENV-1__EU482821__SS-prME
  source 1..9879: mol_type = other RNA
tccgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttatcgcgatggacctgggggagctctgtgaagatacaatgacctacaaatgcccgcgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggaaccgggattttgttgagggactgtccggcgctacgtgggtggacgtcgtgctcgagcacgggagctgtgtgaccacaatggccaaggataaacccaccctggacatcgaactgctcaagacagaggtcaccaatcctgctgttctgcgcaaactttgcattgaagccaagatctctaacacgacaaccgattccagatgtccgacccaaggagaggcgacactggtggaggaacaagacgccaatttcgtgtgccggcgcacctttgtcgatagaggctggggcaacgggtgtggactcttcggcaaagggagcctgattacatgcgctaagtttaagtgcgtgacgaaacttgagggaaagatcgttcagtacgaaaatctgaaatattctgtgatcgtcaccgtgcacacaggcgaccagcatcaagttgggaacgagtccaccgaacacggaacaaccgccacgattacaccccaagctcctaccaccgagatccagctcacagactacggcgccctgaccctggattgtagcccccggacgggcctcgacttcaatgaaatggtgctgcttacaatgaaggagaaatcttggctggtccataagcagtggtttctcgatctgcctcttccctggacctccggggccagcacatcccaagagacctggaaccgccaggacctgctcgtgaccttcaaaacagctcacgcgaagaagcaggaagtcgtggttctgggatctcaagagggcgccatgcacacggctctgaccggggccacagaaattcagaccagcggaacaaccacgatctttgccggccatctcaaatgcagactgaagatggataaacttacactgaaggggatgtcctatgtgatgtgtaccggcagcttcaaactcgagaaggaagtcgctgagacccagcacggaacagtgctggttcagattaagtacgagggcaccgacgccccgtgcaaaatccctttctctacacaagatgaaaagggggtgacgcagaatggacggctgatcaccgcgaaccccattgtcacagacaaagagaagcctgtgaatatcgaagctgagccgccctttggcgagtcctatattgtgatcggggccggagaaaaagcccttaagctcagctggttcaagaaaggctctagcattgggaagatgtttgaggctaccgccagaggcgctcgccggatggccatcctgggagatacagcgtgggacttcggctccatcgggggagtttttacctctgtcggcaaactggtgcatcagattttcgggacggcctacggagtgctctttagcggcgtctcctggaccatgaagatcgggattggcgtgctgcttacatggctgggactcaacagcagatctacctccctgagcatgacatgtatcgctgttggcctggtgaccctttacctcggggtcatggtgcaggccgattctggatgcgttattaattggaaaggccgcgaactgaagtgtgggtccggaatcttcgtgacaaacgaggtccacacctggacggaacaatataagtttcaggctgacagccctaaacggctgtccgccgcgattggcaaggcctgggaggagggggtgtgcggcatcagatctgctacacgcctcgaaaacatcatgtggaaacagattagcaatgagctgaaccatatccttctggaaaatgacatgaagttcaccgttgtggtcggagatgtggccggcattctcgctcaggggaaaaagatgatccggccgcaacccatggagtacaaatattcctggaagtcttggggaaaggccaaaattatcggcgccgacgtgcagaacaccacatttatcattgatgggcctaatacccccgaatgtcctgacgatcagagagcttggaacatctgggaggtcgaggactacggattcggcatttttacgacaaatatctggctgaagctgcgcgatagctatacccaggtttgcgaccaccggcttatgtccgcggccattaaagatagcaaggctgtgcacgccgacatgggctactggatcgaatctgagaaaaacgaaacatggaagctcgccagagcttccttcatcgaggtgaagacctgtatttggcccaaaagccatacactgtggtctaatggggtcctggaatccgagatgatcattccgaagatctatggaggccctattagccaacacaactaccgccccgggtacttcacccagacggccggaccttggcatctcggcaaactggagcttgattttgacctgtgcgaagggaccacagtggttgtggatgagcactgcggaaatcggggcccctctctcagaaccacaaccgtcacgggcaagatcatccacgaatggtgttgccggagctgtacactgcctcccctgcgcttcagaggggaggacggatgctggtatggcatggagattcggccggtgaaagaaaaggaggaaaaccttgttaagtccatggtgagcgcggggtctggagaggtcgactcctttagcctcggcctgctgtgtatctccattatgatcgaagaggtgatgagatctcgctggagccggaaaatgctcatgaccgggacactggctgttttctttcttctgattatgggacagctcacctggaatgatctgatcagactgtgcattatggtgggcgccaacgcctccgaccgcatgggcatggggaccacataccttgctctgatggccacgttcaagatgagacctatgtttgcggtcggactcctgttccggcgcctcacctctagagaggtgctgcttctgacaatcggcctcagcctggtggcttccgtcgaactgcccaattctcttgaggaactgggggatggactcgccatgggcatcatgattctgaaactcctgaccgactttcaaagccatcagctttgggccacactgctctccctgaccttcatcaagacgacatttagcctgcactatgcttggaaaaccatggccatggttctttctattgtgtccctgttccccctctgtctgagcaccacatctcagaagaccacatggctccctgtgctgcttgggtccctgggatgcaagccgctgacgatgtttctcatcgctgagaacaaaatttggggccggcgcagctggcccctgaacgaaggcatcatggccgtcgggatcgtgtctattcttctgtccagcctcctgaagaatgatgttcctctcgcgggacccctgatcgccggcgggatgcttattgcttgttacgtgatctccggaagctctgccgacctgagcctggagaaagctgccgaggtctcctgggaagaggaagccgagcattctggcgctagccacaacattctcgtggaagttcaggatgacgggaccatgaagatcaaagatgaggagagagacgatacactgaccatccttctgaaggcgacactcctggccgtgtccggagtctatcctctctctattcccgctaccctgttcgtgtggtacttctggcagaagaagaagcagcggagcggcgtcctttgggacacgcctagccctcccgaagtgggccgcgccgttctggatgacgggatctatagaattatgcagcggggactgctcggccgctctcaggtgggggtcggagtgtttcaagagaatgttttccataccatgtggcacgtgacaagaggcgccgtcctgatgtaccaggggaaacggcttgaacccagctgggcttccgtgaagaaagacctgatcagctacggaggcggctggagactccaggggtcttggaacaccggagaggaggtgcaggttattgccgtcgaacccggcaagaatcctaaaaacgtgcaaacagcgcccgggacctttaagacaccggagggagaagtgggcgctatcgccctggatttcaagcctgggacgtccggaagccccattgtcaatcgcgagggcaaaatcgtgggcctctatgggaacggagttgtgaccacatctggcacctacgtctccgccatcgctcaggccaaggcgagccaggaagggcctctgcccgagattgaggacgaagtgtttcggaaaagaaatcttaccatcatggatctgcaccccggatccggcaagacacgccggtatctgcctgctattgttagagaggccatcaaacgcaagctccggacgctgattcttgccccgaccagagtggtcgcttctgaaatggccgaggctctgaaggggatgcccatccgctaccaaacaaccgccgtgaaaagcgaacatacaggcaaggagatcgttgacctcatgtgccacgcgaccttcacgatgcggctgctgtcccctgtgagagtccccaactataatatgattatcatggatgaggcccattttacagaccctagctctattgctgcccggggatacatctccacccgcgtgggcatgggggaagctgccgccattttcatgaccgctacaccccctggaagcgtggaggcgtttccgcagtctaacgccgtcatccaggatgaagagagagacatccccgaacggagctggaactccggctatgagtggattaccgatttccctgggaaaacagtttggtttgtgccctctatcaagagcggaaacgacattgctaattgtctccgcaaaaacggcaagagagtgatccagctttcccggaagaccttcgatacggagtaccagaaaaccaagaacaatgactgggactacgtcgtgaccacagatatttctgaaatgggggccaacttcagagccgaccgcgttatcgatcctcggagatgcctgaaacccgtgattctgaaggacggcccggagcgcgtcatcctcgctggacctatgcccgtgaccgttgccagcgcggctcagcggagaggccgcatcgggcggaatcacaacaaagaaggagatcagtatatttacatgggccagcccctgaataacgacgaggatcatgcccactggacggaggccaagatgcttctggacaatatcaacacccctgaagggattatccccgctctctttgagcctgaaagagagaagtccgccgcgattgatggagaatatcgcctgagaggcgaggcccggaaaacattcgtggagctgatgcgcagaggggacctcccggtctggcttagctacaaggtggcttctgaaggctttcaatattccgatcggcgctggtgcttcgacggagagagaaataaccaggtcctggaagagaatatggatgtggaaatctggaccaaagagggcgagcggaagaaactgagaccccgctggctcgacgcccggacatacagcgaccctctggctcttagagaatttaaggagttcgccgctgggcgccggtccgtttctggagatctgatcctcgaaattggcaaactgccccagcacctgacccagagagcccaaaacgcgctcgacaatcttgtgatgctgcataacagcgagcaagggggacgggcctatcgccacgctatggaggaactgcctgatacaatcgagaccctcatgctgcttgccctgattgctgtgctcacgggcggcgtcacactgtttttcctgtccgggagaggactcggcaagacctctatcgggcttctgtgtgttatggccagctccgtgctgctctggatggccagcgtggaaccccattggattgctgcgtctatcatcctggagtttttccttatggtcctgctcattccggaacctgaccggcagcgcacaccccaggataatcaactggcctacgtggttatcggactgctctttatgattcttacagtggctgccaacgagatgggcctgctggagaccacaaagaaagacctcgggatcggacacgtcgccgtggaaaaccaccatcacgctgccatgctggatgtcgaccttcatcctgcgtccgcctggacgctgtacgctgtggccaccacaattatcacccccatgatgagacacacaattgagaataccacggctaacatcagcctcaccgccatcgcgaatcaggccgctattctgatgggcctggataagggctggcctatctctaaaatggacattggggttcccctccttgccctgggatgctattcccaggtgaacccgctgacactcaccgctgccgtcctgatgcttgtggctcattacgccatcattggccctgggctgcaagcgaaggccacacgggaagctcagaaacgcaccgccgctggaatcatgaagaatcccacggttgatggcatcgtggccattgacctcgatcccgtcgtgtatgacgccaagttcgagaaacagctggggcagatcatgctgctcattctttgtacaagccaaatcctgctgatgagaaccacatgggcgctctgcgaatctattaccctggctaccggacctcttacaacgctgtgggagggcagcccgggcaagttttggaacaccacaatcgccgtgtccatggctaatatcttccgggggtcttacctcgccggagccggcctggctttcagcctgatgaaatccctcgggggaggccgcagagggaccggagcccagggcgagacacttggcgaaaagtggaaacggcagctgaaccagctgagcaagtccgagtttaatacctataagagatctgggattatggaagttgaccgcagcgaggcgaaagaaggactcaagcggggcgagacgacaaaacacgccgtctccagagggaccgctaagctgcgctggttcgtggagcggaaccttgtgaaacccgaaggaaaggtcatcgatctgggctgtgggagaggaggctggtcttactattgcgccggcctcaagaaagttaccgaggtgaaggggtacacaaaaggaggccctgggcacgaggagcccattcctatggctacctacggatggaatctggtgaagctgcatagcggcaaagacgtctttttcattccccctgaaaagtgtgatacactcctttgcgacattggggagtcctctccgaaccccacgatcgaggaaggacgcaccctgcgggtgctgaaaatggttgagccttggctcagaggcaatcaattttgtattaagatcctgaacccctatatgcctagcgtggtcgaaacacttgagcagatgcagcgcaagcacggcgggatgctggtgcggaatcccctctccagaaacagcacccatgagatgtactgggtttcttgcggaacaggcaatatcgtgtccgccgtcaacatgaccagccgcatgctgctgaaccggttcacgatggcgcacagaaaaccgacctatgaacgcgatgtggacctcggggccggaacaagacacgtggctgtcgagcctgaagttgccaatctggatattatcggccagcggattgagaacatcaagcatgaacacaaatctacctggcattacgacgaggataatccctataagacatgggcttaccacgggtcctatgaggtgaaacccagcggatctgcctccagcatggtgaacggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgtccagaaataagaagccccggatttgtacccgcgaagagttcacaagaaaagtgcggagcaacgctgccatcggcgctgtctttgtggacgaaaatcagtggaactctgccaaggaggccgttgaggatgaacgcttctgggaccttgtgcatagagagcgggaactgcacaaacaggggaagtgcgcgacctgcgtctacaatatgatgggaaaacgcgagaagaagctcggcgaatttgggaaagctaagggcagcagagccatttggtacatgtggctgggagcccggttcctggagttcgaggctctcggctttatgaacgaagatcactggttctcccgcgaaaattctctgagcggggtggaaggagagggccttcataaactggggtatatcctcagagacatttccaacatccctggaggcaatatgtacgccgatgacacagctgggtgggatacccggatcacagaggacgatctgcagaacgaagcccgcattaccgacatcatggagcccgaacacgcgcttctggccaagtctatttttaaactcacgtatcaaaataaggtcgtgagagttcagcggcctgctaaaaacggcaccgtgatggatgtcatcagccgcagagaccagcggggatccggccaggtggggacatacggactgaacaccttcacaaatatggaggcccaactgattagacagatggaatctgagggcatctttagcccctccgagctcgaaaccccgaacctggctgagcgcgtgcttgattggctggaaaagtatggggttgagcggctcaagagaatggccatcagcggagacgactgtgtggtcaaacctattgatgaccgcttcgcgacggccctgacagctcttaatgatatgggcaaggtgcggaaagacatcccccagtgggaaccttctaaggggtggaacgattggcagcaagttcccttttgctcccatcacttccaccagctgattatgaaagacggcagagagatcgtggtcccttgtcgcaatcaggatgagctcgtgggacgggccagagtcagccagggcgctgggtggtctctgcgcgaaaccgcctgcctgggaaagtcctacgctcaaatgtggcagctcatgtattttcatcggagagacctgcgccttgccgcgaacgccatttgtagcgctgtgcccgttgattggatcccgacatcccggaccacgtggtctattcacgcccatcaccagtggatgaccacagaggacatgctgagcgtgtggaatagagtctggatcgaagagaacccttggatggaagataagacccatatctccagctggggcgacgtgccctacctcgggaaacgggaggaccaatggtgcggatctctgattggccttacagccagagctacctgggccacaaatatccaggttgcgattaaccaggtgcgccggctgatcgggaatgagaactacctcgattatatgacctccatgaagagattcaaaaatgaaagcgaccccgagggcgctctgtggtga

SEQ ID NO: 19287 - RNA, 9879 nt, synthetic construct
  misc_feature 1..9879: note = derived and/or modified CDS sequence (opt5) from DENV-1__EU482822__SS-prME
  source 1..9879: mol_type = other RNA
agcgtgaccatgctgctcatgctgatgcccaccgcccttgctttccacctgacgaccagaggcggggagcctcatatgatcgtgaccaagcaggaacggggaaagtccctcctgtttaagacctctgccggcgttaacatgtgcacccttattgccatggacctgggggagctctgtgaagataccatgacatacaaatgcccgcgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccattctgcgcaaactttgcatcgaagcgaagatttctaatacgacaaccgattccagatgtccgacccaaggagaggccacactgatggaagaacaagacgctaacttcgtttgccggcgcacctttgtggatagaggctggggcaatgggtgtggactcttcggcaaagggagcctgatcacatgcgccaagtttaagtgcgtgacgaaacttgagggaaagatcgtccagtacgaaaacctgaaatattctgtgattgttaccgtgcacacaggcgaccagcatcaagtcgggaatgagtccaccgaacacggaacaaccgctacgatcacaccccaggcccctacaagcgagattcagctcaccgactacggcgccctgacactggattgttctccccggaccggcctcgacttcaacgaaatggtgctgcttacgatgaaggagaaatcctggctggttcataagcagtggtttctcgatctgcctcttccctggacaagcggggcttccacctctcaagagacatggaatcgccaggacctgctcgtgaccttcaaaaccgcgcacgccaagaagcaggaagtcgtggtcctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagttgccgagacccagcacggaaccgtgctggtccagatcaagtacgagggcacagacgcgccgtgcaaaatccctttctccacccaagatgaaaagggggtgacacagaacggacggctgattacggctaatcccatcgttaccgacaaagagaagcctgtgaacattgaagccgagccgccctttggcgagagctatatcgtcattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcatcggcaaactggtgcatcagattttcgggaccgcttacggagttctcttttccggcgtcagctggacgatgaagatcgggattggcgtgctgcttacctggctgggactcaattctagatccacaagcctgtctatgacctgtatcgccgtgggcctggtcacactttacctcggggtgatggttcaggctgattccggatgcgtgattaactggaaaggccgcgaactgaagtgtgggagcggaatcttcgtcaccaatgaggtgcacacatggaccgaacaatataagtttcaggccgactcccctaaacggctgtctgcggccatcggcaaggcttgggaggagggggtttgcggcattagaagcgccacgcgcctcgaaaacatcatgtggaaacagatttccaacgagctgaatcatatccttctggaaaacgacatgaagttcacagtggtcgtgggagatgttgtgggcattctcgctcaggggaaaaagatgatccggccgcaacccatggagcacaaatactcttggaaaagctggggaaaggccaagatcattggcgccgacgtccagaataccacctttatcattgatgggcctaacacacccgaatgtcctgacgatcagagagcttggaatatctgggaggtggaggactatggattcggcatttttaccacgaacatctggctgaagatgcgcgattcctacacacaggtgtgcgaccaccggctgatgagcgcggccatcaaagattctaaggctgtccatgccgacatgggctattggattgaatccgagaaaaatgaaacctggaaacttgccagagctagcttcatcgaggttaagacatgtatttggcccaaatctcacaccctctggtccaacggggtgctggaaagcgagatgatcattccgaagatctacggaggccctatctctcaacataattatcgccccgggtacttcacacagaccgccggaccttggcacctgggcaaactcgagctggattttgacctttgcgaagggacgaccgtggtcgtggatgagcactgcggaaaccggggccccagcctgagaacaaccacagttaccggcaagattatccatgaatggtgttgccggtcctgtacgctccctcccctgcgcttcaaaggggaggacggatgctggtacggcatggagattagaccggtgaaggaaaaggaggaaaatctggtcaaaagcatggtgtctgcggggtccggagaggttgacagcttttcccttggcctcctgtgtatctctattatgatcgaagaggtgatgcggagcagatggtcccgcaagatgctgatgacagggaccctcgctgtcttcctgcttctgattatgggacagctcacatggaacgatctgatccggctgtgcatcatggtgggcgccaatgcctctgacagaatgggcatggggaccacctatcttgctctgatggccacatttaaaatgcgccctatgttcgcggttggactcctgtttagacggctcacgagccgcgaggtgctgcttctgaccattggcctctccctggtcgcttctgtggaactgcccaacagccttgaggaactgggggatggactcgccatgggcatcatgattctgaagctcctgacagacttccaatcccaccagctttgggccaccctgctcagcctgacatttatcaaaaccacgctgtctcttcattacgcttggaagacaatggccatggtgctgtccattgtcagcctcatccccctgtgtctctctaccacctcccagaagacaacctggctgcctgttcttctggggagcctgggatgcaaaccgctcacaatgttcctgatcgctgagaataagatttggggcagaaaatcttggccccttaacgaaggcatcatggccgtgggggtggtctccattctgctcagctccctgctcaagaacgatgtgcctctggcgggaccccttatcgccggcgggatgctgattgcttgttatgttatcagcggatctagcgccgacctgtccctcgagaaagctgccgaggtgtcttgggaagaggaagccgagcacagcggcgcttcccattctatcctggtcgaagtgcaggatgacgggacgatgaagattaaagatgaggagcgggacgatacccttacaatcctgctcaaggcgaccctgctcgccgttagcggagtgtaccctctgtccattcccgctacactttttgtctggtatttctggcaaaagaaaaagcagcgctctggcgtgctgtgggacacccctagccctcccgaagtcgagagagccgtgctggatgacggcatctaccggattatgcagcgcgggctcctgggaagatcccaggttggcgtgggggtctttcaagaaaatgtgttccacacgatgtggcacgttacccggggagccgtgcttatgtatcagggcaaacgcctggagcccagctgggcttctgtcaagaaagacctcatctcctacgggggaggctggagactgcagggcagctggaacacaggggaggaagtccaggtgattgccgttgagcccggaaagaatcctaagaacgtccaaaccgcgcccggcacattcaaaaccccggaaggggaggtgggagctatcgccctcgattttaagcctggcacatctgggtcccccatcgtgaatcgggaaggaaaaattgtcggcctgtacggcaacggggtggttacgaccagcggaacatatgtgtccgccatcgctcaggccaaggcgtctcaggagggccctcttcccgagattgaagacgaggtcttcagaaaacgcaatctgaccatcatggatctgcatcccgggagcggaaagacccggagatacctccctgctattgtgcgcgaagccatcaagcggaaactgagaacacttatcctggccccgacgcgcgttgtggcttccgagatggccgaagctctcaagggcatgcccattcggtatcaaaccacagccgtcaaaagcgagcacaccgggaaggagatcgtggacctgatgtgccatgcgacatttaccatgagactgctctctcctgttcgcgtgcccaactacaatatgattatcatggatgaagcccacttcacggacccttccagcattgctgcccggggctatatctctacaagagtcggaatgggcgaggctgccgccatctttatgaccgctacaccccctgggagcgtggaagcgttcccgcagtccaacgccgtgattcaggatgaggaacgggacatccccgagcgctcttggaatagcggatacgagtggattacagattttcctggcaaaaccgtctggttcgttccctccatcaagtctgggaacgacattgctaattgtcttagaaagaacggaaaacgggtgatccagctgagccgcaagacatttgataccgaatatcagaagacgaagaataacgactgggactacgtggtcacaaccgatatttccgagatgggcgccaacttcagagccgaccgggtgatcgatcctagacgctgcctgaaacccgttatcctcaaggacgggccggaacgggtgattctggctggccctatgcccgtcacagtggccagcgcggctcagagacgcggacggatcggcagaaatcataacaaggagggggatcagtacatttatatgggacagccccttaataacgacgaggatcacgcccactggaccgaagccaaaatgctgctcgacaatatcaacacgcctgagggcattatccccgctctgtttgaacctgagcgcgaaaagtctgccgcgatcgatggggagtaccggctgagaggagaggcccgcaaaaccttcgttgaactcatgagacggggcgaccttccggtgtggctgtcctataaggtcgctagcgaggggttccaatactccgatcgcagatggtgctttgacggcgaacggaataaccaggtgctggaggaaaatatggatgtcgagatttggacaaaagagggagaacgcaagaaactcagaccccggtggctggacgccagaacctattctgaccctcttgctctgcgcgagttcaaggaatttgccgctggccggagaagcgtgtccggggatctcatcctggagattggaaagctgccccagcatctcacacagcgcgcccaaaacgcgcttgacaatctggttatgctgcacaactctgaacagggcgggcgggcctacagacatgctatggaggagctccctgataccatcgaaacactgatgcttctggccctcattgctgtgctgaccggaggcgtgacgctgttctttctcagcggccgggggcttggaaaaacatccatcggcctgctgtgtgtcatggccagctctgttctcctgtggatggcctccgtggagccccactggatcgctgcgagcattatccttgagttctttctgatggtgctcctgattccggagcctgaccgccagagaacaccccaggataatcaactggcctatgtcgtgatcgggctccttttcatgattctgaccgttgctgccaacgagatgggactgctcgaaacaaccaagaaagacctgggcatcgggcacgtggccgtcgagaatcatcaccatgctacaatgcttgatgtggacctgcaccctgcctctgcgtggacgctctacgccgtcgctaccacaattatcacccccatgatgcggcatacaatcgaaaacaccacggccaacatttccctgaccgctatcgccaatcaggcggccattctgatgggactcgataagggctggcctatcagcaaaatggacattggcgtgccccttctggctctggggtgctactctcaggttaacccgctcacactgaccgccgctgtgcttatgctggtcgcccactatgctatcatcggacctggcctccaagccaaggcgacacgcgaggcccagaagagaaccgctgccgggattatgaaaaatcccacggtggatggaatcgttgctattgacctggatcccgtggtctacgacgccaagtttgaaaaacagctgggccagatcatgctccttattctgtgtacaagccaaatcctgctcatgcggaccacatgggccctgtgcgagtccatcacccttgcgaccgggcctctgacaacgctctgggagggatctccgggcaagttctggaacaccacaattgctgtgagcatggccaatatctttcgcggctcctatctggctggggccggactggccttcagcctcatgaaatcccttggcgggggaagacggggcaccggggctcagggagaaacactgggcgagaagtggaagcgccagctgaaccagctctctaaaagcgaatttaatatttacaagagatccggcatcatggaggtggaccggtctgaagccaaagaggggctgaagagaggagagaccacgcgccacgcggttagccggggcacagccaaacttagatggttcgtcgaacgcaacctggtgaagcccgaggggaaggtgattgatctcggatgtggcagagggggatggtcctattactgcgctggcctgaaaaaggtcaccgaagttaaaggctataccaaagggggacctggccatgaggaacccatccctatggccacatacgggtggaatctggtgaaactccactctggaaaggacgtgttctttacaccccctgagaaatgtgatacacttctgtgcgacattggcgagagctccccgaaccccacgatcgaagaggggagaaccctgcgcgtcctcaagatggtggaaccttggctgcggggaaatcaattctgtatcaagattcttaacccctacatgcctagcgttgtggagacactggagcagatgcagagaaaacatggcggcatgctcgtccgcaatcccctgtctcggaactccacccacgaaatgtattgggtgagctgcgggacaggaaatatcgtttctgctgtgaacatgacctccagaatgctgctcaatcgctttacgatggcccaccggaagccgacctacgagaaagatgtcgacctgggcgcggggacaagacatgtggccgtggaacctgaggtcgctaaccttgatattatcggacagcgcattgaaaacatcaagcacgagcataaaagcacctggcactatgacgaggataatccctacaagacatgggcctatcatggctcttacgaagttaagccctccgggagcgcttccagcatggtgaacggagtggtcaaactgctcaccaagccttgggacgtgatccccatggttacacaaattgccatgaccgatacgacacctttcggccagcagagagtgtttaaagagaaggtcgacacccggaccccgaaagctaagcgcggcacagtgcaaatcatggaagttacggccagatggctgtgggggttcctttctcggaataagaaacccagaatttgtacccgggaggaatttacacgcaaggtgagaagcaacgcggccatcggagctgtcttcgtggacgagaatcagtggaactccgccaaagaggctgttgaagatgagcggttttgggacctggtgaagaaagaacgcgagctccacaagcagggcaagtgcgcgacctgcgtctataatatgatggggaaaagagaaaagaaactgggagagttcggcaaggccaaagggtctcgggcgatttggtacatgtggctgggcgctcgctttctcgagttcgaagccctgggatttatgaacgaggatcactggttcagcagagaaaattccctttctggcgtggagggggagggactgcataagctcggctacatcctgcgggacatcagcaaaattcctgggggaaacatgtatgccgatgacacagctggctgggatacccgcatcacagaagacgatcttcagaatgaggccaagattaccgacatcatggaacccgagcacgctctgctcgccacgtccattttcaagctgacctaccaaaacaaagtcgtgagagttcagcggcctgcgaagaatgggacagtgatggatgtcatctctcgcagagaccagcggggcagcggacaggtgggcacctatgggctgaacacatttaccaatatggaagcccaactcatccgccagatggagtccgagggaattttcctgcccagcgaacttgagacgccgaacctggctgaaagagtgctcgattggctggagaaatacggcgttgaacggcttaagagaatggccatctctggggacgactgtgtggtcaaacctattgatgaccgctttgctacagccctgaccgcgctcaacgatatgggaaaggtgcggaaggacatcccccagtgggagccttccaaaggctggaatgattggcagcaagttcccttctgcagccatcactttcaccagctgattatgaaggacgggagagagatcgtggtcccttgtcgcaaccaggatgaactggtgggccgggccagagtctctcagggagctggctggtccctccgcgagacagcctgcctggggaaaagctatgctcaaatgtggcagcttatgtacttccatcggagagacctgcgcctcgccgctaatgccatttgttccgcggtgcccgttgattgggtgccgacctctcggacgacctggagcatccacgcccatcaccagtggatgacaaccgaagacatgctgtccgtctggaacagagtgtggatcgaggaaaatccttggatggaggataagacacatgttagctcttggggagacgtgccctatcttggcaaacgcgaggaccaatggtgcgggtccctgattggactcaccgctcgggccacatgggccagcaacatccaggtcgctattaatcaggtgagacggctgatcggcaacgaaaattacctggattacatgacctctatgaagagatttaagaacgagggggaccccgaaggcgccctctggtga

SEQ ID NO: 19288 - RNA, 9879 nt, synthetic construct
  misc_feature 1..9879: note = derived and/or modified CDS sequence (opt5) from DENV-1__EU482476__SS-prME
  source 1..9879: mol_type = other RNA
agcgtgaccatgctgctgatgctgatgcccaccgcccttgctttccacctgacgacccggggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagaaaatcttggcccctgaacgaagggattatggccgtcggagtggtttccatcctcctgagctccctcctgaagaacgacgtgcctcttgcgggccccctgatcgccgggggaatgctgattgcttgttatgtcatcagcggctctagcgccgatctctccctggagaaagctgccgaggtgtcttgggaagaggaagccgagcacagcggggcttcccataatattcttgttgaagtgcaggacgatggaaccatgaagatcaaagacgaggagcgggatgacacactgaccattctcctgaaggcgacactcctggccgtctctggcgtgtaccctcttagcatccccgctaccctgttcgtctggtatttttggcaaaagaaaaagcagcgctccggcgtgctgtgggatacgccttctcccccggaagttgagagagccgtgctcgacgatgggatctaccggattatgcagcgcggactgcttggcagaagccaggtcggggtgggagttttccaagaaaacgtgttccacaccatgtggcacgtcacacggggcgccgtgctgatgtatcaggggaaacgcctcgagccttcctgggctagcgtgaagaaagacctgatctcttacggaggcggctggagactccaggggtcctggaataccggagaggaagttcaggtcattgccgtggagcccggcaagaaccctaagaatgtgcaaacagcgcccgggacctttaaaacaccggaaggagaggtcggcgctatcgccctggacttcaagcctgggacgagcggatctcccattgtgaaccgggaaggcaaaatcgttggcctttacgggaatggagtggtcaccacatccggcacctatgtgagcgccattgctcaggccaaggcgtcccaggaggggcctctgcccgagatcgaagatgaggtttttagaaaacgcaacctgaccatcatggacctccatcccggatctggcaagacacggagatacctgcctgctattgtgcgcgaagccatcaagcggaaacttagaacgctgattctcgccccgacccgcgtcgtggctagcgagatggccgaagctctgaaggggatgcccatccggtatcaaacaaccgccgttaaatccgagcacacaggcaaggagattgtggatctgatgtgccatgcgaccttcacgatgagactccttagccctgtccgcgtgcccaattacaacatgatcatcatggacgaagcccactttacagatccttcttccattgctgcccggggatatatcagcaccagagtgggcatgggggaggctgccgccattttcatgaccgctacaccccctggatctgtcgaagcgtttccgcagagcaatgccgttatccaggacgaggaacgggatattcccgagcgctcctggaactctggctacgagtggatcaccgacttccctgggaaaacagtgtggtttgtgcccagcatcaagtccggaaatgatattgctaactgtctgagaaagaatggcaaacgggtcatccagctgtctcgcaagaccttcgacacggaatatcagaaaaccaagaacaacgattgggactacgtggttaccacagacattagcgagatgggggccaattttagagccgatcgggtgatcgaccctagacgctgcctcaaacccgtcattctgaaggatggcccggaacgggtgatccttgctggacctatgcccgttaccgtggcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgttcgaacctgagcgcgaaaagagcgccgcgattgacggagagtaccggctcagaggcgaggcccgcaaaacattcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatctggaccaaagagggcgaacgcaagaaactgagaccccggtggcttgatgccagaacatattccgaccctctggctctccgcgagtttaaggagttcgccgctgggcggagatctgtgagcggagacctgattctggagatcggcaagctcccccagcatcttacccagcgcgcccaaaatgcgctggataacctggtgatgctccacaattccgaacaagggggacgggcctacagacatgctatggaggagctgcctgacacaatcgaaacccttatgctgctcgccctgattgctgtcctgacgggcggcgttacactctttttcctttctgggcggggactgggcaaaaccagcatcgggctgctctgtgtgatggcctccagcgtgctgctttggatggcctctgtcgagccccactggattgctgcgtccatcattctggaatttttcctcatggtgctgctgatcccggagcctgatcgccagagaacaccccaggacaaccaactcgcctatgttgtgatcggacttctgtttatgattctgacagtcgctgccaatgagatgggcctcctggaaaccacaaagaaagatcttgggatcggacacgtggccgtcgagaaccatcaccatgctacgatgctggacgtggatctccaccctgccagcgcgtggaccctgtacgccgttgctacaaccattatcacacccatgatgcggcataccattgaaaacacgaccgccaatatctctctgacagctattgccaaccaggcggccatcctcatgggccttgacaagggctggcctatctccaaaatggatattggggtgcccctgctggctctcggatgctacagccaggtcaatccgctgacccttacagccgctgtgctgatgctcgttgcccactatgctatcattggccctgggctgcaagccaaggcgacccgcgaggcccagaagagaacggctgccggaatcatgaaaaaccccacagtggacggcattgtcgctatcgatctggaccccgtggtgtacgatgccaagttcgaaaaacagctcgggcagatcatgcttctgattctgtgtacctctcaaatcctcctgatgcggacaacctgggccctttgcgagagcattaccctggcgacaggacctctcacgaccctgtgggagggctccccgggcaagttttggaatacaaccatcgctgtttctatggccaacattttccgcgggagctatctggctggagccggcctcgccttttcccttatgaaaagcctcgggggaggcagacgggggacaggagctcagggcgaaaccctgggcgagaagtggaagcgccagctcaatcagctgtccaaatctgagttcaacatctacaagagaagcgggatcatggaggtcgaccggtccgaagccaaagagggacttaagagaggcgagacgacacgccacgcggtgtctcgggggaccgccaaactgagatggttcgtggaacgcaatctcgtcaagcccgagggaaaggttattgacctgggctgtgggcggggaggctggagctattactgcgctggcctgaaaaaggtgaccgaagtgaaagggtatacaaagggaggccctgggcatgaggaacccatccctatggccacctacggatggaacctcgtcaaacttcactccggcaaggatgtgtttttcacaccccctgagaaatgtgacacgctgctgtgcgatattggggagtctagcccgaatcccaccatcgaagagggaagaacactccgcgttctgaagatggtggaaccttggcttcggggcaaccaattttgtattaagatcctgaatccctacatgccttccgtcgtggagaccctcgagcagatgcagagaaaacatggcgggatgctggttcgcaaccccctgagcagaaattctacacacgaaatgtattgggtgtcctgcggaaccggcaacattgtcagcgctgtgaatatgacgtctagaatgctcctgaaccgcttcaccatggcccaccggaagccgacatacgagagagacgtggatcttggggcgggaacccgccatgtcgccgttgaacctgaggtggctaacctggacatcatcggccagagaattgaaaatatcaaacacgagcataagtccacatggcactatgatgaggacaacccctacaaaacctgggcctatcatgggagctacgaagtgaagccctctggatccgctagctccatggtcaatggcgtggttaagctcctgacaaaaccttgggatgtgattcccatggtcacccaaatcgccatgacggacacaaccccttttggccagcagcgggtgttcaaggagaaagttgatacccgcacaccgaaggctaaaagagggacggcccaaattatggaagtgaccgcgcggtggctttggggatttctgagcagaaacaagaagccccggatctgtacacgcgaggagttcaccagaaaagtccggtctaatgccgctatcggcgccgtgtttgttgacgagaaccagtggaatagcgctaaggaggccgtggaagacgagcgcttctgggatctcgtccagaaagaaagagagctgcacaagcaggggaaatgcgccacatgcgtgtataacatgatgggaaagcgggaaaagaaactgggcgagtttgggaaggcgaaaggctcccgcgctatttggtacatgtggctcggagccagattcctggagtttgaagcccttggcttcatgaatgaggaccactggttctctcgggaaaacagcctgtccggggtcgagggagagggcctccataagctggggtacatccttcgcgatatttctaaaatccctggaggcaatatgtatgctgacgataccgccgggtgggacacaagaattaccgaagatgacctgcaaaacgaggctaagatcacggatatcatggaacccgagcacgccctcctggcgaccagcatttttaaactgacataccagaataaggtggttcgggtgcagcgccctgccaagaacggcaccgtcatggacgtgatctccagacgggatcagcgcggatctggccaagtggggacatatggactcaataccttcacgaacatggaagctcagctgattagacagatggagagcgagggcatctttcttccctccgaactggagacaccgaacctcgccgaacgggttctggactggcttgagaaatacggggtggaaagactgaagcgcatggctattagcggagatgactgtgtcgtgaaacctatcgacgatcggttcgccaccgcgctcgccgctctgaatgacatgggcaaggttagaaaagatatcccccagtgggagccttctaaggggtggaacgactggcaacaggtgcccttttgctcccatcacttccaccagctgattatgaaggatggccgcgagatcgtcgtgccttgtcggaatcaggacgaactcgtcggacgggcccgcgtgagccaaggcgctgggtggtctctgcgggagacagcctgccttggaaaatcctatgctcagatgtggcagctgatgtactttcatagacgcgatctccggctggccgcgaacgccatttgtagcgctgttcccgtggactgggtcccgacctccagaacgacctggtctatccacgcccatcaccaatggatgacaaccgaagatatgcttagcgtgtggaatcgcgtttggattgaggaaaacccttggatggaggacaagacacatgtgtccagctggggcgatgtcccctatctggggaaacgggaggaccagtggtgcggatctctcatcggcctgaccgccagagctacatgggcctccaatattcaggtggcgatcaaccaggtgcggagactgatcgggaatgaaaactacctcgactacatgaccagcatgaagcgcttcaaaaatgagggcgatcccgaaggagctctgtggtga

SEQ ID NO: 19289 - RNA, 9879 nt, synthetic construct
  misc_feature 1..9879: note = derived and/or modified CDS sequence (opt5) from DENV-1__EU482477__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggaactctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcagcacacaagatgaaaagggggtgacccagaacggacggctgatcacagctaatcccattgtcacggacaaagagaagcctgtgaacatcgaagccgagccgccctttggcgagtcttatattgtgatcggggccggagaaaaagctcttaagctcagctggttcaagaaaggctcctctattgggaagatgtttgaggccaccgctagaggcgcccgccggatggcgatcctgggagatacagcctgggacttcggcagcatcgggggagtttttacctccgtcggcaaactggtgcatcagattttcgggacagcttacggagtgctctttagcggcgtctcttggaccatgaagatcgggattggcgtgctgcttacgtggctgggactcaattccagaagcacctctctgtccatgacatgtatcgccgttggcctggtgaccctttacctcggggtcatggtgcaggctgatagcggatgcgttattaactggaaaggccgcgaactgaagtgtgggtccggaatcttcgtgacaaatgaggtccacacctggacagaacaatataagtttcaggccgactctcctaaacggctgagcgcggccattggcaaggcttgggaggagggggtgtgcggcatcagatccgccacccgcctcgaaaacatcatgtggaaacagatttctaacgagctgaatcatatccttctggaaaacgacatgaagttcacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttaacctgtgcgaagggaccacggtggttgtggacgagcactgcggaaatcggggcccctccctcagaaccacaaccgtcacaggcaagatcatccacgaatggtgttgccggagctgtaccctgcctcccctgcgcttcaaaggggaggatggatgctggtatggcatggagattagaccggtgaaggaaaaggaggaaaaccttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaatgacctgatccggctgtgcattatggtgggcgccaacgctagcgatagaatgggcatggggacaacctaccttgccctgatggcgaccttcaaaatgcgccctatgctcgctgtcggactgctctttagacggctgacatcccgcgaggtgcttctgctcacgatcggcctgtctctggtggccagcgtcgaacttcccaattccctggaggaactcggggacggactggccatgggcatcatgattctcaagctgcttaccgatttccaaagccatcagctgtgggctacactcctgtctctgacctttatcaaaacaacctattcccttcactacgcctggaagacgatggctatggttctgagcattgtgtctctcttccccctgtgtctctccacaaccagccagaagaccacatggctgcctgtgcttctggggtctctgggatgcaaaccgctcaccatgtttctgatcgccgagaacaagatttggggcagaaaatcctggccccttaacgaaggcatcatggcggtcgggatcgtgagcattctgctctccagcctgctcaagaatgacgttcctctggccggaccccttatcgctggcgggatgctgattgcctgttatgtgatctctggaagctccgctgatctgtctctcgagaaagccgccgaggtcagctgggaagaggaagctgagcattccggcgcgtctcacaacattctggtggaagttcaggacgatgggacaatgaagatcaaagacgaggagcgggatgacacgcttaccatcctgctcaaggccacactgctcgctgtgagcggagtctaccctctgtccattcccgccacccttttcgtgtggtatttttggcaaaagaaaaagcagcgctctggcgtcctgtgggatacaccttcccctcccgaagtggagagagccgttctggacgatggcatctaccggattatgcagcgcgggctcctgggaagatcccaggtgggcgtcggggtgttccaagaaaatgttttccataccatgtggcacgtgacgcggggagctgtccttatgtaccagggcaaacgcctggagcccagctgggcctctgtgaagaaagacctcatctcctatgggggaggctggagactgcagggcagctggaacaccggggaggaagtgcaggttattgcggtcgagcccggaaagaatcctaagaacgtgcaaacagctcccggcacctttaaaacatctgaaggggaggtgggagccatcgccctcgacttcaagccgggcacctccgggagccctattgtcaatcgggaaggaaaaatcgtgggcctgtacggcaacggggttgtgacaacgtccggaacctatgtctctgctatcgcccaggcgaaggctagccaggagggcccccttcctgagattgaaaatgaggtgtttagaaaacgcaacctgacaatcatggatctgcaccccgggtccggaaagacccggagatacctccccgccattgttcgcgaagccatcaagcggaaactgagaacccttattctggctcctacacgcgtggtcgccagcgagatggctgaagccctcaagggcatgccgatccggtatcaaacgaccgcggtgaaatctgagcatacagggaaggagatcgttgacctgatgtgccacgccaccttcacaatgagactgctctcccccgtgcgcgtccctaattacaacatgattatcatggatgaagctcattttaccgaccccagctctattgccgctcggggctatatcagcacgagagtgggaatgggcgaggccgccgctattttcatgacagcgacccctcccgggtccgtggaagcctttcctcagtctaatgctgtcatccaggatgaggaacgggacatcccggagcgcagctggaactccggatacgagtggattaccgatttccccggcaaaacagtttggtttgtgccttctatcaagagcgggaatgacattgccaactgtcttagaaagaacggaaaacgggtgatccagctgtcccgcaagaccttcgatacagaataccagaagaccaagaataacgactgggattatgtcgtgacgacagacattagcgagatgggcgccaattttagagctgaccgggttatcgatcccagacgctgcctgaaacctgtgattctcaaggacgggcccgaacgggtcatcctggccggcccgatgcctgtgaccgttgcgtctgctgcccagagacgcggacggatcggcagaaaccacaataaggagggggatcagtacatttatatgggacagccccttaacaatgacgaggatcatgcccactggacagaagctaaaatgctgctcgacaacatcaatacccccgagggcattatccctgccctgttcgaacccgagcgcgaaaagtccgcggccattgatggggagtaccggctgagaggagaggctcgcaaaacgttcgtggaactcatgagacggggcgaccttcctgtctggctgagctataaggtggcctccgaggggtttcaatactctgatcgcagatggtgcttcgacggcgaacggaacaatcaggtcctggaggaaaacatggatgtggagatctggaccaaagagggagaacgcaagaaactcagaccgcggtggctggacgctagaacatatagcgatccccttgccctgcgcgagtttaaggagttcgctgccggccggagatccgtttctggggacctcatcctggagattggaaagctgcctcagcacctcacccagcgcgcgcaaaatgcccttgacaacctggtgatgctgcataatagcgaacagggcgggcgggcttacagacacgccatggaggagctccccgatacaatcgaaaccctgatgcttctggctctcattgccgtgctgacaggaggcgtcaccctgtttttcctctccggccgggggcttggaaaaacgagcatcggcctgctgtgtgttatggcctcttccgtgctcctgtggatggctagcgtggagcctcattggattgcggcctctatcatccttgaatttttcctgatggtcctcctgattcccgagccggaccgccagagaacacctcaggataaccaactggcttacgtggttatcgggctcctttttatgattctgaccgtggccgccaacgagatgggactgctcgaaaccacaaagaaagacctgggcatcgggcacgtcgctgtggagaatcaccatcacgccgcgatgcttgatgtcgacctgcatcccgcctccgcttggaccctctatgccgtggctacaacgattatcacccctatgatgcggcacacaattgaaaacaccacagccaatatcagcctgaccgcgatcgccaaccaggctgccattctgatgggactcgataagggctggcccatctctaaaatggacattggcgttcctcttctggctctggggtgctacagccaggtgaatcccctcacgctgaccgccgctgtccttatgctggtggcccattatgcgatcattggaccgggcctccaagccaaggctacacgcgaggcccagaagagaaccgctgccgggatcatgaaaaaccctacagttgatggaatcgtggccattgacctggatcccgtcgtgtacgacgcgaagttcgaaaaacagctgggccagatcatgctccttattctgtgtacctcccaaatcctgctcatgcggacgacatgggctctgtgcgagtctattacccttgccacagggcccctgaccaccctctgggagggaagccctggcaagttttggaatacaacgatcgctgtgtccatggccaacatcttccgcggcagctatctggccggggctggactggccttttccctcatgaaatctcttggcgggggaagacggggcaccggggcgcagggagaaacactgggcgagaagtggaagcgccagctgaatcagctcagcaaatccgagttcaacacctacaagagatctggcattatggaggttgatcggagcgaagccaaagaggggctgaagagaggagagacaaccaaacacgctgtctcccgcggcacggccaaacttcggtggttcgtggaaagaaatctggtgaagccggaggggaaagtcatcgacctcggatgtggccgcgggggatggtcttattactgcgctggcctgaagaaagttacagaagtgaagggctacaccaaagggggacccggccacgaggaacctattcccatggccacctatgggtggaacctggtgaagctccatagcggaaaagacgtctttttcatccctcccgagaagtgtgatacacttctgtgcgacattggcgagtccagccctaatccgaccatcgaagaggggcggacactgagagtgctcaagatggttgaaccctggctgcgcggaaaccaattttgtattaaaatccttaatccttacatgccctctgtggtcgagacgctggagcagatgcagcggaagcacggcggcatgctcgtgagaaaccctctgtcccgcaatagcacccatgaaatgtattgggtttcttgcgggacaggaaacatcgtgtccgcggtcaacatgaccagccggatgctgctcaatagattcacaatggcccaccgcaaacccacctacgagcgggatgtggacctgggcgctgggacgagacacgtggccgtcgaaccggaggttgctaaccttgatattatcggacagcgcattgaaaatatcaagcatgagcacaaatctacctggcattatgacgaggataacccttacaagacatgggcctatcacggctcctacgaagtgaagcccagcgggtccgctagctctatggtgaatggagtcgtgaaactgctcaccaagccctgggacgttattcctatggtgacacaaatcgccatgaccgatacaaccccctttggccagcagagagtcttcaaagagaaggtggacacgcggacacctaaagcgaagcgcggcaccgcccaaatcatggaagttaccgctaagtggctgtgggggtttcttagcagaaacaaaaagccgcggatttgtacaagagaggagttcacgcggaaagtgcgctccaatgccgctatcggagccgtctttgtggatgagaaccagtggaactctgccaaggaggcggttgaagacgagagattctgggacctggtgcatcgggaacgcgagctccacaaacagggcaagtgcgctacctgcgtctacaacatgatggggaagagagagaaaaagctgggagagtttggcaaagccaaggggagccgggccatttggtatatgtggctgggcgctcgcttcctcgagtttgaagccctgggattcatgaatgaggatcactggttctccagagaaaactctcttagcggcgtggagggggagggactgcataaactcggctacatcctgcgggacatttccaagatccccgggggaaatatgtatgctgatgacacagccggctgggatacccgcatcacagaagacgatcttcagaacgaggcgaaaattaccgacatcatggaacctgagcacgccctgctcgctaagtctatttttaagctgacataccaaaataaagtcgtgagagttcagcggcccgccaagaacgggaccgtgatggatgtcatcagccgcagagaccagcggggctccggacaggtgggcacgtatgggctgaacaccttcacaaatatggaagctcaactcattcgccagatggagagcgagggaatcttttctccttccgaactggagacccccaaccttgccggcagagtgctggattggctcgaaaaacatggggttgagcggctgaagagaatggcgatcagcggagacgattgtgtggtcaaaccgattgacgaccgcttcgccacagctcttaccgccctgaatgatatgggcaaggtgcggaaggacatccctcagtgggaaccctctaaagggtggaacgattggcagcaagttcctttttgctcccaccacttccatcagctcattatgaaggacggcagagagatcgtggtcccctgtcgcaatcaggatgagctggtgggacgggctagagtcagccagggcgccgggtggtccctgcgcgaaacggcttgcctcggaaaatcttacgcccaaatgtggcagctgatgtattttcaccggagagaccttcgcctggcggccaacgctatttgtagcgccgtgcctgttgattgggtgcccacatcccggaccacatggagcatccatgcccaccatcagtggatgaccacggaggacatgctctctgtctggaatagagtgtggattgaagagaacccgtggatggaagataagacccacatctccagctggggcgacgttccttacctggggaaacgcgaggatcaatggtgcggatctcttatcggcctgacagctcgggccacctgggcgacaaatattcaggtggctatcaaccaggtcagacggctcattgggaatgagaactacctggactatatgaccagcatgaagagattcaagaatgaatccgaccccgagggcgccctgtggtga

SEQ ID NO: 19290 - RNA, 9879 nt, synthetic construct
  misc_feature 1..9879: note = derived and/or modified CDS sequence (opt5) from DENV-1__EU482478__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagccacacccaggtctgcgaccaccggctcatgtccgcggccatcaaagatagcaaggctgttcatgccgacatgggctattggatcgaatctgagaaaaatgaaacatggaagctggccagagcttccttcattgaggtgaagacctgtatctggcccaaaagccacacactgtggtctaacggggtgctcgaatccgagatgattatcccgaagatttacggaggccctatcagccaacataattatcgccccgggtacttcacccagacggccggaccttggcacctgggcaaacttgagctggattttgacctctgcgaagggaccacagtcgtggttgatgagcactgcggaaaccggggcccctctctgagaaccacaaccgtgacgggcaagatcattcatgaatggtgttgccggagctgtacactgcctccccttcgcttcagaggggaggacggatgctggtacggcatggagatccggccggtcaaagaaaaggaggaaaatctcgtgaagtccatggttagcgcggggtctggagaggtggactcctttagcctgggcctgctctgtatttccatcatgattgaagaggtcatgagatctcgctggagccggaaaatgctgatgaccgggacacttgctgtgttctttctgctcatcatgggacagctgacctggaacgatctgattagactttgcatcatggttggcgccaatgcctccgaccgcatgggcatggggaccacatatctggctctcatggccacgttcaagatgagacctatgtttgcggtgggactcctgttccggcgcctgacctctagagaggtccttctgctcacaatcggcctgagcctggtggcttccgtggaacttcccaactctctggaggaactcggggatggactggccatgggcattatgatcctcaaactgcttaccgactttcaaagccaccagctgtgggccacactcctgtccctgaccttcattaagacgacatttagccttcattacgcttggaaaaccatggccatggtcctgtctatcgtttccctcttccccctgtgtctcagcaccacatctcagaagaccacatggctgcctgtgcttctggggtccctgggatgcaagccgctcacgatgtttctgattgctgagaataaaatctggggccggcgcagctggccccttaacgaaggcatcatggccgtggggattgtctctatcctgctctccagcctgctcaagaacgatgtgcctctggcgggaccccttattgccggcgggatgctgatcgcttgttatgttatttccggaagctctgccgacctgagcctcgagaaagctgccgaggtgtcctgggaagaggaagccgagcactctggcgctagccataatatcctggtcgaagtgcaggatgacgggaccatgaagatcaaagatgaggagagagacgatacacttaccattctgctcaaggcgacactgctcgccgtttccggagtgtaccctctgtctatccccgctacccttttcgtctggtatttctggcagaagaagaagcagcggagcggcgtgctgtgggacacgcctagccctcccgaagtcgagcgcgccgtgctggatgacggcatttacagaatcatgcagcgggggctcctgggacgctctcaggttggcgtgggggtctttcaagaaaacgtgttccacaccatgtggcacgttacaagaggagccgtgcttatgtatcagggcaaacggctggagcccagctgggcttccgtcaagaaagacctcattagctacgggggaggctggagactgcagggctcttggaataccggggaggaagtccaggtgatcgccgttgagcccggaaagaaccctaaaaatgtccaaacagcgcccggcacctttaagacaccggaaggggaggtgggagctattgccctcgatttcaagcctggcacgtccgggagccccatcgtgaaccgcgaaggaaaaatcgtcggcctgtacggcaatggggtggttaccacatctggaacctatgtgtccgccattgctcaggccaaggcgagccaggagggccctcttcccgagatcgaagacgaggtctttcggaaaagaaacctgaccattatggatctgcatcccgggtccggaaagacacgccggtacctccctgctatcgtgagagaagccattaaacgcaagctgcggacgcttatcctggccccgaccagagttgtggcttctgagatggccgaagctctcaagggcatgcccatccgctatcaaacaaccgccgtcaaaagcgagcacacagggaaggagattgtggacctgatgtgccatgcgaccttcacgatgcggctgctctcccctgttagagtgcccaattacaacatgatcattatggatgaagcccactttacagaccctagctctatcgctgcccggggctatatttccacccgcgtcggaatgggcgaggctgccgccatcttcatgaccgctacaccccctgggagcgtggaagcgtttccgcagtctaatgccgtgatccaggatgaggaaagagacattcccgagcggagctggaactccggatacgagtggatcaccgatttccctggcaaaacagtctggtttgttccctctattaagagcgggaatgacatcgctaactgtcttcgcaaaaatggaaagagagtgattcagctgtcccggaagaccttcgatacggaatatcagaagaccaagaacaacgactgggactacgtggtcaccacagatatctctgagatgggcgccaatttcagagccgaccgcgtgattgatcctcggagatgcctgaaacccgttatcctcaaggacgggccggaacgcgtgatcctggctggccctatgcccgtcaccgtggccagcgcggctcagcggagaggacgcattggccggaaccataataaagagggggatcagtacatctatatgggacagccccttaacaatgacgaggatcacgcccactggacggaagccaagatgctgctcgacaacattaatacccctgagggcatcattcccgctctgtttgaacctgagagagaaaagtccgccgcgatcgatggggagtaccgcctgagaggagaggcccggaaaacattcgttgaactcatgcgcagaggcgaccttccggtgtggctgagctataaggtcgcttctgaggggtttcaatactccgatcggcgctggtgcttcgacggcgaaagaaacaatcaggtgctggaggaaaacatggatgtcgagatctggaccaaagagggagaacggaagaaactcagaccccgctggctggacgcccggacatatagcgaccctcttgctctgagagagtttaaggagttcgccgctggccgccggtccgtgtctggggatctcattctggagatcggaaaactgccccagcatctcacccagagagcccaaaatgcgcttgacaacctggttatgctgcacaatagcgaacagggcgggcgggcctaccgccatgctatggaggagctccctgatacaattgaaaccctgatgcttctggccctcatcgctgtgctgacgggaggcgtgacactgtttttcctctccggcagagggcttggaaagacctctattggcctgctgtgtgtcatggccagctccgttctcctgtggatggccagcgtggagccccactggatcgctgcgtctatcattcttgaatttttcctgatggtgctcctgatcccggagcctgaccggcagcgcacaccccaggataaccaactggcctatgtcgtgattgggctcctttttatgatcctgacagttgctgccaatgagatgggactgctcgaaaccacaaagaaagacctgggcattgggcacgtggccgtcgagaaccatcaccatgctgccatgcttgatgtggacctgcaccctgcgtccgcctggacgctctacgctgtcgccaccacaatcattacccccatgatgagacatacaatcgaaaacaccacggctaatatcagcctgaccgccattgcgaaccaggccgctatcctgatgggactcgataagggctggcctatttctaaaatggacatcggcgtgccccttctggccctggggtgctactcccaggttaatccgctcacactgaccgctgccgtgcttatgctggtcgctcactatgccattatcggacctggcctccaagcgaaggccacacgggaggctcagaaacgcaccgccgctgggatcatgaagaaccccacggtggatggaattgttgccatcgacctggatcccgtggtctacgacgccaagttcgaaaaacagctgggccagattatgctccttatcctgtgtacaagccaaattctgctcatgagaaccacatgggcgctgtgcgagtctatcacccttgctaccgggcctctgacaacgctctgggagggaagcccgggcaagttttggaataccacaatcgccgtgtccatggctaacattttccggggctcttatctggccggggccggactggctttcagcctcatgaaatcccttggcgggggacgcagaggcaccggggcccagggagaaacactgggcgagaagtggaaacggcagctgaatcagctcagcaagtccgaatttaacacctacaagagatctggcatcatggaggtggaccgcagcgaagcgaaagaggggctgaagcggggagagacgacaaaacacgccgtttccagaggcaccgctaaacttcgctggttcgtcgaacggaatctggtgaaacccgaggggaaggtgattgatctcggatgtggcagagggggatggtcttattactgcgccggcctgaagaaagtcaccgaagttaagggctatacaaaagggggacctggccatgaggaacccatccctatggctacctacgggtggaacctggtgaagctccacagcggaaaagacgtgtttttcattccccctgagaagtgtgatacacttctgtgcgacatcggcgagtcctctccgaatcccacgattgaagaggggcgcaccctgcgggtcctcaaaatggtggaaccttggctgagaggaaaccaattttgtatcaagatccttaatccctacatgcctagcgttgtggagacactggagcagatgcagcgcaagcatggcggcatgctcgtccggaaccccctgtccagaaatagcacccacgaaatgtattgggtgtcttgcgggacaggaaacattgtttccgccgtgaatatgaccagccgcatgctgctcaaccggttcacgatggcgcacagaaaaccgacctacgagcgcgatgtcgacctgggcgccgggacaagacatgtggctgtggaacctgagatcgccaaccttgatattatcggacagcggattgaaaatatcaagcacgagcataaatctacctggcactatgacgaggataacccctacaagacatgggcttatcatggctcctacgaagtcaaacccagcgggtctgcctccagcatggttaatggagtggtgaagctgctcaccaagccttgggacgtcatccccatggtgacacaaattgctatgaccgatacgacaccttttggccagcagcgcgttttcaaagagaaggtggacaccagaaccccgaaagccaagcggggcacagcgcaaatcatggaagtcacggccaaatggctgtgggggtttctttccagaaacaagaagccccggatttgtacccgcgaggagttcacaagaaaagtgcggagcaatgctgccatcggagctgtttttgtggacgagaaccagtggaactctgccaaggaggccgtcgaagatgagcgcttctgggacctggtgcacagagaacgggagctccacaaacagggcaagtgcgcgacctgcgtttataacatgatggggaaacgcgaaaagaagctgggagagtttggcaaagctaaggggagcagagccatttggtacatgtggctgggcgcccggttcctcgagttcgaagctctgggatttatgaatgaggatcattggttctcccgcgaaaactctcttagcggcgtggagggggagggactgcacaaactcggctacatcctgagagacatctccaagattcctgggggaaatatgtatgccgatgacacagctggctgggatacccggatcacagaagacgatcttcagaacgaggcccgcattaccgacatcatggaacccgagcatgcgctgctcgccaaatctatttttaagctgacgtaccaaaataaagtcgtgagagtccagcggcctgctaagaacgggaccgtgatggatgttatcagccgcagagaccagcggggctccggacaggtgggcacatatgggctgaataccttcacaaacatggaagcccaactcatcagacagatggagtctgagggaatttttagcccctccgaactggagaccccgaaccttgctgaacgcgtcctggattggctcgagaagtacggcgtggaacggctgaaaagaatggccatcagcggggacgactgtgtggttaagcctattgatgaccgcttcgcgacggcccttacagctctgaatgatatgggaaaagtgcggaaggacatcccccagtgggagccttctaaaggctggaacgattggcagcaagtccccttttgctcccaccacttccatcagctcattatgaaggacgggagagagatcgtggttccttgtcgcaatcaggatgaactggtgggccgggccagagtcagccagggagctggctggtctctgcgcgagaccgcctgcctcgggaagtcctatgctcaaatgtggcagctgatgtactttcaccggagagaccttcgcctggccgcgaacgccatttgtagcgctgtgcccgtcgattggatcccgacatcccggaccacgtggtctatccatgcccaccatcagtggatgaccacagaagacatgctcagcgtgtggaatagagtttggattgaggaaaacccttggatggaggataaaacccacatctccagctggggagacgtgccctatctgggcaagcgggaggaccaatggtgcgggtctcttattggactgacagccagagctacctgggccacaaatatccaggtcgcgattaaccaggtgcgccggctcatcggcaatgaaaactacctggattacatgacctccatgaaaagattcaagaatgagggggaccccgaaggcgctctgtggtga

SEQ ID NO: 19291 - RNA, 9879 nt, synthetic construct
  misc_feature 1..9879: note = derived and/or modified CDS sequence (opt5) from DENV-1__EU482479__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatttgtaccggctctttcaaactcgagaaggaagtcgctgagacccagcacggaacagtgctggttcagatcaagtacgagggcaccgacgccccgtgcaaaatccctttctccacacaagatgaaaagggggtgacgcagaacggacggctgattaccgcgaatcccatcgtcacagacaaagagaagcctgtgaacattgaagctgagccgccctttggcgagagctatatcattatcggggccggagaaaaagcccttaagctctcttggttcaagaaaggcagctccatcgggaagatgtttgaggctaccgccagaggcgctcgccggatggccattctgggagatacagcgtgggacttcggctctatcgggggagtgtttaccagcgttggcaaactggtccatcagattttcgggacggcctacggagtgctcttttccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctgtctgccgcgatcggcaaggcctgggaggagggggtctgcggcattagaagcgctacacgcctcgaaaacatcatgtggaaacagatttccaacgagctgaatcatatccttctggaaaacgacatgaagttcaccgtggttgtgggagatgtcgccggcattctcgctcaggggaaaaagatgatccggccgcaacccatggagtacaaatattcttggaaaagctggggaaaggccaagatcattggcgccgacgtgcagaataccacatttatcattgatgggcctaacacccccgaatgtcctgacgatcagagagcttggaatatctgggaggtggaggactacggattcggcatttttacgacaaacatctggctgaagctgcgcgattcccacacccaggtctgcgaccaccggcttatgagcgcggccatcaaagattctaaggctgttcatgccgacatgggctattggattgaatccgagaaaaatgaaacatggaagctcgccagagctagcttcatcgaggtgaagacctgtatttggcccaaatctcacacactgtggtccaacggggtgctggaaagcgagatgatcattccgaagatctacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagattatccatgaatggtgttgccggtcctgtacactgcctcccctgcgcttcagaggggaggacggatgctggtacggcatggagattcggccggtcaaagaaaaggaggaaaatcttgtcaagagcatggtttctgcggggtccggagaggtggacagcttttccctcggcctgctgtgtatctctattatgatcgaagaggtcatgagaagccgctggtcccggaaaatgctcatgaccgggacactggctgtgttctttcttctgattatgggacagctcacctggaacgatctgatcagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaattggcctctccctggtggcttctgtggaactgcccaacagccttgaggaactgggggatggactcgccatgggcatcatgattctgaaactcctgaccgactttcaatcccaccagctttgggccacactgctcagcctgaccttcatcaagacgacattttctctgcattacgcttggaaaaccatggccatggtcctttccattgttagcctgttccccctctgtctgtctaccacatcccagaagaccacatggctccctgtgctgcttgggagcctgggatgcaagccgctgacgatgtttctcatcgctgagaataaaatctggggccggcgctcttggcccctgaacgaaggcattatggccgtggggatcgtctccattcttctgagctccctcctgaagaacgatgtgcctctcgcgggacccctgatcgccggcgggatgcttattgcttgttatgttatcagcggatctagcgccgacctgtccctggagaaagctgccgaggtgtcttgggaagaggaagccgagcacagcggcgcttcccataatatcctcgtcgaagtgcaggatgacgggaccatgaagattaaagatgaggagagagacgatacactgaccatccttctgaaggcgacactcctggccgtttctggagtgtaccctctcagcattcccgctaccctgttcgtctggtatttctggcagaagaagaagcagcggtccggcgtgctttgggacacgccttctcccccggaagtcgagcgcgccgtgctggatgacggcatctacagaattatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcacctttaagacaccggaaggggaggtgggagctatcgccctggatttcaagcctggcacgagcgggtctcccatcgtgaaccgcgaaggaaaaattgtcggcctctacggcaatggggtggttaccacatccggaacctatgtgagcgccatcgctcaggccaaggcgtcccaggagggccctctgcccgagattgaagacgaggtctttcggaaaagaaaccttaccatcatggatctgcatcccgggtctggaaagacacgccggtacctgcctgctattgtgagagaagccatcaaacgcaagctccggacgctgatccttgccccgaccagagttgtggctagcgagatggccgaagctctgaagggcatgcccattcgctatcaaacaaccgccgtcaaatccgagcacacagggaaggagatcgtggacctcatgtgccatgcgaccttcacgatgcggctgctgagccctgttagagtgcccaattacaacatgattatcatggatgaagcccactttacagacccttcttccattgctgcccggggctatatcagcacccgcgtcggaatgggcgaggctgccgccatcttcatgaccgctacaccccctgggtctgtggaagcgtttccgcagagcaatgccgtgattcaggatgaggaaagagacatccccgagcggtcctggaactctggatacgagtggattaccgatttccctggcaaaacagtctggtttgttcccagcatcaagtccgggaatgacattgctaactgtctccgcaaaaatggaaagagagtgatccagctttctcggaagaccttcgatacggaatatcagaaaaccaagaacaacgactgggactacgtggtcaccacagatattagcgagatgggcgccaatttcagagccgaccgcgtgatcgatcctcggagatgcctgaaacccgttatcctgaaggacgggccggaacgcgtgattctcgctggccctatgcccgtcaccgtggcctccgcggctcagcggagaggacgcatcggccggaaccataataaagagggggatcagtacatttatatgggacagcccctgaacaatgacgaggatcacgcccactggacggaagccaagatgcttctggacaacatcaatacccctgagggcattatccccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatttggaccaaagagggagaacggaagaaactgagaccccgctggctcgacgcccggacatattccgaccctctggctcttagagagtttaaggagttcgccgctggccgccggtctgtgagcggggatctgatcctcgagattggaaaactgccccagcatctgacccagagagcccaaaatgcgctcgacaaccttgttatgctgcacaattccgaacagggcgggcgggcctaccgccatgctatggaggagctgcctgatacaatcgaaaccctcatgctgcttgccctgattgctgtgctcacgggaggcgtgacactgtttttcctgtctggcagagggctcggaaagaccagcatcggccttctgtgtgtcgttgcctccagcgtgctgctctggatggcctctgtggagccccactggatcgctgcgtccattatcctggaatttttccttatggtcctgctcattccggagcctgaccggcagcgcacaccccaggataaccaactggcctatgtggttatcgggctgctctttatgattcttacagtggctgccaatgagatgggactgctggaaaccacaaagaaagacctcggcatcgggcacgtcgccgtggagaaccatcaccatgctgccatgctggatgtcgaccttcaccctgcgagcgcctggacgctgtacgctgtggccaccacaattatcacccccatgatgagacatacaatcgaaaacaccacggctaatatttctctcaccgccatcgcgaaccaggccgctattctgatgggactggataagggctggcctatctccaaaatggacattggcgttcccctccttgccctggggtgctacagccaggtgaatccgctgacactcaccgctgccgtcctgatgcttgtggctcactatgccatcatcggacctggcctgcaagcgaaggccacacgggaggctcagaaacgcaccgccgctgggattatgaagaaccccacggttgatggaatcgtggccattgacctcgatcccgtcgtgtacgacgccaagttcgaaaaacagctgggccagatcatgctgctcattctttgtacatctcaaatcctgctgatgagaaccacatgggcgctctgcgagagcatcaccctggctaccgggcctcttacaacgctgtgggagggatccccgggcaagttttggaataccacaattgccgtgtctatggctaacatcttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcattatggaggttgaccgctccgaagcgaaagaggggctcaagcggggagagacgacaaaacacgccgtctctagaggcaccgctaagctgcgctggttcgtggaacggaatcttgtgaaacccgaggggaaggtcatcgatctgggatgtggcagagggggatggagctattactgcgccggcctcaagaaagttaccgaagtgaagggctatacaaaagggggacctggccatgaggaacccattcctatggctacctacgggtggaacctggtgaagctgcactccggaaaagacgtctttttcattccccctgagaagtgtgatacactcctttgcgacattggcgagtctagcccgaatcccacgatcgaagaggggcgcaccctgcgggtgctgaaaatggttgaaccttggctcagaggaaaccaattttgtatcaagattctgaatccctacatgccttccgtggtcgagacacttgagcagatgcagcgcaagcatggcggcatgctggtgcggaaccccctcagcagaaattctacccacgaaatgtattgggtttcctgcgggacaggaaacatcgtgagcgccgtcaatatgacctctcgcatgctgctgaaccggttcacgatggcgcacagaaaaccgacctacgagaaggatgtggacctcggcgccgggacacgccatgtggctgtcgaacctgaggttgccaacctggatattatcggacagagaattgaaaatatcaaacacgagcataagtccacctggcactatgacgaggataacccctacaaaacatgggcttatcatggcagctacgaagtgaagccctctgggtccgccagctccatggtgaatggagtcgtgaaacttctgaccaaaccttgggacgttatccccatggtgacacaaattgctatgaccgatacgacaccttttggccagcagcgggtcttcaaggagaaagtggacacccgcaccccgaaggccaaaagaggcacagcgcaaatcatggaagttacggccaagtggctctgggggtttctgagccggaacaagaaacccagaatttgtacccgggaggagttcacacgcaaggtgagatctaatgctgccatcggagctgtctttgtggacgagaaccagtggaatagcgccaaagaggccgttgaagatgagcggttctgggaccttgtgcaccgcgaaagagagctgcacaagcagggcaaatgcgcgacctgcgtctataacatgatggggaagcgggaaaagaaactcggagagtttggcaaggctaaagggtcccgcgccatttggtacatgtggctgggcgccagattcctggagttcgaagctctcggatttatgaatgaggatcattggttctctcgggaaaacagcctgtccggcgtggagggggagggacttcacaagctgggctacatcctccgcgacatctctaaaattcctgggggaaatatgtatgccgatgacacagctggctgggataccagaatcacagaagacgatctgcagaacgaggcccggattaccgacatcatggaacccgagcatgcgcttctggccaagagcatttttaaactcacgtaccaaaataaggtcgtgcgcgttcagagacctgctaagaacgggaccgtgatggatgtcatctcccggcgcgaccagagaggctctggacaggtgggcacatatgggctgaataccttcacaaacatggaagcccaactgatccggcagatggagagcgagggaatcttttcccccagcgaactcgagaccccgaacctggctgaaagagtgcttgattggctgaaaaagtacggcgttgagcgcctcaaacggatggccatctctggggacgactgtgtggtcaagcctattgatgacagattcgcgacggccctgacagctcttaatgatatgggaaaagtgcgcaaggacatcccccagtgggaaccttccaagggctggaacgattggcagcaagttcccttttgcagccaccacttccatcagctgattatgaaagacgggcgggagatcgtggtcccttgtagaaatcaggatgagctcgtgggccgcgcccgggtctctcagggagctggctggtccctgagagaaaccgcctgcctgggaaagagctatgctcaaatgtggcagctcatgtactttcaccgccgggacctgagacttgccgcgaacgccatttgttccgctgtgcccgttgattggatcccgacatctcgcaccacgtggagcatccatgcccaccatcagtggatgaccacagaggacatgctgtccgtgtggaatcgggtctggattgaagagaacccttggatggaagataaaacccacatcagctcttggggagacgtgccctatctcggcaagagagaggaccaatggtgcgggtccctgattggacttacagcccgggctacctgggccacaaatatccaggttgcgattaaccaggtgagacgcctgatcggcaatgagaactacctcgattacatgaccagcatgaaacggttcaagaatgaaggggaccccgagggcgctctgtggtga

SEQ ID NO: 19292 - RNA, 9879 nt, synthetic construct
  misc_feature 1..9879: note = derived and/or modified CDS sequence (opt5) from DENV-1__EU482480__SS-prME
  source 1..9879: mol_type = other RNA
agcgtgaccatgctgctgatgctgatgcccacagctcttgctttccacctgacgaccagaggaggggaacctcatatgatcgtgtccaagcaggaacggggaaaatctctcctgtttaagacaagcgccggcgttaacatgtgcacccttatcgcgatggacctgggggagttctgtgaagatacaatgacctacaaatgcccgcgcatcacagaggctgaacccgacgatgtggactgttggtgcaatgccaccgatacgtgggtgacctatggaacatgtacccaaattggcgagcacagacgggacaagcgctccgtcgccctcgctcctcatgtggggctgggactggagacaagaaccgaaacgtggatgtctagcgagggcgcctggaaacagatccagcgggttgaaacatgggctctccgccaccccggctttaccgtgattgccctgttccttgcgcatgccatcgggacatccatcacccagaagggaattatctttattctgctcatgctggctaccccttctatggccatgagatgcgtcggcatcgggagccgggatttcgtggagggactttccggcgctacatgggttgacgtggtcctggagcacgggagctgtgtgacgaccatggccaaggataaacccacactcgacattgaactgctgaagaccgaggtgacaaaccctgcggtcctccgcaaactgtgcatcgaagccaagatttctaataccacgacagattccagatgtccgacccaaggagaggctacccttgttgaagaacaagacgccaactttgtgtgccggcgcacattcgtggatagaggctggggcaatgggtgtggactgtttggcaaagggagcctcattacctgcgctaagttcaagtgcgtcacaaaactggagggaaagatcgtgcagtacgaaaaccttaaatattctgttattgtgacggtccacaccggcgaccagcatcaagtggggaatgagtccacagaacacggaaccatcgccacaattacaccccaggcccctagcacggagatccagctgaccgactacggcgctctcacactggattgttctccccggaccggcctggactttaacgaaatggttctcctgacaatgaaggagaaatcctggcttgtgcataagcagtggttcctggatctccctctgccctggaccagcggggcgtccacgtctcaagagacatggaatcgccaggaccttctggtcacctttaaaacagcccacgctaagaagcaggaagtggtcgtgctcggaagccaagagggcgccatgcacaccgccctgaccggggctacagaaattcagacgtccggaaccacaaccatcttcgccggccatctgaaatgcagactcaagatggataaactgacacttaaggggatgagctatgttatgtgtaccggctctttcaaactggagaaggaagtggcggagacgcagcacggaacagtcctcgtgcagatcaagtacgagggcaccgacgctccgtgcaaaattcctttttccacccaagatgaaaagggggttacacagaacggacggctgatcaccgccaatcccattgtgacagacaaagagaagcctgtcaacatcgaagccgagccgcccttcggcgagagctatattgtgatcggggctggagaaaaagccctgaaactttcttggtttaagaaaggcagctccatcgggaagatgttcgaggctacggccagaggcgcgcgccggatggccattctcggagataccgcttgggactttggctctatcgggggagtgttcacaagcgttggcaaactggtccatcagatttttgggaccgcctacggagtgctgttctccggcgtgagctggacaatgaagatcgggattggcgtcctcctgacctggcttggactcaattctagatccacgagcctctctatgacctgtatcgctgtgggcctggttacactgtaccttggggtgatggtccaggccgattccggatgcgtgattaactggaaaggccgcgaactcaagtgtgggagcggaatctttgttaccaatgaggtgcacacatggaccgaacaatataagttccaggcggactcccctaaacggctgtctgccgctatcggcaaggcctgggaggagggggtctgcggcattagaagcgctacacgcctggaaaacatcatgtggaaacagatttccaacgagctcaatcatatcctgcttgaaaacgacatgaagctgaccgtggttgtgggagatgtcgccggcattctcgcccaggggaaaaagatgatccggccgcaacccatggagtacaaatattcttggaagatctggggaaaggctaaaattatcggcgcggacgtgcagaatacgacatttattatcgatgggcctaacacccccgaatgtcctgacgatcagagagcctggaatatttgggaggtggaggactacggattcggcatctttaccacaaacatctggctgaagctgcgcgatagctatacccaggtctgcgaccaccggcttatgtccgctgccattaaagatagcaaggccgttcacgctgacatgggctactggatcgaatctgagaaaaatgaaacgtggaagctcgccagagcgtccttcattgaggtgaagacatgtatctggcccaaaagccataccctgtggtctaacggggtgctggaatccgagatgattatcccgaagatctatggaggccctattagccaacacaattaccgccccgggtacttcacacagaccgctggaccttggcatctcggcaaactggagcttgattttgacctgtgcgaagggacaaccgtcgtggttgatgagcactgcggaaaccggggcccctctctcagaacgaccacagtgaccggcaagatcattcacgaatggtgttgccggagctgtacactgcctcccctgcgcttcaaaggggaggacggatgctggtatggcatggagatcagaccggtcaaggaaaaggaggaaaatcttgtgaaatccatggttagcgccgggtctggagaggtggactcctttagcctcggcctgctgtgtatttccatcatgattgaagaggtcatgcggtctagatggagccgcaagatgctcatgaccgggacgctggccgtgttctttcttctgatcatgggacagctcacatggaacgatctgatccggctgtgcattatggttggcgctaatgcctccgacagaatgggcatggggaccacataccttgcgctgatggctaccttcaaaatgcgccctatgtttgccgtgggactcctgttcagacggctcacctctcgcgaggtcctgcttctgacaatcggcctcagcctggtggcctccgtggaactgcccaactctcttgaggaactgggggatggactcgctatgggcattatgatcctgaagctcctgacggactttcaaagccatcagctttgggccaccctgctctccctgacattcattagaaccacatttagcctgcactatgcttggaaaaccatggccatggtcctttctatcgtttccctgttccccctctgtctgagcacgacatctcagaagaccacctggctccctgtgctgcttgggtccctgggatgcaagccgctgacaatgtttctcatcgcggagaataaaatttggggccggaagtcctggcccctgaacgaaggcatcatggccgtggggattgtctctatccttctgtccagcctcctgaaaaacgatgtgcctctcgctggacccctgattgccggcgggatgcttatcgcttgttacgttatctccggaagctctgccgacctgagcctggagaaggccgctgaggtgtcctgggaagaggaagcggagcattctggcgccagccacaatattctcgtcgaagtgcaggatgacgggaccatgaaaatcaaggatgaggagcgcgacgatacactgacgattcttctgaaagctaccctcctggccgtttccggagtgtatcctctctctatccccgccacactgttcgtctggtacttctggcaaaagaagaaacagagaagcggcgtgctttgggacacccctagccctcccgaagtcgagcgggctgtgctggatgacggcatttatcgcatcatgcagagagggctgctcggacggtctcaggttggcgtgggggtctttcaagaaaacgtgttccatacaatgtggcacgttacccgcggagccgtgctgatgtaccagggcaagagacttgagcccagctgggcgtccgtcaaaaaggacctgattagctacgggggaggctggcggctccagggctcttggaatacgggggaggaagtccaggtgatcgctgttgagcccggcaagaaccctaagaatgtccaaaccgcccccggcacatttaagacctccgaaggggaggtgggagccatcgctctggatttcaaaccgggcacaagcgggtctcctattgtgaacagagaaggaaagatcgtcggcctctatggcaatggggtggttaccacatccggaacgtacgtgagcgccattgcgcaggctaaagcctcccaggagggccccctgcctgagatcgaagacgaggtctttcgcaagcggaaccttaccattatggatctgcaccccgggtctggaaaaacaagacgctatctgcccgccatcgtgcgggaagctatcaagagacgcctccggaccctgattcttgcccctaccagagttgtggctagcgagatggccgaagcgctgaagggcatgccgatccgctaccaaacaacggccgtcaaatccgagcataccgggaaggagattgtggacctcatgtgccacgctacattcaccatgcggctgctgagccccgttagagtgcctaattataacatgatcattatggatgaagcccattttacagacccctcttccatcgctgcccggggctacatcagcacccgcgtcggaatgggcgaggccgctgcgattttcatgacggccacacctcccgggtctgtggaggcttttcctcagagcaatgccgtgatccaggatgaagaaagagacattccggagcggtcctggaactctggatatgagtggatcaccgatttccccggcaaaaccgtctggtttgttcctagcattaagtccgggaatgacatcgccaactgtctccgcaaaaatggaaagagagtgattcagctttctcggaagacattcgataccgaataccagaagaccaagaacaacgactgggactacgtggtcaccacggatatcagcgagatgggcgctaatttcagagccgaccgcgtgatcgatccccggagatgcctgaaacctgttattctgaaggacgggcccgaacgcgtgatcctcgcgggcccgatgcctgtcacagtggcttccgccgcccagcggagaggacgcattggccggaaccacaataaagagggggatcagtatatctacatgggacagcccctgaacaatgacgaggatcatgctcactggaccgaagccaagatgcttctggacaacattaatacacccgagggcatcatccctgcgctctttgaacccgagagagaaaagagcgccgctattgatggggagtatcgcctgagaggagaggcccggaaaaccttcgttgaactgatgcgcagaggcgacctccctgtgtggctttcttacaaggtcgcttccgaggggtttcaatatagcgatcggcgctggtgcttcgacggcgaaagaaacaatcaggtgctggaggaaaacatggatgtcgagatctggacgaaagagggagaacggaagaaactgagaccgcgctggctcgacgcccggacctactccgaccccctggctcttagagagtttaaggagttcgccgcgggccgccggtctgtgagcggggatctgattctcgagatcggaaaactgcctcagcacctgacacagagagcccaaaatgctctcgacaaccttgttatgctgcataattccgaacagggcgggcgggcctatcgccacgctatggaggagctgcccgataccattgaaacactcatgctgcttgccctgatcgccgtgctcaccggaggcgtgacactgtttttcctgtctggcagagggctcggaaagaccagcatcggccttctgtgtgtcatggcttccagcgttctgctctggatggcgtctgtggagcctcattggattgccgcttccatcattctggaatttttccttatggtgctgctcatccccgagccggaccggcagcgcacgcctcaggataaccaactggcctacgtcgtgattgggctgctctttatgatccttacagttgccgctaatgagatgggactgctggaaaccaccaagaaagacctcggcattgggcacgtggccgtcgagaaccaccatcacgcggccatgctggatgtggaccttcatcccgctagcgcctggacactgtacgctgtcgccaccacaatcatcacgcctatgatgagacacaccattgaaaacacaaccgcgaatatctctctcacagccattgctaaccaggccgctatcctgatgggactggataagggctggcccatttccaaaatggacatcggcgtgcctctccttgccctggggtgctatagccaggttaatcccctgaccctcacggctgccgtgctgatgcttgtcgcgcattacgccatcattggaccgggcctgcaagctaaggccacccgggaggctcagaaacgcacagccgccgggatcatgaagaaccctaccgtggatggaattgttgcgatcgacctcgatcccgtggtctatgacgctaagttcgaaaaacagctgggccagattatgctgctcatcctttgtacatctcaaatcctgctgatgagaaccacgtgggccctctgcgagagcattacactggctaccgggccccttacaaccctgtgggagggatcccctggcaagttttggaataccacaatcgccgtgtctatggccaacattttccggggcagctacctcgctggggccggactggcgttctccctgatgaaaagcctcggcgggggacgcagaggcacgggggcccagggagaaacccttggcgagaagtggaaacggcagctgaatcagctgtccaagtctgaatttaacacatataagagaagcggcatcatggaggtggaccgctccgaagctaaagaggggctcaagcggggagagaccacaaaacacgccgtttctagaggcaccgctaagctgcgctggttcgtcgaacggaatcttgtgaaaccggaggggaaggtgattgatctgggatgtggcagagggggatggagctactattgcgccggcctcaagaaagtcacggaagttaagggctacacaaaagggggacccggccacgaggaacctatccccatggcgacctacgggtggaacctggtgaagctgcattccggaaaagacgtgtttttcattcctcccgagaagtgtgataccctcctttgcgacatcggcgagtctagccctaatccgacaatcgaagaggggcgcaccctgcgggtcctgaaaatggtggaaccctggctcagaggaaaccaattttgtattaagatcctgaatccttatatgccctccgttgtggagacacttgagcagatgcagcgcaagcacggcggcatgctggtccggaaccctctcagcagaaattctacgcatgaaatgtactgggtgtcctgcgggaccggaaacattgttagcgccgtgaatatgacatctcgcatgctgctgaaccggttcaccatggctcacagaaaacccacatatgagcgcgatgtcgacctcggcgccgggaccagacacgtggctgtggaaccggaggtcgccaacctggatatcattggacagcggatcgaaaatatcaagcatgagcacaaatccacgtggcattacgacgaggataacccttataagacctgggcttaccacggcagctatgaagttaaaccctctgggtccgccagctccatggtgaatggagtggtcaaacttctgacaaagccctgggacgtgattcctatggttacccaaatcgcgatgacagataccacaccctttggccagcagcgcgtgttcaaagagaaggtcgacaccagaacgcctaaagccaagcggggcacagctcaaattatggaagtgaccgccaaatggctctgggggtttctgagcagaaacaagaagccgcggatctgtacccgcgaggagttcacaagaaaagttcggtctaatgctgccattggagccgtgtttgtcgacgagaaccagtggaatagcgcgaaggaggctgtggaagatgagcgcttctgggaccttgttcatagagaacgggagctgcacaaacagggcaagtgcgccacgtgcgtgtacaacatgatggggaaacgcgaaaagaagctcggagagtttggcaaagccaaggggtccagagctatctggtacatgtggctgggcgcccggttcctggagttcgaagctctcggatttatgaatgaggatcactggttctctcgcgaaaacagcctgtccggcgtcgagggggagggacttcataaactgggctatatcctcagagacatttctaagatccccgggggaaatatgtacgccgatgacaccgcgggctgggatacacggattaccgaagacgatctgcagaacgaggccaaaatcacagacattatggaacctgagcacgcccttctggccaagagcatctttaaactcacctatcaaaataaggtggtccgcgtgcagagacccgctaagaacgggacagttatggatgtgatctcccggcgcgaccagagaggctctggacaggtcggcacctacgggctgaatacgttcaccaacatggaagcccaactgattcggcagatggagagcgagggaatcttttcccctagcgaactcgagacacccaacctggcgggcagagtgcttgattggctggaaaaacatggggtggagcgcctcaagcggatggccatttctggagacgactgtgttgtgaaaccgatcgatgacagattcgctaccgccctgacagctcttaatgatatgggcaaggtccgcaaagacattcctcagtgggaaccctccaaggggtggaacgattggcagcaagtgcctttttgcagccaccacttccatcagctgatcatgaaggacggccgggagattgttgtgccctgtagaaatcaggatgagctcgtcggacgcgcccgggtgtctcagggcgctgggtggtccctgagagaaaccgcctgcctgggaaaaagctatgcgcaaatgtggcagctcatgtactttcaccgccgggacctgagacttgccgctaacgccatctgttccgccgtccctgtggattgggttcccacgtctcgcacaacctggagcatccatgctcaccatcagtggatgacaaccgaggacatgctgtccgtgtggaatcgggtctggattgaagagaacccgtggatggaagataagacgcacgtgagctcttggggcgacgttccttatctcgggaaaagagaggaccaatggtgcggatccctgatcggccttaccgcccgggcgacatgggctaccaatattcaggtggccatcaaccaggtcagacgcctgctcgggaatgagaactacctggattacatgacaagcatgaagcggttcaaaaatgaatctgaccccgagggcgccctgtggtga

SEQ ID NO: 19293 - RNA, 9879 nt, synthetic construct
  misc_feature 1..9879: note = derived and/or modified CDS sequence (opt5) from DENV-1__EU482481__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaatatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataatcaccgccccgggtatttcacacagaccgccggaccttggcacctcggcaaactggagcttgattttgacctgtgcgaagggacgaccgttgtggtcgatgagcattgcggaaaccggggccccagcctcagaacaaccacagtgaccggcaagattatccacgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctacctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccatcagctgtgggccaccctcctgagcctgacatttattaaaaccacgctttctctgcactatgcttggaagacaatggccatggtgctctccatcgtgagcctgttccccctctgtctgtctaccacctcccagaagacaacctggcttcctgtcctgctggggagcctcggatgcaaaccgctgacaatgtttcttattacggagaataagatctggggcagaaaatcttggcccctgaacgaaggcattatggctgtgggggttgtgtccatcctcctgagctccctcctgaagaacgatgtccctcttgccggacccctgatcgcgggcgggatgctgattgcctgttacgtgatcagcggatctagcgctgacctctccctggagaaagccgctgaggtttcttgggaagaggaagccgagcatagcggcgcctcccacaatattcttgtggaagtccaggatgacgggaccatgaagatcaaagatgaggagcgggacgatacactgaccattctcctgaaggctacactcctggcggtgtctggagtctatcctcttagcatccccgccaccctgttcgtgtggtacttttggcaaaagaaaaagcagcgctccggcgttctgtgggacacgccttctcccccggaagtggagagagctgtcctcgatgacggcatctatcggattatgcagcgcgggctgcttggaagaagccaggtgggcgttggggtgttccaagaaaacgtcttccacaccatgtggcatgtgacacggggagccgtgctgatgtaccagggcaaacgcctcgagccttcctgggccagcgttaagaaagacctgatctcttatgggggaggctggagactccagggctcctggaataccggggaggaagtccaggtgattgctgtggagcccggaaagaaccctaagaatgtccaaacagcccccggcacctttaaaacaccggaaggggaggtgggagcgatcgctctggatttcaagcctggcacgagcgggtctcccattgttaaccgggaaggaaaaatcgtgggcctttacggcaatggggtcgtgaccacatccggaacctacgttagcgccattgcccaggctaaggcctcccaggagggccctctgcccgagatcgaagacgaggtgtttagaaaacgcaacctgaccatcatggatctccaccccgggtctggaaagacacggagatatctgcctgcgattgtccgcgaagctatcaagcggaaacttagaacgctgattctcgccccgacccgcgtggttgccagcgagatggctgaagccctgaagggcatgcccatccggtaccaaacaaccgctgtgaaatccgagcatacagggaaggagattgtcgacctgatgtgccacgccaccttcacgatgagactccttagccctgtgcgcgtgcccaattataacatgatcatcatggatgaagcgcattttacagacccttcttccattgccgctcggggctacatcagcaccagagtcggaatgggcgaggccgctgccattttcatgaccgccacaccccctgggtctgttgaggcttttccgcagagcaatgcggtgatccaggatgaggaacgggacattcccgagcgctcctggaactctggatatgagtggatcaccgatttccctggcaaaacagtgtggtttgtccccagcatcaagtccgggaatgacattgccaactgtctgagaaagaatggaaaacgggtgatccagctgtctcgcaagaccttcgatacggaataccagaagaccaagaacaacgactgggactatgttgtgaccacagatattagcgagatgggcgctaattttagagccgaccgggtcatcgatcctagacgctgcctcaaacccgtgattctgaaggacgggccggaacgggttatccttgccggccctatgcccgtgaccgtcgcttccgccgcgcagagacgcggacggattggcagaaaccacaataaggagggggatcagtacatctacatgggacagcccctgaacaatgacgaggatcacgctcattggacggaagccaaaatgctcctggacaacatcaatacccctgagggcattatccccgccctgttcgaacctgagcgcgaaaagagcgctgccattgatggggagtatcggctcagaggagaggcgcgcaaaacattcgtggaacttatgagacggggcgacctgccggtctggctgtcttacaaggtggcctccgaggggtttcaatatagcgatcgcagatggtgcttcgacggcgaacggaacaatcaggttctcgaggaaaacatggatgtggagatctggaccaaagagggagaacgcaagaaactgagaccccggtggcttgacgctagaacatactccgaccctctggccctccgcgagtttaaggagttcgctgccggccggagatctgtgagcggggatctgatttccgagatcggaaagctgccccagcacctcacccagcgcgctcaaaatgcccttgacaacctggtcatgctgcataattctgaacagggcgggcgggcgtatagacacgccatggaggagctccctgatacaatcgaaaccctgatgcttctggctctcattgccgttctgacgggaggcgtgacactgtttttcctcagcggccgggggcttggaaaaacctccatcggcctgctgtgtgtgatggctagctctgtcctcctgtggatggcctccgtggagccccactggattgccgctagcatcattcttgaatttttcctgatggttctcctgatcccggagcctgaccgccagagaacaccccaggataaccaactggcgtacgtggtcatcgggctcctttttatgattctgacagtggccgctaatgagatgggactgctcgaaaccacaaagaaagacctgggcatcgggcatgtcgccgtggagaaccaccatcacgccacgatgcttgatgttgacctgcatcctgcttctgcctggaccctctatgcggtggccacaaccattatcacacccatgatgcggcacaccattgaaaacacgaccgctaatatctccctgacagccattgctaaccaggccgcgatcctgatgggactcgataagggctggcctatcagcaaaatggacattggcgtcccccttctggccctggggtgctactctcaggtgaatccgctcaccctgacagctgccgttcttatgctggtggctcactacgccatcattggacctggcctccaagctaaggccacccgcgaggcgcagaagagaacggccgctgggatcatgaaaaaccccacagtcgatggaattatcgccatcgacctggatcccgtggtgtatgacgctaagttcgaaaaacagctgggccagattatgctccttatcctgtgtaccagccaaattctgctcatgcggacaacctgggccctgtgcgagtccatcacccttgccacagggcctctgacgaccctctgggagggatctccgggcaagttttggaatacaaccattgcggttagcatggctaacatcttccgcggctcctacctggccggggctggactggcctttagcctcatgaaatcccttggcgggggaagacggggcacaggggcccagggagaaaccctgggcgagaagtggaagcgccagctgaatcagctctctaaaagcgagttcaacatctataagagatccggcattatggaggtcgaccggtctgaagctaaagaggggctgaagagaggagagacgacacgccatgccgtgagccggggcaccgcgaaacttagatggttcgtggaacgcaatctggtcaagcccgaggggaaggttatcgatctcggatgtggcagagggggatggtcctactattgcgccggcctgaaaaaggtgaccgaagtgaaaggctacacaaaagggggacctggccacgaggaacccattcctatggctacctatgggtggaacctggtcaaactccattctggaaaggacgtgtttttcacaccccctgagaaatgtgatacgcttctgtgcgacatcggcgagagctccccgaatcccaccattgaagaggggagaacactgcgcgttctcaagatggtggaaccttggctgcggggaaaccaattttgtatcaagattcttaatccctacatgcctagcgtcgtggagaccctggagcagatgcagagaaaacacggcggcatgctcgttcgcaaccccctgtctagaaattccacacacgaaatgtactgggtgagctgcgggaccggaaacatcgtctctgccgtgaatatgacgtccagaatgctgctcaaccgcttcaccatggctcatcggaagccgacatatgagagagatgtggacctgggcgccgggacccgccacgtcgcggttgaacctgaggtggccaaccttgatatcattggacagagaatcgaaaatattaaacatgagcacaagagcacatggcattacgacgaggataacccctataaaacctgggcttaccacggctcttatgaagtgaagccctccgggagcgcctccagcatggtcaatggagtggttaagctgctcacaaaaccttgggacgtgatccccatggtcacccaaattgctatgacggatacaaccccttttggccagcagcgggtgttcaaggagaaagttgacacccgcacaccgaaggccaaaagaggcacggctcaaatcatggaagtgaccgcccggtggctgtgggggtttctttctagaaacaagaagccccggatctgtacacgcgaggagttcaccagaaaagtccggagcaatgcggccattggagctgtgtttgttgacgagaaccagtggaactccgccaaggaggctgtggaagatgagcgcttctgggacctggtccagaaagaaagagagctccacaagcagggcaaatgcgccacatgcgtgtacaacatgatggggaagcgggaaaagaaactgggagagtttggcaaggccaaagggtctcgcgcgatctggtatatgtggctgggcgctagattcctcgagtttgaagccctgggattcatgaatgaggatcattggttcagccgggaaaactccctttctggcgtcgagggggagggactgcacaagctcggctacattctgcgcgacatcagcaaaattcctgggggaaatatgtacgccgatgacaccgctggctgggatacaagaatcaccgaagacgatcttcaaaacgaggccaagatcacggacattatggaacccgagcatgctctgctcgccacctccatctttaaactgacatatcagaataaggtggttcgggtgcagcgccctgcgaagaacgggaccgtcatggatgtgatttctagacgggaccagcgcggcagcggacaagtgggcacatacgggctgaataccttcacgaacatggaagcccagctcatcagacagatggagtccgagggaatttttctgcccagcgaacttgagacaccgaacctggctgaacgggttctcgattggctggagaaatatggcgtggaaagacttaagcgcatggccatctctggggacgactgtgtcgtgaaacctatcgatgaccggttcgctaccgccctgacagcgctcaatgatatgggaaaggttagaaaagacattccccagtgggagccttccaagggctggaacgattggcaacaggtgcccttttgcagccaccacttccatcagctgatcatgaaggacgggcgcgagattgtcgtgccttgtcggaatcaggatgaactggtcggcagagcccgcgtgtctcaaggagctggctggtccctccgggagaccgcctgcctggggaaaagctacgctcagatgtggcagcttatgtattttcacagacgcgacctgcggctcgccgctaacgccatctgttccgcggttcccgtggattgggtcccgacgtctagaaccacatggagcattcatgcccaccatcaatggatgaccacagaagacatgctgtccgtgtggaatcgcgtttggatcgaggaaaacccttggatggaggataagacccacgtgagctcttggggagacgtcccctaccttggcaaacgggaggaccagtggtgcgggtccctgattggactcacagctagagccacctgggccagcaatatccaggtggctatcaaccaggtgcggagactgattggcaatgaaaactatctggattacatgacgtctatgaagcgcttcaaaaatgagggggaccccgaaggcgccctctggtga

SEQ ID NO: 19294 - RNA, 9879 nt, synthetic construct
  misc_feature 1..9879: note = derived and/or modified CDS sequence (opt5) from DENV-1__EU482482__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcctgtgcttctggggagcctgggatgcaagccgctcacgatgtttctgatcgctgagaataaaatttggggccggcgctcttggccccttaacgaaggcatcatggccgtggggatcgtctccattctgctcagctccctgctcaagaacgatgtgcctctggcgggaccccttatcgccggcgggatgctgattgcttgttacgttatcagcggatctagcgccgacctgtccctcgagaaagctgccgaggtgtcttgggaagaggaagccgagcatagcggcgcttcccacaatattctggtcgaagtgcaggatgacgggaccatgaagatcaaagatgaggagagagacgatacacttaccatcctgctcaaggcgacactgctcgccgtttctggagtgtatcctctgagcattcccgctacccttttcgtctggtacttctggcagaagaagaagcagcggtccggcgtgctgtgggacacgccttctcccccggaagtcgagcgcgccgtgctggatgacggcatctatagaattatgcagcgggggctcctgggacgcagccaggttggcgtgggggtctttcaagaaaacgtgttccataccatgtggcacgttacaagaggagccgtgcttatgtaccagggcaaacggctggagccttcctgggctagcgtcaagaaagacctcatctcttacgggggaggctggagactgcagggctcctggaataccggggaggaagtccaggtgattgccgttgagcccggaaagaaccctaaaaatgtccaaacagcgcccggcacctttaagacaccggaaggggaggtgggagctatcgccctcgatttcaagcctggcacgagcgggtctcccattgtgaaccgcgaaggaaaaatcgtcggcctgtatggcaatggggtggttaccacatccggaacctacgtgagcgccatcgctcaggccaaggcgtcccaggagggccctcttcccgagattgaagacgaggtctttcggaaaagaaacctgaccatcatggatctgcaccccgggtctggaaagacacgccggtatctccctgctattgtgagagaagccatcaaacgcaagctgcggacgcttattctggccccgaccagagttgtggctagcgagatggccgaagctctcaagggcatgcccatccgctaccaaacaaccgccgtcaaatccgagcatacagggaaggagatcgtggacctgatgtgccacgcgaccttcacgatgcggctgctcagccctgttagagtgcccaattataacatgattatcatggatgaagcccattttacagacccttcttccattgctgcccggggctacatcagcacccgcgtcggaatgggcgaggctgccgccattttcatgaccgctacaccccctgggtctgtggaagcgtttccgcagagcaatgccgtgatccaggatgaggaaagagacatccccgagcggtcctggaactctggatatgagtggattaccgatttccctggcaaaacagtctggtttgttcccagcatcaagtccgggaatgacattgctaactgtcttcgcaaaaatggaaagagagtgatccagctgtctcggaagaccttcgatacggaataccagaagaccaagaacaacgactgggactacgtggtcaccacagatattagcgagatgggcgccaatttcagagccgaccgcgtgatcgatcctcggagatgcctgaaacccgttattctcaaggacgggccggaacgcgtgatcctggctggccctatgcccgtcaccgtggcctccgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagagcgccgcgattgatggggagtatcgcctgagaggagaggcccggaaaacattcgttgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgtcgagatctggaccaaagagggagaacggaagaaactcagaccccgctggctggacgcccggacatactccgaccctcttgctctgagagagtttaaggagttcgccgctggccgccggtctgtgagcggggatctcatcctggagattggaaaactgccccagcacctcacccagagagcccaaaatgcgcttgacaacctggttatgctgcataattccgaacagggcgggcgggcctatcgccacgctatggaggagctccctgatacaatcgaaaccctgatgcttctggccctcattgctgtgctgacgggaggcgtgacactgtttttcctctctggcagagggcttggaaagaccagcatcggcctgctgtgtgtcatggcctccagcgttctcctgtggatggcctctgtggagccccattggattgctgcgtccatcatccttgaatttttcctgatggtgctcctgattccggagcctgaccggcagcgcacaccccaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcctgcgagcgcctggacgctctacgctgtcgccaccacaattatcacccccatgatgagacacacaattgaaaacaccacggctaatatctctctgaccgccatcgcgaaccaggccgctattctgatgggactcgataagggctggcctatctccaaaatggacattggcgtgccccttctggccctggggtgctatagccaggttaatccgctcacactgaccgctgccgtgcttatgctggtcgctcattacgccatcattggacctggcctccaagcgaaggccacacgggaggctcagaaacgcaccgccgctgggatcatgaagaaccccacggtggatggaatcgttgccattgacctggatcccgtggtctatgacgccaagttcgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttttggaataccacaatcgccgtgtctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcattatggaggtggaccgctccgaagcgaaagaggggctgaagcggggagagacgacaaaacacgccgtttctagaggcaccgctaaacttcgctggttcgtcgaacggaatctggtgaaacccgaggggaaggtgatcgatctcggatgtggcagagggggatggagctactattgcgccggcctgaagaaagtcaccgaagttaagggctacacaaaagggggacctggccacgaggaacccattcctatggctacctacgggtggaacctggtgaagctccattccggaaaagacgtgtttttcattccccctgagaagtgtgatacacttctgtgcgacatcggcgagtctagcccgaatcccacgatcgaagaggggcgcaccctgcgggtcctcaaaatggtggaaccttggctgagaggaaaccaattttgtattaagatccttaatccctatatgccttccgttgtggagacactggagcagatgcagcgcaagcacggcggcatgctcgtccggaaccccctgagcagaaattctacccatgaaatgtactgggtgtcctgcgggacaggaaacatcgttagcgccgtgaatatgacctctcgcatgctgctcaaccggttcacgatggcgcacagaaaaccgacctatgagcgcgatgtcgacctgggcgccgggacaagacacgtggctgtggaacctgaggtcgccaaccttgatattatcggacagcggattgaaaatatcaagcatgagcacaaatccacctggcattacgacgaggataacccctataagacatgggcttaccacggcagctatgaagttaaaccctctgggtccgccagctccatggtgaatggagtggtcaagctgctcaccaagccttgggacgtgattcccatggttacacaaatcgctatgaccgatacgacaccttttggccagcagcgcgtgttcaaagagaaggtcgacaccagaaccccgaaagccaagcggggcacagcgcaaatcatggaagtgacggccaaatggctgtgggggtttcttagcagaaacaagaagccccggatttgtacccgcgaggagttcacaagaaaagttcggtctaatgctgccatcggagctgtgtttgtcgacgagaaccagtggaatagcgccaaggaggccgtggaagatgagcgcttctgggacctggttcatagagaacgggagctccacaaacagggcaagtgcgcgacctgcgtgtacaacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtcgagggggagggactgcataaactcggctatatcctgagagacatttctaagatccctgggggaaatatgtacgccgatgacacagctggctgggatacccggatcacagaagacgatcttcagaacgaggcccgcattaccgacatcatggaacccgagcacgcgctgctcgccaaaagcatttttaagctgacgtatcaaaataaagtggtcagagtgcagcggcctgctaagaacgggaccgttatggatgtgatctcccgcagagaccagcggggctctggacaggtcggcacatacgggctgaataccttcacaaacatggaagcccaactcattagacagatggagagcgagggaatcttttcccccagcgaactggagaccccgaaccttgctaagcgcgtgctggattggctcgaaaaatatggcgtggagcggctgaagagaatggccatctctggggacgactgtgttgtgaaacctattgatgaccgcttcgcgacggcccttacagctctgaatgatatgggaaaggtccggaaagacatcccccagtgggaaccttccaagggctggaacgattggcagcaagtgcccttttgcagccatcacttccaccagctcattatgaaggacgggagagagatcgttgtgccttgtcgcaatcaggatgagctggtcggccgggccagagtgtctcagggagctggctggtccctgcgcgaaaccgcctgcctcgggaaaagctacgctcaaatgtggcagctgatgtattttcatcggagagaccttcgcctggccgcgaacgccatttgttccgctgtccccgtggattggatcccgacatctcggaccacgtggagcattcacgcccatcaccagtggatgaccacagaggacatgctctccgtttggaatagagtgtggatcgaagagaacccttggatggaagataagacccatatcagctcttggggagacgtcccctacctgggcaaacgggaggaccaatggtgcgggtcccttattggactgacagccagagctacctgggccacaaatatccaggtggcgattaaccaggttcgccggctcatcggcaatgagaactacctggattatatgaccagcatgaagagattcaaaaatgaatctgaccccgagggggctctgtggtga

SEQ ID NO: 19295 - RNA, 9879 nt, synthetic construct
  misc_feature 1..9879: note = derived and/or modified CDS sequence (opt5) from DENV-1__EU482485__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgctatagccaggtgaatccgctgacactcaccgctgccgtcctgatgcttgtggctcattacgccatcattggccctgggctgcaagcgaaggccacacgggaagctcagaaacgcaccgccgctggaatcatgaagaaccccacggttgatggcatcgtggccattgacctcgatcccgtcgtgtatgacgccaagttcgagaaacagctggggcagatcatgctgctcattctttgtacatctcaaatcctgctgatgagaaccacatgggcgctctgcgaaagcattaccctggctaccggacctcttacaacgctgtgggagggctccccgggcaagttttggaataccacaatcgccgtgtctatggctaacatcttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcatcgatctgggctgtgggagaggaggctggagctactattgcgccggcctcaagaaagttaccgaggtgaaggggtacacaaaaggaggccctgggcacgaggagcccattcctatggctacctacggatggaacctggtgaagctgcattccggcaaagacgtctttttcattccccctgaaaagtgtgatacactcctttgcgacattggggagtctagcccgaatcccacgatcgaggaaggacgcaccctgcgggtgctgaaaatggttgagccttggctcagaggcaaccaattttgtattaagatcctgaatccctatatgccttccgtggtcgaaacacttgagcagatgcagcgcaagcacggcgggatgctggtgcggaaccccctcagcagaaattctacccatgagatgtactgggtttcctgcggaacaggcaacatcgtgagcgccgtcaatatgacctctcgcatgctgctgaaccggttcacgatggcgcacagaaaaccgacctatgaacgcgatgtggacctcggggccggaacaagacacgtggctgtcgagcctgaagttgccaacctggatattatcggccagcggattgagaatatcaagcatgaacacaaatccacctggcattacgacgaggataacccctataagacatgggcttaccacgggagctatgaggtgaaaccctctggatccgccagctccatggtgaatggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgagcagaaacaagaagccccggatttgtacccgcgaagagttcacaagaaaagtgcggtctaatgctgccatcggcgctgtctttgtggacgaaaaccagtggaatagcgccaaggaggccgttgaggatgaacgcttctgggaccttgtgcatagagagcgggaactgcacaaacaggggaagtgcgcgacctgcgtctacaacatgatgggaaaacgcgagaagaagctcggcgaatttgggaaagctaagggctccagagccatttggtacatgtggctgggagcccggttcctggagttcgaggctctcggctttatgaatgaagatcactggttctctcgcgagaacagcctgtccggggtggaaggagagggccttcataaactggggtatatcctcagagacatttctaatatccctggaggcaacatgtacgccgatgacacagctgggtgggatacccggatcacagaggacgatctgcagaatgaagcccgcattaccgacatcatggagcccgaacacgcgcttctggccaagagcatttttaaactcacgtatcaaaacaaggtcgtgagagttcagcggcctaccaaaaatggcacagtgatggatgtcatctcccgcagagaccagcggggatctggccaggtggggacctacggactgaacacattcaccaacatggaggctcaactgattagacagatggaaagcgagggcatcttttcccccagcgagctcgaaacgccgaatctggccgagcgcgtgcttgattggctggaaaagtatggggttgagcggctcaagagaatggctatctctggagacgactgtgtggtcaaacctgtggatgaccgcttcgccacagcgctgaccgcccttaacgatatgggcaaggttcggaaagacattccccagtgggaaccttccaaggggtggaatgattggcagcaagtgcccttttgcagccatcacttccaccagctgatcatgaaagacggcagagagattgtcgtgccttgtcgcaaccaggatgagctcgtcggacgggctagagtgtctcagggcgccgggtggtccctgcgcgaaacagcttgcctgggaaagagctacgcccaaatgtggcagctcatgtattttcatcggagagacctgcgccttgctgccaatgcgatctgttccgccgttcccgtggattggattccgacctctcggacgacctggagcatccacgctcatcaccagtggatgacaaccgaggacatgctgtccgtctggaacagagtgtggattgaagagaatccttggatggaagataagacacatatcagctcttggggcgacgttccctacctcgggaaacgggaggaccaatggtgcggatccctgatcggccttaccgccagagccacatgggctaccaacattcaggtggccatcaatcaggtccgccggctgattgggaacgagaattacctcgattatatgacgagcatgaagagattcaaaaacgaatctgaccccgagggcgcgctgtggtga

SEQ ID NO: 19296 - RNA, 9879 nt, synthetic construct
  misc_feature 1..9879: note = derived and/or modified CDS sequence (opt5) from DENV-1__EU482486__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacgagcgccggcgttaatatgtgcacccttattgcgatggacctgggggaactctgtgaagatacaatgacctacaagtgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagagctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggcctcttcaagctggagaaggaagtggctgagacacagcacggaaccgttctggtgcagattaaatacgagggcaccgacgccccgtgcaagatccctttctccacacaagatgaaaaaggggtcacccagaacggaagacttatcacagcgaatcccattgtgacggacaaggagaaacctgtgaacatcgaagctgagccgccctttggcgagagctatattgttatcggggccggagaaaaggccctcaagctgtcttggttcaaaaagggcagctccattgggaaaatgtttgaggctaccgcccggggcgctagacgcatggccatcctgggagatacagcgtgggacttcggctctatcgggggagtctttaccagcgtgggcaagctcgtgcatcagattttcgggacagcctacggagtcctgttttccggcgtgagctggaccatgaaaatcgggattggcgttcttctgacgtggctcggactcaattctcggtccaccagcctgtctatgacatgtatcgctgtgggccttgtcaccctctacctgggggtgatggttcaggccgattccggatgcgtgattaactggaagggcagagaactgaagtgtgggagcggaatcttcgtcacaaatgaggtgcacacctggacagaacaatataaatttcaggctgactcccctaagcgcctctctgccgcgattggcaaagcctgggaggagggggtttgcggcatccggagcgctaccagactggaaaacatcatgtggcgccagatttccaacgagcttaatcatatcctgctcgaaaacgacatgaagttcacggtggtcgtgggagatgtggtcggcattctggcccaggggaaaaagatgatccggccgcaacccatggagcacaaatactcttggaaaagctggggaaaggctaagattatcggcgccgacgttcagaatacaacctttatcattgatgggcctaacacccccgaatgtcctgacgatcagagagcctggaatatctgggaggtggaggactatggattcggcatttttacaaccaacatctggctgaaacttcgcgattcctacacacaggtgtgcgaccaccggctcatgagcgctgcgattaaagattctaaggccgtccatgctgacatgggctattggatcgaatccgagaaaaatgaaacatggaagctggccagagccagcttcatcgaggtgaagacctgtatttggcccaaatctcacacactgtggtccaacggggttctcgaaagcgagatgatcattccgaagatctacggaggccctatttctcaacataattatcgccccgggtacttcacccagacagctggaccttggcacctgggcaaacttgagctggattttgacctctgcgaagggaccacggtggtcgtggatgagcactgcggaaaccggggccccagcctgagaaccacaaccgttacaggcaagatcatccatgaatggtgttgccggtcctgtaccctgcctccccttcgcttcaaaggggaggacggatgctggtacggcatggagattagaccggtgaaggaaaaggaggaaaatctcgtcaaaagcatggtgtctgccgggtccggagaggttgacagcttttccctgggcctgctctgtatctctattatgatcgaagaggtgatgcggagcagatggtcccgcaagatgctgatgacggggacacttgcggtcttctttctgctcattatgggacagctgacctggaacgatctgatccggtcttgcattatggtgggcgctaatgccagcgacagaatgggcatggggacaacctatcttgccctgatggctaccttcaaaatgcgccctatgtttgccgtgggactcctgttcagacggctcacatcccgcgaggtcctgcttctgacgatcggcctctctctggttgcgagcgtggaactgcccaactcccttgaggaactgggggatggactcgctatgggcatcatgattctgaagctcctgaccgactttcaaagctaccagctttgggccacactgctctctctgaccttcatcaaaacaaccttttccctgcactatgcctggaagacgatggctatggtgcttagcattgtctctctgctccccctgtgtctctccacaaccagccagaagaccacatggctgcctgtgcttctggggtctctgggatgcaaaccgctcaccatgttcctgatcgccgagaataagatttggggcagaaaatcctggccccttaacgaaggcatcatggctgttgggatcgtgagcattctgctctccagcctgctcaagaacgatgtccctctggccggaccccttatcgcgggcgggatgctgattgcctgttacgtgatctctggaagctccgctgacctgtctctcgagaaagccgctgaggttagctgggaagaggaagccgagcattccggcgcctctcacaatattctggtggaagtccaggatgacgggacaatgaagatcaaagatgaggagcgggacgatacgcttaccatcctgctcaaggctacactgctcgcggtgagcggagtctatcctctgtccattcccgccaccctttttgtgtggtacttctggcaaaagaaaaagcagcgctctggcgttctgtgggacacacctagccctcccgaagtggagagagctgtcctggatgacggcatctatcggattatgcagcgcgggctcctgggaagatcccaggtgggcgttggggtgttccaagaaaacgtctttcataccatgtggcacgtgacgcggggagccgtgcttatgtaccagggcaaacgcctggagcccagctgggcctctgttaagaaagacctcatctcctacgggggaggctggagactgcagggcagctggaataccggggaggaagtccaggtgattgctgtggagcccggaaagaaccctaagaatgtccaaacagcccccggcaccttcaaaacaccggaaggggaggtgggagcgatcgctctcgattttaagcctggcacctctgggtcccccattgttaaccgggaaggaaaaatcgtgggcctgtatggcaatggggtcgtgacaacgagcggaacctacgtttccgccatcgcccaggctaaggcctctcaggagggccctcttcccgagattgaagacgaggtgttcagaaaacgcaacctgacaatcatggatctgcaccccgggagcggaaagacccggagatatctccctgcgattgtccgcgaagctatcaagcggaaactgagaacccttattctggccccgacacgcgtggttgcctccgagatggctgaagccctcaagggcatgcccatccggtaccaaacgaccgctgtgaaaagcgagcatacagggagagagatcgtcgacctgatgtgccacgccacctttacaatgcgcctgctctctcctgtgcgggtgcccaattataacatgattatcatggatgaagcgcatttcaccgacccttccagcattgccgctagaggctacatctctacgcgggtcggaatgggcgaggccgctgccatttttatgacagccacaccccctgggagcgttgaggctttcccgcagtccaatgcggtgatccaggatgaggaacgcgacatccccgagagatcttggaacagcggatatgagtggattaccgattttcctggcaagacagtgtggttcgtcccctccatcaaatctgggaatgacattgccaactgtcttcggaagaatggaaagcgcgtgatccagctgagcagaaaaacctttgatacagaataccaaaagaccaaaaacaacgactgggactacgttgtgacgacagatatttccgagatgggcgctaatttccgggccgacagagtcatcgatcctcgccggtgcctgaagcccgtgattctcaaagacgggccggaaagagttatcctggccggccctatgcccgtgaccgtcgctagcgccgcgcagcgccggggaagaatcggccgcaaccacaataaggagggggatcagtatatttacatgggacagccccttaacaatgacgaggatcatgctcactggacagaagccaagatgctgctcgacaacatcaatacccctgagggcattatccccgccctgttcgaacctgagcgggaaaaatctgctgccattgatggggagtatagactgcgcggagaggcgagaaagacgtttgtggaactcatgcggcgcggcgaccttccggtctggctgtcctacaaagtggccagcgaggggttccaatattccgatagacggtggtgctttgacggcgaacgcaacaatcaggttctggaggaaaacatggatgtggagatctggaccaaggagggagaacgcaagaagctccggcccagatggctggacgctcgcacatactctgaccctcttgccctgcgggagttcaaagaatttgctgccggcagacgcagcgtgtccggggatctcatcctggagattggaaagctgccccagcacctcacccagcgggctcaaaatgcccttgacaacctggtcatgctgcataattctgaacagggcgggagagcgtatcggcacgccatggaggagctccctgatacaatcgaaaccctgatgcttctggctctcattgccgttctgacaggaggcgtgaccctgttctttctcagcggccgcgggcttggaaagacgtccatcggcctgctgtgtgtgatggctagctctgccctcctgtggatggcctccgtcgagccccattggattgctgcgagcatcatccttgagttctttctgatggtgctcctgattccggagcctgacagacagcggacaccccaggataaccaactggcctacgttgtgatcgggctccttttcatgattctgaccgtcgctgccaatgagatgggactgctcgaaaccaccaagaaggacctgggcatcgggcacgtggccgtcgagaaccaccatcacgctaccatgcttgatgtggacctgcatcctgcctctgcgtggacactctacgccgttgctacgaccattatcacacccatgatgcgccacaccattgaaaacacaaccgccaatatctccctgacggctatcgccaaccaggcggccattctgatgggactcgataaaggctggcctatcagcaagatggacattggcgtgccccttctggctctggggtgctattctcaggtcaatccgctcaccctgacagccgctgtgcttatgctggttgcccattacgctatcattggacctggcctccaagccaaagcgaccagagaggcccagaagcggacagctgccgggatcatgaagaaccccaccgtggatggaatcgtcgctattgacctggatcccgtggtgtatgacgccaaatttgaaaagcagctgggccagatcatgctccttattctgtgtacgagccaaatcctgctcatgcgcacaacctgggccctgtgcgagtccattacacttgcgaccgggcctctgaccacactctgggagggatctccgggcaaattctggaatacgaccatcgctgttagcatggccaacatctttagaggctcctacctggctggggccggactggccttcagcctcatgaagtcccttggcgggggacggcgcggcacaggggctcagggagaaaccctgggcgagaaatggaagagacagctgaatcagctctctaagagcgagttcaacacatataaacggtccggcattatggaggtcgacagatctgaagccaaggaggggctgcgccggggagagaccacgaaacacgcggtgagcagaggcacagccaaacttcgctggtttgtggaacggaatctggtcaaacccgaggggaaggttatcgatctcggatgtggcagagggggatggtcctactattgcgctggcctgaagaaagtgaccgaagtgaagggctacaccaaagggggacctggccacgaggaacccattcctatggccacatacgggtggaacctggtcaagctccattctggaaaagacgtgttctttattccccctgagaagtgtgatacccttctgtgcgacatcggcgagagctccccgaatcccacaatcgaagaggggcgcacgctgcgggttctcaaaatggtggaaccttggctgagaggaaaccaattctgtattaagatccttaatccctatatgcctagcgtcgtggagaccctggagcagatgcagcgcaagcacggcggcatgctcgttcggaaccccctgtctagaaattccacacatgaaatgtactgggtgagctgcgggaccggaaacatcgtctctgctgtgaatatgacatcccgcatgctgctcaaccggtttaccatggcccacagaaaaccgacgtatgagcgcgatgtggacctgggcgcggggaccagacacgtcgccgttgaacctgaggtggctaaccttgatattatcggacagcggattgaaaatatcaagcatgagcacaaaagcacatggcattacgacgaggataacccctataagacctgggcctaccacggctcttatgaagtgaaaccctccgggagcgcttccagcatggtcaatggagtggttaagctgctcacaaagccttgggacgtgattcccatggtcacccaaatcgccatgacagataccacgcctttcggccagcagcgcgtgtttaaagagaaggttgacacaagaaccccgaaagctaagcggggcaccgcccaaatcatggaagtgacagcgagatggctgtgggggttcctttctcggaacaaaaagccccgcatttgtacgagagaggaatttacccggaaggtccgcagcaatgccgctatcggagccgtgttcgttgacgagaaccagtggaactccgctaaagaggccgtggaagatgagagattttgggacctggtccatcgggaacgcgagctccacaagcagggcaaatgcgccacatgcgtgtacaacatgatggggaagagagagaagaagctgggagagttcggcaaggcgaaagggtctcgggctatttggtacatgtggctgggcgcccgctttctcgagttcgaagccctgggattcatgaatgaggatcactggtttagcagagaaaactccctttctggcgtcgagggggagggactgcataagctcggctatatcctgcgggacattagcaaaatccctgggggaaatatgtacgctgatgacaccgccggctgggatacacgcatcaccgaagacgatcttcagaacgaggctaagattacagacatcatggaacccgagcacgccctgctcgcgacctccattttcaaactgacgtatcaaaataaggtggttagagtgcagcggcctgcccgcaacgggaccgtcatggatgtgatctctagacgggaccagagaggcagcggacaggtgggcacatacgggctgaatacctttacaaacatggaagctcaactcattcgccagatggagtccgagggaatcttcagcccctctgaactggagaccccgaaccttgccgaacgggttctggattggctcgagaaacatggcgtggaaagactgaagcgcatggctatctccggggacgactgtgtcgtgaagcctattgatgaccggtttgccacggcgcttagcgccctgaatgatatgggaaaagttagaaaggacatcccccagtgggagccttctaaaggctggaacgattggcagcaagtgcccttctgctcccaccactttcatcagctcattatgaaggacgggcgcgagatcgtcgtgccttgtcggaatcaggatgaactggtcggcagagctcgcgtgagccagggagccggctggtccctgcgggagacagcttgcctcgggaaatcttatgcccaaatgtggcagctgatgtacttccacagacgcgaccttcggctggctgccaacgcgatttgtagcgccgttcccgtggattgggtcccgacctccagaacaacctggagcatccatgctcaccatcagtggatgacgaccgaagacatgctctctgtgtggaatcgggtttggattgaggaaaacccttggatggaggataagacacacatctccagctggggagacgtgccctatctgggcaagagagaggaccaatggtgcgggtctcttatcggactgaccgcccgcgccacatgggctaccaatattcaggtcgccatcaaccaggtgcggagactcattggcaatgaaaactacctggattacatgacaagcatgaaacgctttaagaatgactccgatcccgagggggcgctgtggtga

SEQ ID NO: 19297 - RNA, 9879 nt, synthetic construct
  misc_feature 1..9879: note = derived and/or modified CDS sequence (opt5) from DENV-1__EU482487__SS-prME
  source 1..9879: mol_type = other RNA
agcgtgaccatgctgctcatgctgatgcccacagcccttgctttccacctgacgaccagaggcggggagcctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgccaaaaatgagacatggaagctcgctagagccagcttcattgaagtgaagacctgtatctggcccaaatctcacacactgtggtccaacggggtgctggagagcgaaatgattatcccgaagatttacggaggccctatctctcaacataattatcgccccgggtacttcacccagacggcgggaccttggcacctcggcaaactggagcttgattttgacctgtgcgaggggaccacagtcgtggttgatgaacactgcggaaaccggggccccagcctcagaaccacaaccgtgacgggcaagatcattcatgagtggtgttgccggtcctgtacactgcctcccctgcgcttcagaggggaagacggatgctggtacggcatggagatccggccggtcaaagagaaggaagagaatcttgtcaagagcatggtttctgctgggtccggagaagtggacagcttttccctcggcctgctgtgtatttctatcatgattgaggaagtcatgagaagccgctggtcccggaaaatgctcatgaccgggacactggccgtgttctttcttctgatcatgggacagctcacctggaacgatctgattagactgtgcatcatggttggcgccaatgcttctgaccgcatgggcatggggaccacatatcttgccctgatggcgacgttcaagatgagacctatgtttgctgtgggactcctgttccggcgcctcaccagcagagaggtcctgcttctgacaatcggcctctccctggtggcctctgtggagctgcccaacagccttgaggaactgggggatggactcgccatgggcattatgatcctgaaactcctgaccgactttcaatcccaccagctttgggctacactgctcagcctgaccttcattaagacgacattttctctgcattacgcctggaaaaccatggctatggtcctttccatcgttagcctgttccccctctgtctgtctaccacatcccagaagaccacatggctccctgtgctgcttgggagcctgggatgcaagccgctgacgatgtttctcattgccgaaaataaaatctggggccggcgctcttggcccctgaacgagggcatcatggcggtggggattgtctccatccttctgagctccctcctgaagaacgatgtgcctctcgccggacccctgattgctggcgggatgcttatcgcctgttatgttattagcggatctagcgctgacctgtccctggaaaaagccgccgaggtgtcttgggaggaagaggctgaacacagcggcgcgtcccataatatcctcgtcgaggtgcaggatgacgggaccatgaagatcaaagatgaagagagagacgatacactgaccattcttctgaaggccacactcctggctgtttctggagtgtaccctctcagcatccccgccaccctgttcgtctggtatttctggcagaagaagaagcagcggtccggcgtgctttgggacacgccttctcccccggaggtcgaacgcgccgtgctggatgacggcatttacagaatcatgcagcgggggctgctcggacgcagccaggttggcgtgggggtctttcaagagaacgtgttccacaccatgtggcacgttacaagaggagctgtgctgatgtatcagggcaaacggcttgaaccttcctgggccagcgtcaagaaagacctgatttcttacgggggaggctggagactccagggctcctggaataccggggaggaggtccaggtgatcgcggttgaacccggaaagaaccctaaaaatgtccaaacagctcccggcacctttaagacaccggagggggaagtgggagccattgccctggatttcaagcctggcacgagcgggtctcccatcgtgaaccgcgagggaaaaatcgtcggcctctacggcaatggggtggttaccacatccggaacctatgtgagcgctattgcccaggcgaaggcttcccaggaaggccctctgcccgagatcgaggacgaagtctttcggaaaagaaaccttaccattatggatctgcatcccgggtctggaaagacacgccggtacctgcctgccatcgtgagagaggccattaaacgcaagctccggacgctgatccttgctccgaccagagttgtggccagcgaaatggctgaggccctgaagggcatgcccatccgctatcaaacaaccgcggtcaaatccgaacacacagggaaggagattgtggacctcatgtgccatgccaccttcacgatgcggctgctgagccctgttagagtgcccaattacaacatgatcattatggatgaggctcactttacagacccttcttccatcgccgctcggggctatattagcacccgcgtcggaatgggcgaagccgccgctatcttcatgaccgcgacaccccctgggtctgtggaggcctttccgcagagcaatgctgtgatccaggatgaagagagagacattcccgaacggtcctggaactctggatacgagtggatcaccgatttccctggcaaaacagtctggtttgttcccagcattaagtccgggaatgacatcgccaactgtctccgcaaaaatggaaagagagtgattcagctttctcggaagaccttcgatacggagtatcagaaaaccaagaacaacgactgggactacgtggtcaccacagatatcagcgaaatgggcgccaatttcagagctgaccgcgtgattgatcctcggagatgcctgaaacccgttatcctgaaggacgggccggagcgcgtgatcctcgccggccctatgcccgtcaccgtggcgtccgctgcccagcggagaggacgcattggccggaaccataataaagaaggggatcagtacatctatatgggacagcccctgaacaatgacgaggatcacgcccactggacggaggctaagatgcttctggacaacattaatacccctgaaggcatcattcccgccctctttgagcctgaaagagaaaagagcgcggccatcgatggggaataccgcctgagaggagaggctcggaaaacattcgttgagctgatgcgcagaggcgacctcccggtgtggctttcttataaggtcgcctccgaagggtttcaatacagcgatcggcgctggtgcttcgacggcgagagaaacaatcaggtgctggaagagaacatggatgtcgaaatctggaccaaagagggagagcggaagaaactgagaccccgctggctcgacgctcggacatattccgaccctctggcccttagagaatttaaggagttcgctgccggccgccggtctgtgagcggggatctgattctcgaaatcggaaaactgccccagcatctgacccagagagcgcaaaatgccctcgacaaccttgttatgctgcacaattccgagcagggcgggcgggcttaccgccatgccatggaggaactgcctgatacaattgagaccctcatgctgcttgctctgatcgccgtgctcacgggaggcgtgacactgtttttcctgtctggcagagggctcggaaagaccagcattggccttctgtgtgtcatggcctccagcgttctgctctggatggcttctgtggaaccccactggatcgcggcctccatcattctggagtttttccttatggtgctgctcatcccggaacctgaccggcagcgcacaccccaggataaccaactggcttatgtcgtgattgggctgctctttatgatccttacagttgccgccaatgagatgggactgctggagaccacaaagaaagacctcggcattgggcacgctgccgtggaaaaccatcaccatgcggccatgctggatgtcgaccttcaccctgctagcgcctggacgctgtacgctgtggccaccacaatcattacccccatgatgagacatacaatcgagaacaccacggcgaatatctctctcaccgccattgctaaccaggccgctatcctgatgggactggataagggctggcctatttccaaaatggacatcggcgtccccctccttgccctggggtgctacagccaggtgaatccgctgacactcaccgctgccgttctgatgcttgtggcgcactatgccattatcggacctggcctgcaagctaaggccacacgggaagctcagaaacgcaccgccgccgggatcatgaagaaccccacggtcgatggaattgtggcgatcgacctcgatcccgttgtgtacgacgctaagttcgagaaacagctgggccagattatgctgctcatcctttgtacatctcaaattctgctgatgagaaccacatgggccctctgcgaaagcatcaccctggctaccgggcctcttacaacgctgtgggagggatccccgggcaagttttggaataccacaatcgccgtctctatggccaacattttccggggcagctatctcgctggggccggactggcgttctccctgatgaaaagcctcggcgggggacgcagaggcaccggggcccagggagagacacttggcgaaaagtggaaacggcagctgaatcagctgtccaagtctgagtttaacacctacaagagaagcggcatcatggaagtggaccgctccgaggctaaagaagggctcaagcggggagagacgacaaaacacgccgtgtctagaggcaccgctaagctgcgctggttcgttgagcggaatcttgtcaaacccgaagggaaggtgattgatctgggatgtggcagagggggatggagctattactgcgccggcctcaagaaagtgaccgaggtcaagggctatacaaaagggggacctggccatgaggagcccatccctatggcgacctacgggtggaacctggttaagctgcactccggaaaagacgtgtttttcattccccctgaaaagtgtgatacactcctttgcgacatcggcgagtctagcccgaatcccacgattgaggaagggcgcaccctgcgggtgctgaaaatggtcgagccttggctcagaggaaaccaattttgtatcaagatcctgaatccctacatgccttccgtggttgaaacacttgagcagatgcagcgcaagcatggcggcatgctggtgcggaaccccctcagcagaaattctacccacgagatgtattgggtctcctgcgggacaggaaacattgtgagcgccgttaatatgacctctcgcatgctgctgaaccggttcacgatggctcacagaaaaccgacctacgaacgcgatgtggacctcggcgccgggacaagacatgtcgctgtggagcctgaagtggccaacctggatatcattggacagcggatcgagaatattaagcacgaacataaatccacctggcactatgacgaggataacccctacaagacatgggcttatcatggcagctacgaggtcaaaccctctgggtccgccagctccatggttaatggagtggtgaaacttctgaccaagccttgggacgtcatccccatggtgacacaaatcgcgatgaccgatacgacaccttttggccagcagcgcgttttcaaagaaaaggtggacaccagaaccccgaaagccaagcggggcacagctcaaattatggaggtcacggccaaatggctctgggggtttctgagcagaaacaagaagccccggatctgtacccgcgaagagttcacaagaaaagtgcggtctaatgctgccattggagccgtttttgtggacgaaaaccagtggaatagcgcgaaggaggctgtcgaggatgaacgcttctgggaccttgtgcacagagagcgggaactgcacaaacagggcaagtgcgctacctgcgtttataacatgatggggaaacgcgagaagaagctcggagaatttggcaaagccaaggggtccagagctatctggtacatgtggctgggcgcccggttcctggagttcgaggctctcggatttatgaatgaagatcattggttctctcgcgagaacagcctgtccggcgtggaaggggagggacttcacaaactgggctacattctcagagacatctctaagatccctgggggaaatatgtatgccgatgacacagcgggctgggatacccggattacagaggacgatctgcagaacgaagcccgcatcaccgacattatggagcccgaacatgcccttctggccaaaagcatctttaagctcacgtaccaaaataaagtcgtgagagtccagcggcctgctaagaacgggaccgtgatggatgttatttcccgcagagaccagcggggctctggacaggtgggcacatatgggctgaataccttcacaaacatggaggcccaactgatcagacagatggaaagcgagggaatcttttcccccagcgagctcgaaaccccgaacctggcggagcgcgtccttgattggctgaagaaatacggcgtggaacggctcaagagaatggccatttctggggacgactgtgtggttaaacctatcgatgaccgcttcgctacggccctgacagctcttaatgatatgggaaaggtgcggaaagacattccccagtgggagccttccaagggctggaacgattggcagcaagtccccttttgcagccaccacttccatcagctgatcatgaaggacgggagagaaattgtggttccttgtcgcaatcaggatgagctcgtgggccgggccagagtctctcagggagctggctggtccctgcgcgagaccgcctgcctggggaaaagctatgcgcaaatgtggcagctcatgtactttcaccggagagacctgcgccttgccgctaacgccatctgttccgccgtgcccgtcgattggattccgacatctcggaccacgtggagcatccatgctcaccatcagtggatgaccacagaagacatgctgtccgtgtggaatagagtttggatcgaggaaaacccttggatggaggataagacccacattagctcttggggagacgtgccctatctcggcaaacgggaagaccaatggtgcgggtccctgatcggacttacagccagagcgacctgggctacaaatattcaggtcgccatcaaccaggtgcgccggctgattggcaatgagaactacctcgattacatgaccagcatgaagagattcaaaaatgagggggaccccgaaggcgccctgtggtga

SEQ ID NO: 19298 - RNA, 9879 nt, synthetic construct
  misc_feature 1..9879: note = derived and/or modified CDS sequence (opt5) from DENV-1__EU482488__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcagcacacaagatgaaaagggggtgacccagaacggacggctgatcacagctaatcccattgtcacggacaaagagaagcctgtgaacatcgaagccgagccgccctttggcgagtcttatattgtgatcggggccggagaaaaagctcttaagctcagctggttcaagaaaggctcctctattgggaagatgtttgaggccaccgctagaggcgcccgccggatggcgatcctgggagatacagcctgggacttcggcagcatcgggggagtttttacctccgtcggcaaactggtgcatcagattttcgggacagcttacggagtgctctttagcggcgtctcttggaccatgaagatcgggattggcgtgctgcttacgtggctgggactcaattccagaagcacctctctgtccatgacatgtatcgccgttggcctggtgaccctttacctcggggtcatggtgcaggctgatagcggatgcgttattaactggaaaggccgcgaactgaagtgtgggtccggaatcttcgtgacaaatgaggtccacacctggacagaacaatataagtttcaggccgactctcctaaacggctgagcgcggccattggcaaggcttgggaggagggggtgtgcggcatcagatccgccacccgcctcgaaaacatcatgtggaaacagatttctaacgagctgaatcatatccttctggaaaacgacatgaagctcacggttgtggtcggagatgtggctggcattctggcccaggggaaaaagatgatccggccgcaacccatggagtacaaatatagctggaagtcctggggaaaggccaaaattatcggcgctgacgtgcagaatacaaccttcatcattgatgggcctaacacccccgaatgtcctgacgatcagagagcgtggaatatctgggaggtcgaggactacggatttggcattttcacaaccaacatctggctgaaacttcgcgatagctatacgcaggtttgcgaccaccggctcatgtctgccgctattaaagattccaaggccgtgcacgccgacatgggctactggatcgaaagcgagaaaaatgaaacatggaagctggctagagcctcttttatcgaggtgaagacctgtatttggcccaaatcccatacactgtggagcaacggggtcctcgaatctgagatgatcattccgaagatctatggaggccctattagccaacacaattaccgccccgggtacttcacccagacagcgggaccttggcatctgggcaaacttgagctggatttcgacctctgcgaagggaccacggtggttgtggatgagcactgcggaaaccggggcccctccctgagaaccacaaccgtcacaggcaagatcatccacgaatggtgttgccggagctgtaccctgcctccccttcgctttaaaggggaggacggatgctggtatggcatggagattagaccggtgaaggaaaaggaggaaaatctcgttaaatctatggtgtccgctgggagcggagaggtcgactccttctctctgggcctgctctgtatcagcattatgatcgaagaggtgatgcggtccagatggtctcgcaagatgctgatgacggggacacttgccgtctttttcctgctcattatgggacagctgacctggaacgatctgatccggctttgcattatggtgggcgccaatgctagcgacagaatgggcatggggacaacctacctggccctcatggcgacctttaaaatgcgccctatgttcgctgtcggactgctctttagacggctgacatcccgcgaggtgcttctgctcacgatcggcctgtctctggtggccagcgtcgaacttcccaactccctggaggaactcggggatggactggccatgggcatcatgattctcaagctgcttaccgacttccaaagccatcagctgtgggctacactcctgtctctgacctttatcagaacaaccttctcccttcactatgcctggaaaacgatggctatggttctgagcattgtgtctctctttcccctgtgtctctccacaaccagccagaagaccacatggctgcctgtgcttctggggtctctgggatgcaagccgctcaccatgttcctgatcgccgagaataaaatttggggccggaagtcctggccccttaacgaaggcatcatggcggtcgggatcgtgagcattctgctctccagcctgctcaaaaacgatgttcctctggccggaccccttatcgctggcgggatgctgattgcctgttacgtgatctctggaagctccgctgacctgtctctcgagaaggccgccgaggtcagctgggaagaggaagctgagcattccggcgcgtctcacaatattctggtggaagttcaggatgacgggacaatgaaaatcaaggatgaggagcgcgacgatacgcttaccatcctgctcaaagccacactgctcgctgtgagcggagtctatcctctgtccattcccgccaccctttttgtgtggtacttctggcaaaagaagaaacagagatctggcgtcctgtgggacacaccttcccctcccgaagtggagcgggccgttctggatgacggcatctatcgcattatgcagagagggctcctgggacggtcccaggtgggcgtcggggtgttccaagaaaacgtttttcataccatgtggcacgtgacgcgcggagctgtccttatgtaccagggcaagagactggagcccagctgggcctctgtgaaaaaggacctcatctcctacgggggaggctggcggctgcagggcagctggaataccggggaggaagtgcaggttattgcggtcgagcccggcaagaatcctaagaatgtgcaaacagctcccggcaccttcaagacatctgaaggggaggtgggagccatcgccctcgattttaaaccgggcacctccgggagccctattgtcaacagagaaggaaagatcgtgggcctgtatggcaatggggttgtgacaacgtccggaacctacgtctctgctatcgcccaggcgaaagctagccaggagggcccccttcctgagattgaagacgaggtgttccgcaagcggaacctgacaatcatggatctgcaccccgggtccggaaaaaccagacgctatctccccgccattgttcgggaagccatcaagagacgcctgcggacccttattctggctcctacaagagtggtcgccagcgagatggctgaagccctcaagggcatgccgatccgctaccaaacgaccgcggtgaaatctgagcatacagggaaggagatcgttgacctgatgtgccacgccacctttacaatgcggctgctctcccccgtgagagtccctaattataacatgattatcatggatgaagctcatttcaccgaccccagctctattgccgctcggggctacatcagcacgcgcgtgggaatgggcgaggccgccgctatttttatgacagcgacccctcccgggtccgtggaagccttccctcagtctaatgctgtcatccaggatgaggaaagagacatcccggagcggagctggaactccggatatgagtggattaccgattttcccggcaaaacagtttggttcgtgccttctatcaagagcgggaatgacattgccaactgtcttcgcaaaaatggaaagagagtgatccagctgtcccggaagacctttgatacagaataccagaagaccaagaacaacgactgggactacgtcgtgacgacagatattagcgagatgggcgccaatttcagagctgaccgcgttatcgatccccggagatgcctgaaacctgtgattctcaaggacgggcccgaacgcgtcatcctggccggcccgatgcctgtgaccgttgcgtctgctgcccagcggagaggacgcatcggccggaaccacaataaagagggggatcagtatatttacatgggacagccccttaacaatgacgaggatcatgcccactggacagaagctaagatgctgctcgacaacatcaatacccccgagggcattatccctgccctgttcgaacccgagagagaaaagtccgcggccattgatggggagtatcgcctgagaggagaggctcggaaaacgtttgtggaactcatgcgcagaggcgaccttcctgtctggctgagctacaaggtggcctccgaggggttccaatattctgatcggcgctggtgctttgacggcgaaagaaacaatcaggtcctggaggaaaacatggatgtggagatctggaccaaagagggagaacggaagaaactcagaccgcgctggctggacgctcggacatacagcgacccccttgccctgagagagttcaaggaatttgctgccggccgccggtccgtttctggggatctcatcctggagattggaaaactgcctcagcacctcacccagagagcgcaaaatgcccttgacaacctggtgatgctgcataatagcgaacagggcgggcgggcttatcgccacgccatggaggagctccccgatacaatcgaaaccctgatgcttctggctctcattgccgtgctgacaggaggcgtcaccctgttctttctctccggcagagggcttggaaagacgagcatcggcctgctgtgtgttatggcctcttccgtgctcctgtggatggctagcgtggagcctcattggattgcggcctctatcatccttgagttctttctgatggtcctcctgattcccgagccggaccggcagcgcacacctcaggataaccaactggcttacgtggttatcgggctccttttcatgattctgaccgtggccgccaatgagatgggactgctcgaaaccacaaagaaagacctgggcatcgggcacgtcgctgtggagaaccaccatcacgccgcgatgcttgatgtcgacctgcatcccgcctccgcttggaccctctacgccgtggctacaacgattatcacccctatgatgagacacacaattgaaaacaccacagccaatatcagcctgaccgcgatcgccaaccaggctgccattctgatgggactcgataagggctggcccatctctaaaatggacattggcgttcctcttctggctctggggtgctatagccaggtgaatcccctcacgctgaccgccgctgtccttatgctggtggcccattacgcgatcattggaccgggcctccaagccaaggctacacgggaggcccagaaacgcaccgctgccgggatcatgaagaaccctacagttgatggaatcgtggccattgacctggatcccgtcgtgtatgacgcgaagtttgaaaaacagctgggccagatcatgctccttattctgtgtacctcccaaatcctgctcatgagaacgacatgggctctgtgcgagtctattacccttgccacagggcccctgaccaccctctgggagggaagccctggcaagttctggaatacaacgatcgctgtgtccatggccaacatctttcggggcagctacctggccggggctggactggccttctccctcatgaaatctcttggcgggggacgcagaggcaccggggcgcagggagaaacactgggcgagaagtggaaacggcagctgaatcagctcagcaagtccgagttcaacacctataagagatctggcattatggaggttgaccgcagcgaagccaaagaggggctgaagcggggagagacaaccaaacacgctgtctccagaggcacggccaaacttcgctggtttgtggaacggaatctggtgaaaccggaggggaaggtcatcgatctcggatgtggcagagggggatggtcttactattgcgctggcctgaagaaagttacagaagtgaagggctacaccaaagggggacccggccacgaggaacctattcccatggccacctacgggtggaacctggtgaagctccatagcggaaaagacgtcttctttatccctcccgagaagtgtgatacacttctgtgcgacattggcgagtccagccctaatccgaccatcgaagaggggcgcacactgcgggtgctcaaaatggttgaaccctggctgagaggaaaccaattctgtattaagatccttaatccttatatgccctctgtggtcgagacgctggagcagatgcagcgcaagcacggcggcatgctcgtgcggaaccctctgtccagaaatagcacccatgaaatgtactgggtttcttgcgggacaggaaacatcgtgtccgcggtcaatatgaccagccgcatgctgctcaaccggtttacaatggcccacagaaaacccacctatgagcgcgatgtggacctgggcgctgggacgagacacgtggccgtcgaaccggaggttgctaaccttgatattatcggacagcggattgaaaatatcaagcatgagcacaaatctacctggcattacgacgaggataacccttataagacatgggcctaccacggctcctatgaagtgaaacccagcgggtccgctagctctatggtgaatggagtcgtgaagctgctcaccaagccctgggacgttattcctatggtgacacaaatcgccatgaccgatacaacccccttcggccagcagcgcgtctttaaagagaaggtggacacgagaacacctaaagcgaagcggggcaccgcccaaatcatggaagttaccgctaaatggctgtgggggttccttagcagaaacaagaagccgcggatttgtacacgcgaggaatttacgagaaaagtgcggtccaatgccgctatcggagccgtcttcgtggacgagaaccagtggaactctgccaaggaggcggttgaagatgagcgcttttgggacctggtgcatagagaacgggagctccacaaacagggcaagtgcgctacctgcgtctacaacatgatggggaaacgcgaaaagaagctgggagagttcggcaaagccaaggggagcagagccatttggtacatgtggctgggcgctcggtttctcgagttcgaagccctgggattcatgaatgaggatcactggttttcccgcgaaaactctcttagcggcgtggagggggagggactgcataaactcggctatatcctgagagacatttccaagatccccgggggaaatatgtacgctgatgacacagccggctgggatacccggatcacagaagacgatcttcagaacgaggcgaaaattaccgacatcatggaacctgagcacgccctgctcgctaagtctattttcaaactgacatatcaaaataaggtcgtgcgcgttcagagacccgccaagaacgggaccgtgatggatgtcatcagccggcgcgaccagagaggctccggacaggtgggcacgtacgggctgaatacctttacaaacatggaagctcaactcattcggcagatggagagcgagggaatcttctctccttccgaactggagacccccaaccttgccggcagagtgctggattggctcgaaaaacatggggttgagcgcctgaagcggatggcgatcagcggagacgactgtgtggtcaaaccgattgatgacagatttgccacagctcttaccgccctgaatgatatgggcaaggtgcgcaaagacatccctcagtgggaaccctctaaggggtggaacgattggcagcaagttcctttctgctcccaccactttcatcagctcattatgaaggacggccgggagatcgtggtcccctgtagaaatcaggatgagctggtgggacgcgctcgggtcagccagggcgccgggtggtccctgagagaaacggcttgcctcggaaaatcttatgcccaaatgtggcagctgatgtacttccaccgccgggaccttagactggcggccaacgctatttgtagcgccgtgcctgttgattgggtgcccacatcccgcaccacatggagcatccatgcccaccatcagtggatgaccacggaggacatgctctctgtctggaatcgggtgtggattgaagagaacccgtggatggaagataagacccacgtttccagctgggaggacgtgccttatctgggcaaaagagaggaccaatggtgcgggtctcttatcggactgacagctcgggccacctgggcgacaaatatccaggtcgctattaaccaggtgagacgcctcctgggcaatgaaaactacctggattacatgaccagcatgaagcggtttaaaaatgagtccgaccccgaaggggccctctggtga

SEQ ID NO: 19299 - RNA, 9879 nt, synthetic construct
  misc_feature 1..9879: note = derived and/or modified CDS sequence (opt5) from DENV-1__EU482489__SS-prME
  source 1..9879: mol_type = other RNA
agcgtgaccatgctgcttatgctgatgcccacagcccttgctttccacctgacgaccagaggcggggaacctcatatgatcgtctccaagcaggaacgggggaaatctctgctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacacttatcgctctgtttctcgcccatgcgattgggacctctatcacccagaagggaatcattttcatcctgcttatgctggtgacacctagcatggccatgagatgcgtcggcattgggtcccgggattttgtggagggactcagcggcgctacgtgggttgacgtggtcctggagcacgggtcttgtgtgaccacaatggccaaggataaacccaccctggacatcgaactcctgaagacagaggtgaccaaccctgctgtccttcgcaaactgtgcattgaagccaagatctccaatacgacaaccgatagcagatgtccgacccaaggagaggcgacactcgttgaagaacaagacgccaacttcgtgtgccggcgcacctttgtggatagaggctggggcaatgggtgtggactgttcggcaaagggtctcttattacatgcgctaagtttaagtgcgtcacgaaactggagggaaagatcgtgcagtacgaaaacctcaaatattccgttatcgtgaccgtccacacaggcgaccagcatcaagtggggaatgagagcaccgaacacggaacaaccgccacgattacaccccaagctcctaccaccgagatccagctgacagactacggcgccctgaccctcgattgttctccccggacgggcctggacttcaacgaaatggttcttctgacaatgaaggagaaatcctggctcgtgcataagcagtggtttctggatcttcctctgccctggaccagcggggcctccacatctcaagagacctggaatcgccaggacctcctggtcaccttcaaaacagctcacgcgaagaagcaggaagtggtcgtgctgggaagccaagagggcgccatgcacacggctctcaccggggccacagaaattcagacctccggaacaaccacgatctttgccggccatctgaaatgcagacttaagatggataaactgacactcaaggggatgagctatgttatgtgtaccggctctttcaaactggagaaggaactggctgagacccagcacggaacagtgcttgtccagattaagtacgagggcaccgacgccccgtgcaaaatccctttctccacacaagatgaaaagggggtgacgcagaacggacggctcatcaccgcgaatcccattgttacagacaaagagaagcctgtgaacatcgaagctgagccgccctttggcgagagctatattgtcatcggggccggagaaaaagccctgaagctgtcttggttcaagaaaggcagctccattgggaagatgtttgaggctaccgccagaggcgctcgccggatggccatcctcggagatacagcgtgggacttcggctctatcgggggagtgtttaccagcgtgggcaaactggttcatcagattttcgggacggcctacggagtcctcttttccggcgtgagctggaccatgaagatcgggattggcgtgctgctcacatggctgggactcaattctagatccaccagcctttctatgacatgtatcgctgtcggcctcgtgaccctgtacctgggggttatggtgcaggccgattccggatgcgtcattaactggaaaggccgcgaactcaagtgtgggagcggaatcttcgtgacaaatgaggttcacacctggacggaacaatataagtttcaggctgactcccctaaacggctgtctgccgcgattggcaaggcctgggaggagggggtgtgcggcatcagaagcgctacacgccttgaaaacatcatgtggaaacagatttccaacgagctgaatcatatcctcctggaaaacgacatgaagttcaccgtcgtggttggagatgtggccggcattctggctcaggggaaaaagatgatccggccgcaacccatggagtacaaatattcttggaaaagctggggaaaggccaagattatcggcgccgacgtccagaataccacatttatcattgatgggcctaacacccccgaatgtcctgacgatcagagagcttggaatatctgggaggtggaggactacggattcggcatttttacgacaaacatctggcttaagctccgcgattcctatacccaggtgtgcgaccaccggctgatgagcgcggccattaaagattctaaggctgtccacgccgacatgggctactggatcgaatccgagaaaaatgaaacatggaagctggccagagctagcttcatcgaggttaagacctgtatttggcccaaatctcatacactctggtccaacggggtgctggaaagcgagatgatcattccgaagatctatggaggccctatttctcaacacaattaccgccccgggtacttcacccagacggccggaccttggcatcttggcaaactggagctcgattttgacctgtgcgaagggaccacagtggtcgtggatgagcactgcggaaaccggggccccagcctgagaaccacaaccgttacgggcaagatcatccacgaatggtgttgccggtcctgtacacttcctcccctccgcttcagaggggaggacggatgctggtatggcatggagattcggccggtgaaagaaaaggaggaaaatctggtcaagagcatggtgtctgcggggtccggagaggttgacagcttttccctgggcctcctgtgtatctctattatgatcgaagaggtgatgagaagccgctggtcccggaaaatgcttatgaccgggacactggctgtcttctttctcctgattatgggacagctgacctggaacgatcttatcagactgtgcattatggtgggcgccaatgcctctgaccgcatgggcatggggaccacatacctcgctctgatggccacgttcaagatgagacctatgtttgcggttggactcctgttccggcgccttaccagcagagaggtgctgctcctgacaatcggcctgtcccttgtcgcttctgtggaactgcccaacagcctcgaggaactgggggatggactcgccatgggcatcatgattctgaaacttctgaccgactttcaatcccatcagctctgggccacactgctgagccttaccttcatcaagacgacattttctctgcactatgcttggaaaaccatggccatggtgctctccattgtcagcctgttccccctctgtctgtctaccacatcccagaagaccacatggcttcctgttctgctggggagcctcggatgcaagccgctgacgatgtttcttatcgctgagaataaaatttggggccggcgctcttggcccctgaacgaaggcatcatggccgtggggatcgtgtccattctcctgagctccctcctgaagaacgatgtccctcttgcgggacccctgatcgccggcgggatgctgattgcttgttacgtgatcagcggatctagcgccgacctctccctggagaaagctgccgaggtttcttgggaagaggaagccgagcatagcggcgcttcccacaatattcttgtggaagtccaggatgacgggaccatgaagatcaaagatgaggagagagacgatacactgaccatcctcctgaaggcgacactcctggccgtgtctggagtttatcctcttagcattcccgctaccctgttcgtgtggtacttctggcagaagaagaagcagcggtccggcgtcctgtgggacacgccttctcccccggaagtggagcgcgccgtcctcgatgacggcatctatagaattatgcagcgggggctgcttggacgcagccaggtgggcgttggggtgtttcaagaaaacgtcttccataccatgtggcacgtgacaagaggagccgttctgatgtaccagggcaaacggctcgagccttcctgggctagcgtgaagaaagacctgatctcttacgggggaggctggagactccagggctcctggaataccggggaggaagtccaggtgattgccgtggagcccggaaagaaccctaaaaatgttcaaacagcgcccggcacctttaagacaccggaaggggaggtcggagctatcgccctggatttcaagcctggcacgagcgggtctcccattgtgaaccgcgaaggaaaaatcgtgggcctttatggcaatggggtcgtgaccacatccggaacctacgttagcgccatcgctcaggccaaggcgtcccaggagggccctctgcccgagattgaagacgaggtgtttcggaaaagaaacctgaccatcatggatctccaccccgggtctggaaagacacgccggtatctgcctgctattgtcagagaagccatcaaacgcaaacttcggacgctgattctcgccccgaccagagtggttgctagcgagatggccgaagctctgaagggcatgcccatccgctaccaaacaaccgccgtgaaatccgagcatacagggaaggagatcgtcgacctgatgtgccacgcgaccttcacgatgcggctccttagccctgtgagagttcccaattataacatgattatcatggatgaagcccattttacagacccttcttccattgctgcccggggctacatcagcacccgcgtgggaatgggcgaggctgccgccattttcatgaccgctacaccccctgggtctgtcgaagcgtttccgcagagcaatgccgtgatccaggatgaggaaagagacatccccgagcggtcctggaactctggatatgagtggattaccgatttccctggcaaaacagtgtggtttgtccccagcatcaagtccgggaatgacattgctaactgtctgcgcaaaaatggaaagagagttatccagctgtctcggaagaccttcgatacggaataccagaagaccaagaacaacgactgggactacgtggtgaccacagatattagcgagatgggcgccaatttcagagccgaccgcgtcatcgatcctcggagatgcctcaaacccgtgattctgaaggacgggccggaacgcgttatccttgctggccctatgcccgtgaccgtcgcctccgcggctcagcggagaggacgcatcggccggaaccacaataaagagggggatcagtatatttacatgggacagcccctgaacaatgacgaggatcatgcccactggacggaagccaagatgctcctggacaacatcaatacccctgagggcattatccccgctctgtttgaacctgagagagaaaagagcgccgcgattgatggggagtatcgcctcagaggagaggcccggaaaacattcgtggaacttatgcgcagaggcgacctgccggtttggctgtcttacaaggtggcttccgaggggtttcaatatagcgatcggcgctggtgcttcgacggcgaaagaaacaatcaggtcctcgaggaaaacatggatgtggagatctggaccaaagagggagaacggaagaaactgagaccccgctggcttgacgcccggacatactccgaccctctggctctcagagagtttaaggagttcgccgctggccgccggtctgtcagcggggatctgatcctggagattggaaaactcccccagcaccttacccagagagcccaaaatgcgctggacaacctggtgatgctccataattccgaacagggcgggcgggcctatcgccacgctatggaggagctgcctgatacaatcgaaacccttatgctgctcgccctgattgctgttctgacgggaggcgtgacactctttttcctttctggcagagggctgggaaagaccagcatcggcctgctctgtgtgatggcctccagcgtcctgctttggatggcctctgttgagccccattggattgctgcgtccatcatcctggaatttttcctcatggtgctgctgattccggagcctgaccggcagcgcacaccccaggataaccaactcgcctacgtggtcatcgggcttctgtttatgattctgacagtggctgccaatgagatgggactcctggaaaccacaaagaaagaccttggcatcgggcacgttgccgtggagaaccaccatcacgctgccatgctggatgtcgacctccatcctgcgagcgcctggacgctgtacgctgtggccaccacaattatcacccccatgatgagacacacaattgaaaacaccacggctaatatctctctgaccgccatcgcgaaccaggccgctattctcatgggacttgataagggctggcctatctccaaaatggacattggcgtccccctgctggccctcgggtgctatagccaggtgaatccgctgacacttaccgctgccgttctgatgctcgtggctcattacgccatcattggacctggcctgcaagcgaaggccacacgggaggctcagaaacgcaccgccgctgggatcatgaagaaccccacggtcgatggaatcgtggccattgacctggatcccgttgtgtatgacgccaagttcgaaaaacagctcggccagatcatgcttctgattctgtgtacatctcaaatcctcctgatgagaaccacatgggcgctttgcgagagcattaccctggctaccgggcctctcacaacgctgtgggagggatccccgggcaagttttggaataccacaatcgccgtctctatggctaacatcttccggggcagctacctggccggggccggactcgctttctcccttatgaaaagcctgggcgggggacgcagaggcaccggggcccagggagaaacactgggcgagaagtggaaacggcagctcaatcagctgtccaagtctgaatttaacacctataagagaagcggcattatggaggtggaccgctccgaagcgaaagaggggcttaagcggggagagacgacaaaacacgccgtgtctagaggcaccgctaagctgcgctggttcgttgaacggaatctcgtcaaacccgaggggaaggtgatcgatctgggatgtggcagagggggatggagctactattgcgccggcctgaagaaagtgaccgaagtcaagggctacacaaaagggggacctggccacgaggaacccattcctatggctacctacgggtggaacctcgttaaacttcattccggaaaagacgtgtttttcattccccctgagaagtgtgatacactgctgtgcgacattggcgagtctagcccgaatcccacgatcgaagaggggcgcaccctccgggtgctgaaaatggtcgaaccttggcttagaggaaaccaattttgtattaagatcctgaatccctatatgccttccgtggttgagacactcgagcagatgcagcgcaagcacggcggcatgctggtgcggaaccccctgagcagaaattctacccatgaaatgtactgggtctcctgcgggacaggaaacatcgtgagcgccgttaatatgacctctcgcatgctcctgaaccggttcacgatggcgcacagaaaaccgacctatgagcgcgatgtggaccttggcgccgggacaagacacgtcgctgtggaacctgaggtggccaacctggatattatcggacagcggattgaaaatatcaagcatgagcacaaatccacctggcattacgacgaggataacccctataagacatgggcttaccacggcagctatgaagtcaaaccctctgggtccgccagctccatggttaatggagtggtgaagctcctgaccaagccttgggacgtcattcccatggtgacacaaatcgctatgaccgatacgacaccttttggccagcagcgcgttttcaaagagaaggtggacaccagaaccccgaaagccaagcggggcacagcgcaaatcatggaagtcacggccaaatggctttgggggtttctgagcagaaacaagaagccccggatttgtacccgcgaggagttcacaagaaaagtgcggtctaatgctgccatcggagctgtttttgtggacgagaaccagtggaatagcgccaaggaggccgtcgaagatgagcgcttctgggacctcgtgcatagagaacgggagctgcacaaacagggcaagtgcgcgacctgcgtttacaacatgatggggaaacgcgaaaagaagctgggagagtttggcaaagctaaggggtccagagccatttggtacatgtggctcggcgcccggttcctggagttcgaagctcttggatttatgaatgaggatcactggttctctcgcgaaaacagcctgtccggcgtggagggggagggactccataaactgggctatatccttagagacatttctaagatccctgggggaaatatgtacgccgatgacacagctggctgggatacccggatcacagaagacgatctgcagaacgaggcccgcattaccgacatcatggaacccgagcacgcgctcctggccaaaagcatttttaagctgacgtatcaaaataaagtcgtgagagtccagcggcctgctaagaacgggaccgtgatggatgttatctcccgcagagaccagcggggctctggacaggtgggcacatacgggctcaataccttcacaaacatggaagcccaactgattagacagatggagagcgagggaatcttttcccccagcgaacttgagaccccgaacctggctgaacgcgtcctcgattggctggagaagtatggcgtggaacggcttaaaagaatggccatctctggggacgactgtgtggttaagcctattgatgaccgcttcgcgacggccctgacagctctcaatgatatgggaaaagtgcggaaggacatcccccagtgggagccttccaaaggctggaacgattggcagcaagtccccttttgcagccatcacttccaccagctgattatgaaggacgggagagagatcgtggttccttgtcgcaatcaggatgaactggtgggccgggccagagtctctcagggagctggctggtccctccgcgagaccgcctgcctgggaaagagctacgctcaaatgtggcagcttatgtattttcatcggagagacctgcgcctcgccgcgaacgccatttgttccgctgtgcccgtcgattggatcccgacatctcggaccacgtggagcattcacgcccatcaccagtggatgaccacagaagacatgctgtccgtgtggaatagagtttggatcgaggaaaacccttggatggaggataaaacccatatcagctcttggggagacgtgccctaccttggcaagcgggaggaccaatggtgcgggtccctgattggactcacagccagagctacctgggccacaaatatccaggtcgcgattaaccaggtgcgccggctgatcggcaatgaaaactacctggattatatgaccagcatgaaaagattcaagaatgagtctgaccccgaaggggctctctggtga

SEQ ID NO: 19300 - RNA, 9879 nt, synthetic construct
  misc_feature 1..9879: note = derived and/or modified CDS sequence (opt5) from DENV-1__EU482490__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattaccatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtgtttacgagcgttggcaaactggtccatcagattttcgggaccgcctacggagtgctcttttccggcgtgagctggacaatgaagatcgggattggcgtcctgcttacctggctgggactcaattctagatccacaagcctgtctatgacctgtatcgctgtgggcctggttacactttacctcggggtgatggtccaggccgattccggatgcgtgattaactggaaaggccgcgaactgaagtgtgggagcggaatcttcgttaccaatgaggtgcacacgtggacagaacaatataagtttcaggctgactcccctaaacggctgtctgccgcgattggcaaggcctgggaggagggggtctgcggcatcagaagcgctacccgcctcgaaaacatcatgtggaaacagatttccaacgagctgaatcatatccttctggaaaacgacatgaagttcaccgtggttgtgggagatgtcgccggcattctcgctcaggggaaaaagatgatccggccgcaacccatggagtacaaatattcttggaaaagctggggaaaggccaagattatcggcgccgacgtgcagaatacaacctttatcattgatgggcctaacacgcccgaatgtcctgacgatcagagagcttggaatatctgggaggtggaggactacggattcggcatttttacaaccaacatctggctgaagctgcgcgattcctatacacaggtctgcgaccaccggcttatgagcgcggccattaaagattctaaggctgttcacgccgacatgggctactggatcgaatccgagaaaaatgaaacctggaagctcgccagagctagcttcatcgaggtgaagacatgtatttggcccaaatctcataccctgtggtccaacggggtgctggaaagcgagatgatcattccgaagatctatggaggccctatttctcaacacaattaccgccccgggtacttcacgcagaccgccggaccttggcatctcggcaaactggagcttgattttgacctgtgcgaagggacaaccgtcgtggttgatgagcactgcggaaaccggggccccagcctcagaacaaccacggtgacaggcaagatcatccacgaatggtgttgccggtcctgtaccctgcctcccctgcgcttcagaggggaggacggatgctggtatggcatggagattcggccggtcaaagaaaaggaggaaaatcttgtcaagagcatggtttctgcggggtccggagaggtggacagcttttccctcggcctgctgtgtatctctattatgatcgaagaggtcatgagaagccgctggtcccggaaaatgctcatgacagggaccctggctgtgttctttcttctgattatgggacagctcacctggaacgatctgatcagactgtgcattatggttggcgccaatgcctctgaccgcatgggcatggggacaacgtaccttgctctgatggccaccttcaagatgagacctatgtttgcggtgggactcctgttccggcgcctcacaagcagagaggtcctgcttctgaccatcggcctctccctggtggcttctgtggaactgcccaacagccttgaggaactgggggatggactcgccatgggcatcatgattctgaaactcctgacagactttcaatcccatcagctttgggccaccctgctcagcctgacgttcatcaagacaaccttttctctgcactatgcttggaaaaccatggccatggtcctttccattgttagcctgttccccctctgtctgtctacaacctcccagaagacaacgtggctccctgtgctgcttgggagcctgggatgcaagccgctgaccatgtttctcatcgctgagaataaaatttggggccggcgctcttggcccctgaacgaaggcatcatggccgtggggatcgtctccattcttctgagctccctcctgaagaacgatgtgcctctcgcgggacccctgatcgccggcgggatgcttattgcttgttacgttatcagcggatctagcgccgacctgtccctggagaaagctgccgaggtgtcttgggaagaggaagccgagcatagcggcgcttcccacaatattctcgtcgaagtgcaggatgacgggacaatgaagatcaaagatgaggagagagacgataccctgacaatccttctgaaggcgaccctcctggccgtttctggagtgtatcctctcagcattcccgctacgctgttcgtctggtacttctggcagaagaagaagcagcggtccggcgtgctttgggacaccccttctcccccggaagtcgagcgcgccgtgctggatgacggcatctatagaattatgcagcgggggctgctcggacgcagccaggttggcgtgggggtctttcaagaaaacgtgttccatacaatgtggcacgttaccagaggagccgtgctgatgtaccagggcaaacggcttgagccttcctgggctagcgtcaagaaagacctgatctcttacgggggaggctggagactccagggctcctggaatacaggggaggaagtccaggtgattgccgttgagcccggaaagaaccctaaaaatgtccaaaccgcgcccggcacatttaagacgccggaaggggaggtgggagctatcgccctggatttcaagcctggcaccagcgggtctcccattgtgaaccgcgaaggaaaaatcgtcggcctctatggcaatggggtggttacaacctccggaacctacgtgagcgccatcgctcaggccaaggcgtcccaggagggccctctgcccgagattgaagacgaggtctttcggaaaagaaaccttacaatcatggatctgcaccccgggtctggaaagacgcgccggtatctgcctgctattgtgagagaagccatcaaacgcaagctccggaccctgattcttgccccgacaagagttgtggctagcgagatggccgaagctctgaagggcatgcccatccgctaccaaaccacagccgtcaaatccgagcataccgggaaggagatcgtggacctcatgtgccacgcgacgttcacaatgcggctgctgagccctgttagagtgcccaattataacatgattatcatggatgaagcccattttaccgacccttcttccattgctgcccggggctacatcagcacccgcgtcggaatgggcgaggctgccgccattttcatgacagctacaccccctgggtctgtggaagcgtttccgcagagcaatgccgtgatccaggatgaggaaagagacatccccgagcggtcctggaactctggatatgagtggattacagatttccctggcaaaaccgtctggtttgttcccagcatcaagtccgggaatgacattgctaactgtctccgcaaaaatggaaagagagtgatccagctttctcggaagacgttcgatacagaataccagaaaaccaagaacaacgactgggactacgtggtcacaaccgatattagcgagatgggcgccaatttcagagccgaccgcgtgatcgatcctcggagatgcctgaaacccgttattctgaaggacgggccggaacgcgtgatcctcgctggccctatgcccgtcacggtggcctccgcggctcagcggagaggacgcatcggccggaaccacaataaagagggggatcagtatatttacatgggacagcccctgaacaatgacgaggatcatgcccactggaccgaagccaagatgcttctggacaacatcaatacacctgagggcattatccccgctctctttgaacctgagagagaaaagagcgccgcgattgatggggagtatcgcctgagaggagaggcccggaaaaccttcgttgaactgatgcgcagaggcgacctcccggtgtggctttcttacaaggtcgcttccgaggggtttcaatatagcgatcggcgctggtgcttcgacggcgaaagaaacaatcaggtgctggaggaaaacatggatgtcgagatctggacaaaagagggagaacggaagaaactgagaccccgctggctcgacgcccggacctactccgaccctctggctcttagagagtttaaggagttcgccgctggccgccggtctgtgagcggggatctgatcctcgagattggaaaactgccccagcacctgacacagagagcccaaaatgcgctcgacaaccttgttatgctgcataattccgaacagggcgggcgggcctatcgccacgctatggaggagctgcctgataccatcgaaacgctcatgctgcttgccctgattgctgtgctcacaggaggcgtgaccctgtttttcctgtctggcagagggctcggaaagaccagcatcggccttctgtgtgtcatggcctccagcgttctgctctggatggcctctgtggagccccattggattgctgcgtccatcatcctggaatttttccttatggtgctgctcattccggagcctgaccggcagcgcacaccccaggataaccaactggcctacgtcgtgatcgggctgctctttatgattcttaccgttgctgccaatgagatgggactgctggaaacaacgaagaaagacctcggcatcgggcacgtggccgtcgagaaccaccatcacgctgccatgctggatgtggaccttcatcctgcgagcgcctggaccctgtacgctgtcgccacaaccattatcacacccatgatgagacacaccattgaaaacacgaccgctaatatctctctcacagccatcgcgaaccaggccgctattctgatgggactggataagggctggcctatctccaaaatggacattggcgtgcccctccttgccctggggtgctatagccaggttaatccgctgaccctcacagctgccgtgctgatgcttgtcgctcattacgccatcattggacctggcctgcaagcgaaggccacccgggaggctcagaaacgcacggccgctgggatcatgaagaaccccacagtggatggaatcgttgccattgacctcgatcccgtggtctatgacgccaagttcgaaaaacagctgggccagatcatgctgctcattctttgtacctctcaaatcctgctgatgagaacaacctgggcgctctgcgagagcattaccctggctacagggcctcttacgaccctgtgggagggatccccgggcaagttttggaatacaaccatcgccgtgtctatggctaacatcttccggggcagctacctcgccggggccggactggctttctccctgatgaaaagcctcggcgggggacgcagaggcacaggggcccagggagaaacccttggcgagaagtggaaacggcagctgaatcagctgtccaagtctgaatttaacacgtataagagaagcggcattatggaggtggaccgctccgaagcgaaagaggggctcaagcggggagagacaaccaaacacgccgtttctagaggcaccgctaagctgcgctggttcgtcgaacggaatcttgtgaaacccgaggggaaggtgatcgatctgggatgtggcagagggggatggagctactattgcgccggcctcaagaaagtcacagaagttaagggctacaccaaagggggacctggccacgaggaacccattcctatggctacatacgggtggaacctggtgaagctgcattccggaaaagacgtgtttttcattccccctgagaagtgtgatacgctcctttgcgacattggcgagtctagcccgaatcccaccatcgaagaggggcgcacactgcgggtcctgaaaatggtggaaccttggctcagaggaaaccaattttgtattaagatcctgaatccctatatgccttccgttgtggagacccttgagcagatgcagcgcaagcacggcggcatgctggtccggaaccccctcagcagaaattctacacatgaaatgtactgggtgtcctgcgggaccggaaacatcgttagcgccgtgaatatgacgtctcgcatgctgctgaaccggttcaccatggcgcacagaaaaccgacatatgagcgcgatgtcgacctcggcgccgggaccagacacgtggctgtggaacctgaggtcgccaacctggatattatcggacagcggattgaaaatatcaagcatgagcacaaatccacatggcattacgacgaggataacccctataagacctgggcttaccacggcagctatgaagttaaaccctctgggtccgccagctccatggtgaatggagtggtcaaacttctgacaaagccttgggacgtgattcccatggttacccaaatcgctatgacggatacaaccccttttggccagcagcgcgtgttcaaagagaaggtcgacaccagaacaccgaaagccaagcggggcacggcgcaaatcatggaagtgaccgccaaatggctctgggggtttctgagcagaaacaagaagccccggatttgtacacgcgaggagttcaccagaaaagttcggtctaatgctgccatcggagctgtgtttgtcgacgagaaccagtggaatagcgccaaggaggccgtggaagatgagcgcttctgggaccttgttcatagagaacgggagctgcacaaacagggcaagtgcgcgacatgcgtgtacaacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtcgagggggagggacttcataaactgggctatatcctcagagacatttctaagatccctgggggaaatatgtacgccgatgacaccgctggctgggatacacggatcaccgaagacgatctgcagaacgaggcccgcattacggacatcatggaacccgagcacgcgcttctggccaaaagcatttttaagctcacctatcaaaataaagtggtcagagtgcagcggcctgctaagaacgggacagttatggatgtgatctcccgcagagaccagcggggctctggacaggtcggcacctacgggctgaatacattcaccaacatggaagcccaactgattagacagatggagagcgagggaatcttttcccccagcgaactcgagacgccgaacctggctgaacgcgtgcttgattggctggagaagtatggcgtggaacggctcaaaagaatggccatctctggggacgactgtgttgtgaagcctattgatgaccgcttcgcgacagccctgaccgctcttaatgatatgggaaaagtccggaaggacatcccccagtgggagccttccaaaggctggaacgattggcagcaagtgcccttttgcagccatcacttccaccagctgattatgaaggacgggagagagatcgttgtgccttgtcgcaatcaggatgaactcgtcggccgggccagagtgtctcagggagctggctggtccctgcgcgagacagcctgcctgggaaagagctacgctcaaatgtggcagctcatgtattttcatcggagagacctgcgccttgccgcgaacgccatttgttccgctgtccccgtggattggatcccgacctctcggacgacctggagcattcacgcccatcaccagtggatgacaaccgaagacatgctgtccgtttggaatagagtgtggatcgaggaaaacccttggatggaggataaaacacatatcagctcttggggagacgtcccctacctcggcaagcgggaggaccaatggtgcgggtccctgattggacttaccgccagagctacatgggccaccaatatccaggtggcgattaaccaggttcgccggctgatcggcaatgaaaactacctcgattatatgacgagcatgaaaagattcaagaatgagtctgaccccgaaggggctctgtggtga

SEQ ID NO: 19301 - RNA, 9879 nt, synthetic construct
  misc_feature 1..9879: note = derived and/or modified CDS sequence (opt5) from DENV-1__EU482491__SS-prME
  source 1..9879: mol_type = other RNA
agcgtgaccatgctgctgatgctgatgcccacagctcttgctttccacctgacgaccagaggcggggaacctcatatgatcgtgtccaagcaggaacggggaaaatctctcctgtttaagacaagcgccggcgttaacatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgtacccaaattggcgaacacagacgggacaagcgctccgtcgccctcgctcctcatgtggggctgggactggagacaagaaccgaaacgtggatgtctagcgagggcgcctggaaacagatccagcgggttgaaacatgggctctccgccaccccggctttaccgtgattgccctgttccttgcgcatgccatcgggacatccatcacccagaagggaattatctttattctgctcatgctggctaccccttctatggccatgagatgcgtcggcatcgggagccgggatttcgtggagggactttccggcgctacatgggttgacgtggtcctggagcacgggagctgtgtgacgaccatggccaaggataaacccacactcgacattgaactgctgaagaccgaggtgacaaaccctgcggtcctccgcaaactgtgcatcgaagccaagatttctaataccacgacagattccagatgtccgacccaaggagaggctacccttgttgaagaacaggacgccaactttgtgtgccggcgcacattcgtggatagaggctggggcaatgggtgtggactgtttggcaaagggagcctcatcacatgcgctaagttcaagtgcgtcacaaaactggagggaaagatcgtgcagtacgaaaaccttaaatattctgttattgtgacggtccacaccggcgaccagcatcaagtggggaatgagtccacagaacacggaaccatcgccacaattacgccccaagcccctagcaccgagatccagctgaccgactacggcgctctcacactggattgttctccccggaccggcctggactttaacgaaatggttctcctgacaatgaaggagaaatcctggcttgtgcataagcagtggttcctggatctccctctgccctggaccagcggggcgtccacgtctcaagagacatggaatcgccaggaccttctggtcacctttaaaacagcccacgctaagaagcaggaagtggtcgtgctcggaagccaagagggcgccatgcacaccgccctgaccggggctacagaaattcagacgtccggaaccacaaccatcttcgccggccatctgaaatgcagactcaagatggataaactgacacttcgggggatgagctatgttatgtgtaccggctctttcaagctggagaaagaagtggcggagacgcagcacggaacagtcctcgtgcagatcaagtacgagggcaccgacgctccgtgcaagattcctttttccacccaagatgaaaaaggggttacacagaacggaagactgatcaccgccaatcccattgtgacagacaaggagaaacctgtcaacatcgaagccgagccgcccttcggcgagagctatattgtgatcggggctggagaaaaggccctgaaactttcttggtttaagaagggcagctccatcgggaaaatgttcgaggctacggcccgcggcgcgcggagaatggccattctcggagataccgcttgggactttggctctatcgggggagtgttcacaagcgttggcaagctggtccatcagatttttgggaccgcctacggagtgctgttctccggcgtgagctggacaatgaaaatcgggattggcgtcctcctgacctggcttggactcaattctcgctccacgagcctctctatgacctgtatcgctgtgggcctggttacactgtaccttggggtgatggtccaggccgattccggatgcgtgattaactggaagggccgggaactcaaatgtgggagcggaatctttgttaccaatgaggtgcacacatggaccgaacaatataagttccaggcggactcccctaagagactgtctgccgctatcggcaaagcctgggaggagggggtctgcggcattcgcagcgctacacggctggaaaacatcatgtggaagcagatttccaacgagctcaatcatatcctgcttgaaaacgacatgaaactgaccgtggttgtgggagatgtcgccggcattctcgcccaggggaagaaaatgatcagaccgcaacccatggagtacaagtattcttggaaaatctggggaaaggctaagattatcggcgcggacgtgcagaatacgacatttattatcgatgggcctaacacccccgaatgtcctgacgatcagcgcgcctggaatatttgggaggtggaggactacggattcggcatctttaccacaaacatctggctgaaactgcgggatagctatacccaggtctgcgaccacagacttatgtccgctgccattaaggatagcaaagccgttcacgctgacatgggctactggatcgaatctgagaagaatgaaacgtggaaactcgcccgcgcgtccttcattgaggtgaagacatgtatctggcccaagagccataccctgtggtctaacggggtgctggaatccgagatgattatcccgaaaatctatggaggccctattagccaacacaattaccggcccgggtacttcacacagaccgctggaccttggcatctcggcaagctggagcttgattttgacctgtgcgaagggacaaccgtcgtggttgatgagcactgcggaaacagaggcccctctctccggacgaccacagtgaccggcaaaatcattcacgaatggtgttgccgcagctgtacactgcctcccctgagattcaagggggaggacggatgctggtatggcatggagatccggccggtcaaagaaaaggaggaaaatcttgtgaagtccatggttagcgccgggtctggagaggtggactcctttagcctcggcctgctgtgtatttccatcatgattgaagaggtcatgagatctcgctggagccggaaaatgctcatgaccgggacgctggccgtgttctttcttctgatcatgggacagctcacatggaacgatctgatcagactgtgcattatggttggcgctaatgcctccgaccgcatgggcatggggaccacataccttgcgctgatggctaccttcaagatgagacctatgtttgccgtgggactcctgttccggcgcctcacctctagagaggtcctgcttctgacaatcggcctcagcctggtggcctccgtggaactgcccaactctcttgaggaactgggggatggactcgctatgggcattatgatcctgaaactcctgacggactttcaaagccatcagctttgggccaccctgctctccctgacattcattcggaccacatttagcctgcactatgcttggaagaccatggccatggtcctttctatcgtttccctgttccccctctgtctgagcacgacatctcagaaaaccacctggctccctgtgctgcttgggtccctgggatgcaagccgctgacaatgtttctcatcgcggagaataagatttggggccgcaaaagctggcccctgaacgaaggcatcatggccgtggggattgtctctatccttctgtccagcctcctgaagaacgatgtgcctctcgctggacccctgattgccggcgggatgcttatcgcttgttacgttatctccggaagctctgccgacctgagcctggagaaagccgctgaggtgtcctgggaagaggaagcggagcattctggcgccagccacaatattctcgtcgaagtgcaggatgacgggaccatgaagatcaaagatgaggagagagacgatacactgacgattcttctgaaggctaccctcctggccgtttccggagtgtatcctctctctatccccgccacactgttcgtctggtacttctggcagaagaagaagcagcggagcggcgtgctttgggacacccctagccctcccgaagtcgagcgcgctgtgctggatgacggcatttatagaatcatgcagcgggggctgctcggacgctctcaggttggcgtgggggtctttcaagaaaacgtgttccatacaatgtggcacgttaccagaggagccgtgctgatgtaccagggcaaacggcttgagcccagctgggcgtccgtcaagaaagacctgattagctacgggggaggctggagactccagggctcttggaatacgggggaggaagtccaggtgatcgctgttgagcccggaaagaaccctaaaaatgtccaaaccgcccccggcacatttaagacctccgaaggggaggtgggagccatcgctctggatttcaagccgggcacaagcgggtctcctattgtgaaccgcgaaggaaaaatcgtcggcctctatggcaatggggtggttaccacatccggaacgtacgtgagcgccattgcgcaggctaaggcctcccaggagggccccctgcctgagatcgaagacgaggtctttcggaaaagaaaccttaccattatggatctgcaccccgggtctggaaagacacgccggtatctgcccgccatcgtgagagaagctatcaaacgccggctcagaaccctgattcttgcccctacccgcgttgtggctagcgagatggccgaagcgctgaagggcatgccgatccggtaccaaacaacggccgtcaagtccgagcataccgggaaagagattgtggacctcatgtgccacgctacattcaccatgagactgctgagccccgttcgggtgcctaattataacatgatcattatggatgaagcccattttacagacccctcttccatcgctgcccgcggctacatcagcaccagagtcggaatgggcgaggccgctgcgattttcatgacggccacacctcccgggtctgtggaggcttttcctcagagcaatgccgtgatccaggatgaggaacgggacattccggagcgctcctggaactctggatatgagtggatcaccgatttccccggcaagaccgtctggtttgttcctagcattaaatccgggaatgacatcgccaactgtctcagaaagaatggaaaacgggtgattcagctttctagaaagacattcgataccgaataccaaaagaccaaaaacaacgactgggactacgtggtcaccacggatatcagcgagatgggcgctaatttccgcgccgaccgggtgatcgatcccagacgctgcctgaagcctgttattctgaaagacgggcccgaacgggtgatcctcgcgggcccgatgcctgtcacagtggcttccgccgcccagagacgcggacggattggcagaaaccacaataaggagggggatcagtatatctacatgggacagcccctgaacaatgacgaggatcatgctcactggaccgaagccaaaatgcttctggacaacattaatacacccgagggcatcatccctgcgctctttgaacccgagcgcgaaaagagcgccgctattgatggggagtatagactgcggggagaggcccgcaagaccttcgttgaactgatgagacggggcgacctccctgtgtggctttcttacaaagtcgcttccgaggggtttcaatatagcgatcgcagatggtgcttcgacggcgaacggaacaatcaggtgctggaggaaaacatggatgtcgagatctggacgaaggagggagaacgcaaaaagctgcgcccgcggtggctcgacgccagaacctactccgaccccctggctcttagagagtttaaagagttcgccgcgggccggagatctgtgagcggggatctgattctcgagatcggaaagctgcctcagcacctgacacagcgggcccaaaatgctctcgacaaccttgttatgctgcataattccgaacagggcgggcgcgcctatagacacgctatggaggagctgcccgataccattgaaacactcatgctgcttgccctgatcgccgtgctcaccggaggcgtgacactgtttttcctgtctggccgggggctcggaaaaaccagcatcggccttctgtgtgtcatggcttccagcgttctgctctggatggcgtctgtggagcctcattggattgccgcttccatcattctggaatttttccttatggtgctgctcatccccgagccggaccgccagagaacgcctcaggataaccaactggcctacgtcgtgattgggctgctctttatgatccttacagttgccgctaatgagatgggactgctggaaaccaccaagaaggacctcggcattgggcacgtggccgtcgagaaccaccatcacgcggccatgctggatgtggaccttcatcccgctagcgcctggacactgtacgctgtcgccaccacaatcatcacgcctatgatgcggcacaccattgaaaacacaaccgcgaatatctctctcacagccattgctaaccaggccgctatcctgatgggactggataaaggctggcccatttccaagatggacatcggcgtgcctctccttgccctggggtgctatagccaggttaatcccctgaccctcacggctgccgtgctgatgcttgtcgcgcattacgccatcattggaccgggcctgcaagctaaagccacccgcgaggctcagaagagaacagccgccgggatcatgaaaaaccctaccgtggatggaattgttgcgatcgacctcgatcccgtggtctatgacgctaagttcgaaaagcagctgggccagattatgctgctcatcctttgtacatctcaaatcctgctgatgcggaccacgtgggccctctgcgagagcattacactggctaccgggccccttacaaccctgtgggagggatcccctggcaaattttggaataccacaatcgccgtgtctatggccaacattttccgcggcagctacctcgctggggccggactggcgttctccctgatgaagtccctcggcgggggaagacggggcacgggggcccagggagaaacccttggcgagaaatggaagagacagctgaatcagctgtccaaatctgaatttaacacatataagcgcagcggcatcatggaggtggaccggtccgaagctaaggaggggctcaaaagaggagagaccacaaagcacgccgtttctcgcggcaccgctaaactgcggtggttcgtcgaaagaaatcttgtgaagccggaggggaaagtgattgatctgggatgtggccgcgggggatggagctactattgcgccggcctcaagaaggtcacggaagttaaaggctacacaaaagggggacccggccacgaggaacctatccccatggcgacctacgggtggaacctggtgaaactgcattccggaaaggacgtgtttttcattcctcccgagaaatgtgataccctcctttgcgacatcggcgagtctagccctaatccgacaatcgaagaggggcggaccctgagagtcctgaagatggtggaaccctggctccgcggaaaccaattttgtattaaaatcctgaatccttatatgccctccgttgtggagacacttgagcagatgcagcggaagcacggcggcatgctggtcagaaaccctctcagccgcaattctacgcatgaaatgtactgggtgtcctgcgggaccggaaacattgttagcgccgtgaatatgacatctcggatgctgctgaacagattcaccatggctcaccgcaagcccacatatgagagagatgtcgacctcggcgccgggacccggcacgtggctgtggaaccggaggtcgccaacctggatatcattggacagcgcatcgaaaatatcaaacatgagcacaagtccacgtggcattacgacgaggataacccttataaaacctgggcttaccacggcagctatgaagttaagccctctgggtccgccagctccatggtgaatggagtggtcaaacttctgacaaagccctgggacgtgattcctatggttacccaaatcgcgatgacagataccacaccctttggccagcagagagtgttcaaggagaaagtcgacacccggacgcctaaggccaaaagaggcacagctcaaattatggaagtgaccgccaagtggctctgggggtttctgagccggaacaaaaagccgcgcatctgtaccagagaggagttcacacggaaggttcgctctaatgctgccattggagccgtgtttgtcgacgagaaccagtggaatagcgcgaaagaggctgtggaagatgagagattctgggaccttgttcatcgggaacgcgagctgcacaagcagggcaaatgcgccacgtgcgtgtacaacatgatggggaagagagagaaaaagctcggagagtttggcaaggccaaagggtcccgggctatctggtacatgtggctgggcgcccgcttcctggagttcgaagctctcggatttatgaatgaggatcactggttctctagagaaaacagcctgtccggcgtcgagggggagggacttcataagctgggctatatcctccgggacatttctaaaatccccgggggaaatatgtacgccgatgacaccgcgggctgggatacacgcattaccgaagacgatctgcagaacgaggccaagatcacagacattatggaacctgagcacgcccttctggccaaaagcatctttaagctcacctatcaaaataaagtggtcagagtgcagcggcccgctaagaacgggacagttatggatgtgatctcccgcagagaccagcggggctctggacaggtcggcacctacgggctgaatacgttcaccaacatggaagcccaactgattagacagatggagagcgagggaatcttttcccctagcgaactcgagacacccaacctggcgggccgcgtgcttgattggctggaaaagcatggggtggagcggctcaaaagaatggccatttctggagacgactgtgttgtgaagccgatcgatgaccgcttcgctaccgccctgacagctcttaatgatatgggcaaagtccggaaggacattcctcagtgggaaccctccaaagggtggaacgattggcagcaagtgcctttttgcagccaccacttccatcagctgatcatgaaggacggcagagagattgttgtgccctgtcgcaatcaggatgagctcgtcggacgggccagagtgtctcagggcgctgggtggtccctgcgcgaaaccgcctgcctgggaaagagctatgcgcaaatgtggcagctcatgtactttcaccggagagacctgcgccttgccgctaacgccatctgttccgccgtccctgtggattgggttcccacgtctcggacaacctggagcatccatgctcaccatcagtggatgacaaccgaggacatgctgtccgtgtggaatagagtctggattgaagagaacccgtggatggaagataaaacgcacgtgagctcttggggcgacgttccttatctcgggaagcgggaggaccaatggtgcggatccctgatcggccttaccgccagagcgacatgggctaccaatattcaggtggccatcaaccaggtccgccggctgctcgggaatgagaactacctggattacatgacaagcatgaaaagattcaagaatgaatctgaccccgagggcgccctgtggtga

SEQ ID NO: 19302 - RNA, 9879 nt, synthetic construct
  misc_feature 1..9879: note = derived and/or modified CDS sequence (opt5) from DENV-1__EU482493__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtggaggactatggattcggcatttttacgacaaacatctggctgaaacttcgcgattcctacacccaggtctgcgaccaccggctcatgagcgcggccattaaagattctaaggctgttcatgccgacatgggctattggatcgaatccgagaaaaatgaaacatggaagctggccagagctagcttcatcgaggtgaagacctgtatttggcccaaatctcacacactgtggtccaacggggtgctcgaaagcgagatgatcattccgaagatctacggaggccctatttctcaacataattatcgccccgggtacttcacccagacggccggaccttggcacctgggcaaacttgagctggattttgacctctgcgaagggaccacagtcgtggttgatgagcactgcggaaaccggggccccagcctgagaaccacaaccgtgacgggcaagatcatccatgaatggtgttgccggtcctgtacactgcctccccttcgcttcagaggggaggacggatgctggtacggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattgttggacagctgacctggaacgatctgatcagactttgcattatggtgggcgccaatgcctctgaccgcatgggcatggggaccacatatctggctctcatggccacgttcaagatgagacctatgtttgcggtcggactgctgttccggcgcctgaccagcagagaggtgcttctgctcacaatcggcctgtccctggtggcttctgtcgaacttcccaacagcctggaggaactcggggatggactggccatgggcatcatgattctcaaactgcttaccgactttcaatcccaccagctgtgggccacactcctgagcctgaccttcatcaagacgacattttctcttcattacgcttggaaaaccatggccatggttctgtccgtggtgagcctcttccccctgtgtctctctaccacatcccagaagaccacatggctgcctgtccttctggggagcctgggatgcaagccgctcacgatgtttctgattgctgagaataaaatctggggccggcgctcttggccccttaacgaaggcattatggccgtggggatcgtttccatcctgctcagctccctgctcaagaacgatgtgcctctggcgggaccccttattgccggcgggatgctgatcgcttgttatgtcattagcggatctagcgccgacctgtccctcgagaaagctgccgaggtgtcttgggaagaggaagccgagcacagcggcgcttcccataatatcctggttgaagtgcaggatgacgggaccatgaagattaaagatgaggagagagacgatacacttaccatcctgctcaaggcgacactgctcgccgtctctggagtgtaccctctgagcatccccgctacccttttcgtctggtatttctggcagaagaagaagcagcggtccggcgtgctgtgggacacgccttctcccccggaagttgagcgcgccgtgctggatgacggcatttacagaatcatgcagcgggggctcctgggacgcagccaggtcggcgtgggggtttttcaagaaaacgtgttccacaccatgtggcacgtcacaagaggagccgtgcttatgtatcagggcaaacggctggagccttcctgggctagcgtgaagaaagacctcatttcttacgggggaggctggagactgcagggctcctggaataccggggaggaagttcaggtcatcgccgtggagcccggaaagaaccctaaaaatgtgcaaacagcgcccggcacctttaagacaccggaaggggaggtcggagctattgccctcgatttcaagcctggcacgagcgggtctcccatcgtgaaccgcgaaggaaaaattgttggcctgtacggcaatggggtggtcaccacatccggaacctatgtgagcgccatcgctcaggccaaggcgtcccaggagggccctcttcccgagatcgaagacgaggtttttcggaaaagaaacctgaccattatggatctgcatcccgggtctggaaagacacgccggtacctccctgctatcgtgagagaagccattaaacgcaagctgcggacgcttatcctggccccgaccagagtcgtggctagcgagatggccgaagctctcaagggcatgcccattcgctatcaaacaaccgccgttaaatccgagcacacagggaaggagatcgtggacctgatgtgccatgcgaccttcacgatgcggctgctcagccctgtcagagtgcccaattacaacatgatcattatggatgaagcccactttacagacccttcttccatcgctgcccggggctatattagcacccgcgtgggaatgggcgaggctgccgccatcttcatgaccgctacaccccctgggtctgtcgaagcgtttccgcagagcaatgccgttattcaggatgaggaaagagacatccccgagcggtcctggaactctggatacgagtggatcaccgatttccctggcaaaacagtgtggtttgtgcccagcattaagtccgggaatgacatcgctaactgtcttcgcaaaaatggaaagagagtcattcagctgtctcggaagaccttcgatacggaatatcagaagaccaagaacaacgactgggactacgtggttaccacagatatcagcgagatgggcgccaatttcagagccgaccgcgtgattgatcctcggagatgcctgaaacccgtcatcctcaaggacgggccggaacgcgtgattctggctggccctatgcccgttaccgtggcctccgcggctcagcggagaggacgcatcggccggaaccataataaagagggggatcagtacatctatatgggacagccccttaacaatgacgaggatcacgcccactggacggaagccaagatgctgctcgacaacattaatacccctgagggcatcattcccgctctgtttgaacctgagagagaaaagagcgccgcgatcgatggggagtaccgcctgagaggagaggcccggaaaacattcgtcgaactcatgcgcagaggcgaccttccggtgtggctgtcttataaggtcgcttccgaggggtttcaatacagcgatcggcgctggtgcttcgacggcgaaagaaacaatcaggtgctggaggaaaacatggatgttgagatttggaccaaagagggagaacggaagaaactcagaccccgctggctggacgcccggacatattccgaccctcttgctctgagagagtttaaggagttcgccgctggccgccggtctgtgagcggggatctcatcctggagatcggaaaactgccccagcatctcacccagagagcccaaaatgcgcttgacaacctggtgatgctgcacaattccgaacagggcgggcgggcctaccgccatgctatggaggagctccctgatacaattgaaaccctgatgcttctggccctcatcgctgtcctgacgggaggcgttacactgtttttcctctctggcagagggcttggaaagaccagcattggcctgctgtgtgtgatggcctccagcgtgctcctgtggatggcctctgtcgagccccactggatcgctgcgtccattatccttgaatttttcctgatggtgctcctgatcccggagcctgaccggcagcgcacaccccaggataaccaactggcctatgttgtgattgggctcctttttatgatcctgacagtcgctgccaatgagatgggactgctcgaaaccacaaagaaagacctgggcattgggcacgtggccgtcgagaaccatcaccatgctgccatgcttgatgtggacctgcaccctgcgagcgcctggacgctctacgctgttgccaccacaatcattacccccatgatgagacatacaatcgaaaacaccacggctaatatttctctgaccgccatcgcgaaccaggccgctatcctgatgggactcgataagggctggcctatttccaaaatggacatcggcgtgccccttctggccctggggtgctacagccaggtcaatccgctcacactgaccgctgccgtgcttatgctggttgctcactatgccattatcggacctggcctccaagcgaaggccacacgggaggctcagaaacgcaccgccgctgggattatgaagaaccccacggtggatggaatcgtcgccatcgacctggatcccgtggtgtacgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaattgccgtttctatggctaacatcttccggggcagctatctggccggggccggactggctttctccctcatgaaaagccttggcgggggacgcagaggcaccggggcccagggagaaacactgggcgagaagtggaaacggcagctgaatcagctctccaagtctgaatttaacacctacaagagaagcggcatcatggaggtcgaccgctccgaagcgaaagaggggctgaagcggggagagacgacaaaacacgccgtgtctagaggcaccgctaaacttcgctggttcgtggaacggaatctggtcaaacccgaggggaaggttattgatctcggatgtggcagagggggatggagctattactgcgccggcctgaagaaagtgaccgaagtgaagggctatacaaaagggggacctggccatgaggaacccatccctatggctacctacgggtggaacctggtcaagctccactccggaaaagacgtgtttttcattccccctgagaagtgtgatacacttctgtgcgacatcggcgagtctagcccgaatcccacgattgaagaggggcgcaccctgcgggttctcaaaatggtggaaccttggctgagaggaaaccaattttgtatcaagattcttaatccctacatgccttccgtcgtggagacactggagcagatgcagcgcaagcatggcggcatgctcgttcggaaccccctgagcagaaattctacccacgaaatgtattgggtgtcctgcgggacaggaaacatcgtcagcgccgtgaatatgacctctcgcatgctgctcaaccggttcacgatggcgcacagaaaaccgacctacgagcgcgatgtggacctgggcgccgggacaagacatgtcgctgttgaacctgaggtggccaaccttgatatcattggacagcggatcgaaaatattaagcacgagcataaatccacctggcactatgacgaggataacccctacaagacatgggcttatcatggcagctacgaagtgaaaccctctgggtccgccagctccatggtcaatggagtggttaagctgctcaccaagccttgggacgtgatccccatggtcacacaaattgctatgaccgatacgacaccttttggccagcagcgcgtgttcaaagagaaggttgacaccagaaccccgaaagccaagcggggcacagcgcaaatcatggaagtgacggccaaatggctgtgggggtttcttagcagaaacaagaagccccggatctgtacccgcgaggagttcacaagaaaagtccggtctaatgctgccattggagctgtgtttgttgacgagaaccagtggaatagcgccaaggaggccgtggaagatgagcgcttctgggacctggtccacagagaacgggagctccacaaacagggcaagtgcgcgacctgcgtgtataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgtcgagggggagggactgcacaaactcggctacattctgagagacatctctaagattcctgggggaaatatgtatgccgatgacacagctggctgggatacccggatcacagaagacgatcttcagaacgaggcccgcatcaccgacattatggaacccgagcatgcgctgctcgccaaaagcatctttaagctgacgtaccaaaataaagtggttagagtgcagcggcctgctaagaacgggaccgtcatggatgtgatttcccgcagagaccagcggggctctggacaggtgggcacatatgggctgaataccttcacaaacatggaagcccaactcatcagacagatggagagcgagggaatcttttcccccagcgaactggagaccccgaaccttgctgaacgcgttctggattggctcgagaagtacggcgtggaacggctgaaaagaatggccatctctggggacgactgtgtcgtgaagcctatcgatgaccgcttcgcgacggcccttacagctctgaatgatatgggaaaagttcggaaggacattccccagtgggagccttccaaaggctggaacgattggcagcaagtgcccttttgcagccaccacttccatcagctcatcatgaaggacgggagagagattgtcgtgccttgtcgcaatcaggatgaactggtcggccgggccagagtgtctcagggagctggctggtccctgcgcgagaccgcctgcctcggaaagagctatgctcaaatgtggcagctgatgtactttcaccggagagaccttcgcctggccgcgaacgccatctgttccgctgttcccgtggattggattccgacatctcggaccacgtggagcatccatgcccaccatcagtggatgaccacagaagacatgctctccgtctggaatagagtgtggattgaggaaaacccttggatggaggataaaacccacatcagctcttggggagacgttccctatctgggcaagcgggaggaccaatggtgcgggtcccttatcggactgacagccagagctacctgggccacaaatattcaggtggcgatcaaccaggtccgccggctcattggcaatgaaaactacctggattacatgaccagcatgaaaagattcaagaatgagtctgaccccgaaggggctctgtggtga

SEQ ID NO: 19303 - RNA, 9879 nt, synthetic construct
  misc_feature 1..9879: note = derived and/or modified CDS sequence (opt5) from DENV-1__EU482494__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggagctctgtgaagatacaatcacctacaaatgccccagaattacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagatccagcgggttgaaacctgggccctgcgccaccccggcttcacagtgattgctctttttctggcccatgcgatcgggacctctatcacccagaagggaattatcttcattctcctgatgcttgccacacctagcatggctatgagatgcgtcggcatcgggtcccgggattttgtggagggactgagcggcgccacgtgggttgacgtggtcctcgagcacgggtcttgtgtgaccacaatggctaaggataaacccaccctggacattgaactgctcaagacagaggtgaccaaccctgccgtcctgcgcaaactttgcatcgaagcgaagatttccaatacgacaaccgatagcagatgtccgacccaaggagaggccacactggttgaagaacaggacgctaacttcgtgtgccggcgcacctttgtggatagaggctggggcaatgggtgtggactcttcggcaaagggtctctgatcacatgcgccaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgctacgatcacaccccaggcccctacaaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcttccacatctcaagagacctggaatcgccaggacctgctcgtcaccttcaaaacagcgcacgccaagaagcaggaagtggtcgtgctgggaagccaagagggcgctatgcacacggccctgaccggggccacagaaatccagacctccggaacaaccacgatttttgctggccatctcaaatgcagactgaagatggataaacttacactgcgggggatgagctatgttatgtgtaccggctctttcaagctcgagaaagaagtggccgagacccagcacggaacagtcctggtgcagatcaagtacgagggcaccgacgcgccgtgcaagatccctttctccacacaagatgaaaaaggggttacgcagaacggaagactgattaccgctaatcccatcgtgacagacaaggagaaacctgtcaacattgaagccgagccgccctttggcgagagctatatcgtgattggggccggagaaaaggctcttaaactctcttggttcaagaagggcagctccatcgggaaaatgtttgaggccaccgctcgcggcgcccggagaatggcgatcctgggagatacagcctgggacttcggctctattgggggagtgtttaccagcgttggcaagctggtccatcagatcttcgggacggcttacggagtgctcttttccggcgtgagctggaccatgaaaattgggatcggcgtcctgcttacatggctgggactcaattctcgctccaccagcctgtctatgacatgtattgccgtgggcctggttaccctttacctcggggtgatggtccaggctgattccggatgcgtgatcaactggaagggccgggaactgaaatgtgggagcggaattttcgttacaaatgaggtgcacacctggacggaacaatataagtttcaggccgactcccctaagagactgtctgcggccatcggcaaggcttgggaggagggggtctgcggcatccgcagcgccacacggctcgaaaacattatgtggaagcagatctccaacgagctgaatcatattcttctggaaaacgacatgaaattcaccgtggttgtgggagatgtcgctggcatcctcgcccaggggaagaaaatgattagaccgcaacccatggagcacaagtactcttggaaaagctggggaaaggccaagatcatcggcgctgacgtgcagaataccacatttattatcgatgggcctaacacccccgaatgtcctgacgatcagcgcgcgtggaatatttgggaggtggaggactatggattcggcatctttacgacaaacatttggctgaaactgcgggattcctacacccaggtctgcgaccacagacttatgagcgccgctatcaaggattctaaagccgttcatgccgacatgggctattggatcgaatccgagaagaatgaaacatggaaactcgctcgcgccagcttcattgaggtgaagacctgtatctggcccaagtctcacacactgtggtccaacggggtgctggaaagcgagatgattatcccgaaaatttacggaggccctatctctcaacataattatcggcccgggtacttcacccagacggcgggaccttggcacctcggcaagctggagcttgattttgacctgtgcgaagggaccacagtcgtggttgatgagcactgcggaaacagaggccccagcctccggaccacaaccgtgacgggcaaaatcattcatgaatggtgttgccgctcctgtacactgcctcccctgagattcagaggggaagacggatgctggtacggcatggagatccggccggtcaaggaaaaagaggaaaatcttgtgaaaagcatggtttctgctgggtccggagaggtggacagcttttccctcggcctgctgtgtatttctatcatgattgaagaggtcatgcgcagccggtggtccagaaagatgctcatgaccgggacactggccgtgttctttcttctgatcatgggacagctcacctggaacgatctgattcgcctgtgcatcatggttggcgccaatgcttctgacagaatgggcatggggaccacatatcttgccctgatggcgacgttcaaaatgcggcctatgtttgctgtgggactcctgttccgcagactcaccagccgggaggtcctgcttctgacaatcggcctctccctggtggcctctgtggaactgcccaacagccttgaggaactgggggatggactcgccatgggcattatgatcctgaagctcctgaccgactttcaatcccaccagctttgggctacactgctcagcctgaccttcattaaaacgacattttctctgcattacgcctggaagaccatggctatggtcctttccatcgttagcctgttccccctctgtctgtctaccacatcccagaaaaccacatggctccctgtgctgcttgggagcctgggatgcaagccgctgacgatgtttctcattgccgagaataagatctggggccgcagatcttggcccctgaacgaaggcatcatggcggtggggattgtctccatccttctgagctccctcctgaaaaacgatgtgcctctcgccggacccctgattgctggcgggatgcttatcgcctgttatgttattagcggatctagcgctgacctgtccctggagaaggccgccgaggtgtcttgggaagaggaagctgagcacagcggcgcgtcccataatatcctcgtcgaagtgcaggatgacgggaccatgaaaatcaaggatgaggagcgggacgatacactgaccattcttctgaaagccacactcctggctgtttctggagtgtaccctctcagcatccccgccaccctgttcgtctggtatttctggcaaaagaaaaagcagcgctccggcgtgctttgggacacgccttctcccccggaagtcgagagagccgtgctggatgacggcatttaccggatcatgcagcgcgggctgctcggaagaagccaggttggcgtgggggtctttcaagaaaacgtgttccacaccatgtggcacgttacacggggagctgtgctgatgtatcagggcaagagacttgagccttcctgggccagcgtcaaaaaggacctgatttcttacgggggaggctggcgcctccagggctcctggaataccggggaggaagtccaggtgatcgcggttgagcccggcaagaaccctaagaatgtccaaacagctcccggcacctttaaaacaccggaaggggaggtgggagccattgccctggatttcaagcctggcacgagcgggtctcccatcgtgaaccgggaaggaaagatcgtcggcctctacggcaatggggtggttaccacatccggaacctatgtgagcgctattgcccaggcgaaggcttcccaggagggccctctgcccgagatcgaagacgaggtctttagaaagcgcaaccttaccattatggatctgcatcccgggtctggaaaaacacggagatacctgcctgccatcgtgcgcgaagccattaagcggaaactcagaacgctgatccttgctccgacccgcgttgtggccagcgagatggctgaagccctgaagggcatgcccatccggtatcaaacaaccgcggtcaagtccgagcacacagggaaagagattgtggacctcatgtgccatgccaccttcacgatgagactgctgagccctgttcgggtgcccaattacaacatgatcattatggatgaagctcactttacagacccttcttccatcgccgctcgcggctatattagcaccagagtcggaatgggcgaggccgccgctatcttcatgaccgcgacaccccctgggtctgtggaagcctttccgcagagcaatgctgtgatccaggatgaggaacgggacattcccgagcgctcctggaactctggatacgagtggatcaccgatttccctggcaagacagtctggtttgttcccagcattaaatccgggaatgacatcgccaactgtctcagaaagaatggaaaacgggtgattcagctttctagaaagaccttcgatacggaatatcaaaagaccaaaaacaacgactgggactacgtggtcaccacagatatcagcgagatgggcgccaatttccgcgctgaccgggtgattgatcctagacgctgcctgaagcccgttatcctgaaagacgggccggaacgggtgatcctcgccggccctatgcccgtcaccgtggcgtccgctgcccagagacgcggacggattggcagaaaccataataaggagggggatcagtacatctatatgggacagcccctgaacaatgacgaggatcacgcccactggacggaagctaaaatgcttctggacaacattaatacccctgagggcatcattcccgccctctttgaacctgagcgcgaaaagagcgcggccatcgatggggagtacagactgcggggagaggctcgcaagacattcgttgaactgatgagacggggcgacctcccggtgtggctttcttataaagtcgcctccgaggggtttcaatacagcgatcgcagatggtgcttcgacggcgaacggaacaatcaggtgctggaggaaaacatggatgtcgagatctggaccaaggagggagaacgcaaaaagctgcgcccccggtggctcgacgctagaacatattccgaccctctggcccttcgcgagtttaaagagttcgctgccggccggagatctgtgagcggggatctgattctcgagatcggaaagctgccccagcatctgacccagcgggcgcaaaatgccctcgacaaccttgttatgctgcacaattccgaacagggcgggcgcgcttacagacatgccatggaggagctgcctgatacaattgaaaccctcatgctgcttgctctgatcgccgtgctcacgggaggcgtgacactgtttttcctgtctggccgggggctcggaaaaaccagcattggccttctgtgtgtcatggcctccagcgttctgctctggatggcttctgtggagccccactggatcgcggcctccatcattctggaatttttccttatggtgctgctcatcccggagcctgaccgccagagaacaccccaggataaccaactggcttatgtcgtgattgggctgctctttatgatccttacagttgccgccaatgagatgggactgctggaaaccacaaagaaggacctcggcattgggcacgtggctgtcgagaaccatcaccatgccgcgatgctggatgtggaccttcaccctgccagcgcttggacgctgtacgccgtcgctaccacaatcattacccccatgatgcggcatacaatcgaaaacaccacggccaatatctctctcaccgcgattgccaaccaggctgccatcctgatgggactggataaaggctggcctatttccaagatggacatcggcgtgcccctccttgctctggggtgctacagccaggttaatccgctgacactcaccgccgctgtgctgatgcttgtcgcccactatgcgattatcggacctggcctgcaagccaaagctacacgcgaggcccagaagagaaccgctgccgggatcatgaaaaaccccacggtggatggaattgttgccatcgacctcgatcccgtggtctacgacgcgaagttcgaaaagcagctgggccagattatgctgctcatcctttgtacatctcaaattctgctgatgcggaccacatgggctctctgcgagagcatcaccctggccaccgggcctcttacaacgctgtgggagggatccccgggcaaattttggaataccacaatcgctgtgtctatggccaacattttccgcggcagctatctcgccggggctggactggccttctccctgatgaaaagcctcggcgggggaagacggggcaccggggcgcagggagaaacacttggcgagaaatggaagagacagctgaatcagctgtccaaatctgaatttaacacctacaagcgcagcggcatcatggaggtggaccggtccgaagccaaggaggggctcaaaagaggagagacgacaaagcacgctgtttctcgcggcaccgccaaactgcggtggttcgtcgaaagaaatcttgtgaagcccgaggggaaagtgattgatctgggatgtggccgcgggggatggagctattactgcgctggcctcaagaaggtcaccgaagttaaaggctatacaaaaggcgggcctgggcatgaggaacccatccctatggccacctacgggtggaacctggtgaaactgcactccggaaaggacgtgtttttcattccccctgagaaatgtgatacactcctttgcgacatcggcgagtctagcccgaatcccacgattgaagaggggcggaccctgagagtcctgaagatggtggaaccttggctccgcggaaaccaattttgtatcaaaatcctgaatccctacatgccttccgttgtggagacacttgagcagatgcagcggaagcatggcggcatgctggtcagaaaccccctcagccgcaattctacccacgaaatgtattgggtgtcctgcgggacaggaaacattgttagcgcggtgaatatgacctctcggatgctgctgaacagattcacgatggcccaccgcaagccgacctacgagagagatgtcgacctcggcgctgggacacggcatgtggccgtggaacctgaggtcgctaacctggatatcattggacagcgcatcgaaaatattaaacacgagcataagtccacctggcactatgacgaggataacccctacaaaacatgggcctatcatggcagctacgaagttaagccctctgggtccgctagctccatggtgaatggagtggtcaaacttctgaccaagccttgggacgtgatccccatggttacacaaatcgccatgaccgatacgacaccttttggccagcagagagtgttcaaggagaaagtcgacacccggaccccgaaggcgaaaagaggcacagcccaaattatggaagtgacggctaagtggctctgggggtttctgagccggaacaaaaagccccgcatctgtaccagagaggagttcacacggaaggttcgctctaatgccgctattggagccgtgtttgtcgacgagaaccagtggaatagcgccaaagaggcggtggaagatgagagattctgggaccttgttcaccgggaacgcgagctgcacaagcagggcaaatgcgctacctgcgtgtataacatgatggggaagagagagaaaaagctcggagagtttggcaaggccaaagggtcccgggccatctggtacatgtggctgggcgctcgcttcctggagttcgaagccctcggatttatgaatgaggatcattggttctctagagaaaacagcctgtccggcgtcgagggggagggacttcacaagctgggctacattctccgggacatctctaaaatccctgggggaaatatgtatgctgatgacacagccggctgggatacccgcattacagaagacgatctgcagaacgaggcgagaatcaccgacattatggaacccgagcatgcccttctggctaagagcatctttaaactcacgtaccaaaataaggtggtccgggtgcagcgccctgccaaaaacgggaccgttatggatgtgatttccagacgggaccagagaggctctggacaggtcggcacatatgggctgaataccttcacaaacatggaagctcaactgatccgccagatggagagcgagggaatcttttcccccagcgaactcgagaccccgaacctggccgaacgggtgcttgattggctggagaagtacggcgtggaaagactcaagcgcatggcgatttctggggacgactgtgttgtgaaacctatcgatgaccggttcgccacggctctgacagcccttaatgatatgggaaaggtcagaaaagacattccccagtgggagccttccaagggctggaacgattggcagcaagtgcccttttgcagccaccacttccatcagctgatcatgaaagacgggcgcgagattgttgtgccttgtcggaatcaggatgaactcgtcggcagagctcgcgtgtctcagggagccggctggtccctgcgggagaccgcttgcctgggaaagagctatgcccaaatgtggcagctcatgtactttcacagacgcgacctgcggcttgcggccaacgctatctgttccgccgtccccgtggattggattccgacatctagaaccacgtggagcatccatgcccaccatcagtggatgaccacagaagacatgctgtccgtttggaatcgggtgtggatcgaggaaaacccttggatggaggataagacccacattagctcttggggagacgtcccctatctcggcaaaagagaggaccaatggtgcgggtccctgatcggacttacagctcgcgccacctgggcgacaaatattcaggtggctatcaaccaggttcggagactgattggcaatgaaaactacctcgattacatgaccagcatgaagcgcttcaaaaatgagtctgaccccgaaggggccctgtggtga

SEQ ID NO: 19304 - RNA, 9879 nt, synthetic construct
  misc_feature 1..9879: note = derived and/or modified CDS sequence (opt5) from DENV-1__EU482495__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacgagcgccggcgttaatatgtgcacccttattgcgatggacctgggggaactctgtgaagatacaatgacctacaagtgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagagctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggcctcttcaagctggagaaggaagtggctgagacacagcacggaaccgttctggtgcagattaaatacgagggcaccgacgccccgtgcaagatccctttctccacacaagatgaaaaaggggtcacccagaacggaagacttatcacagcgaatcccattgtgacggacaaggagaaacctgtgaacatcgaagctgagccgccctttggcgagagctatattgttatcggggccggagaaaaggccctcaagctgtcttggttcaaaaagggcagctccattgggaaaatgtttgaggctaccgcccggggcgctagacgcatggccatcctgggagatacagcgtgggacttcggctctatcgggggagtctttaccagcgtgggcaagctcgtgcatcagattttcgggacagcctacggagtcctgttttccggcgtgagctggaccatgaaaatcgggattggcgttcttctgacgtggctcggactcaattctcggtccaccagcctgtctatgacatgtatcgctgtgggccttgtcaccctctacctgggggtgatggttcaggccgattccggatgcgtgattaactggaagggcagagaactgaagtgtgggagcggaatcttcgtcacaaatgaggtgcacacctggacagaacaatataaatttcaggctgactcccctaagcgcctctctgccgcgattggcaaagcctgggaggagggggtttgcggcatccggagcgctaccagactggaaaacatcatgtggcgccagatttccaacgagcttaatcatatcctgctcgaaaacgacatgaagttcacggtggtcgtgggagatgtggtcggcattctggcccaggggaaaaagatgatccggccgcaacccatggagcacaaatactcttggaaaagctggggaaaggctaagattatcggcgccgacgttcagaatacaacctttatcattgatgggcctaacacccccgaatgtcctgacgatcagagagcctggaatatctgggaggtggaggactatggattcggcatttttacaaccaacatctggctgaaacttcgcgattcctacacacaggtgtgcgaccaccggctcatgagcgctgcgattaaagattctaaggccgtccatgctgacatgggctattggatcgaatccgagaaaaatgaaacatggaagctggccagagccagcttcatcgaggtgaagacctgtatttggcccaaatctcacacactgtggtccaacggggttctcgaaagcgagatgatcattccgaagatctacggaggccctatttctcaacataattatcgccccgggtacttcacccagacagctggaccttggcacctgggcaaacttgagctggattttgacctctgcgaagggaccacggtggtcgtggatgagcactgcggaaaccggggccccagcctgagaaccacaaccgttacaggcaagatcatccatgaatggtgttgccggtcctgtaccctgcctccccttcgcttcaaaggggaggacggatgctggtacggcatggagattagaccggtgaaggaaaaggaggaaaatctcgtcaaaagcatggtgtctgccgggtccggagaggttgacagcttttccctgggcctgctctgtatctctattatgatcgaagaggtgatgcggagcagatggtcccgcaagatgctgatgacggggacacttgcggtcttctttctgctcattatgggacagctgacctggaacgatctgatccggtcttgcattatggtgggcgctaatgccagcgacagaatgggcatggggacaacctatcttgccctgatggctaccttcaaaatgcgccctatgtttgccgtgggactcctgttcagacggctcacatcccgcgaggtcctgcttctgacgatcggcctctctctggttgcgagcgtggaactgcccaactcccttgaggaactgggggatggactcgctatgggcatcatgattctgaagctcctgaccgactttcaaagctaccagctttgggccacactgctctctctgaccttcatcaaaacaaccttttccctgcactatgcctggaagacgatggctatggtgcttagcattgtctctctgctccccctgtgtctctccacaaccagccagaagaccacatggctgcctgtgcttctggggtctctgggatgcaaaccgctcaccatgttcctgatcgccgagaataagatttggggcagaaaatcctggccccttaacgaaggcatcatggctgttgggatcgtgagcattctgctctccagcctgctcaagaacgatgtccctctggccggaccccttatcgcgggcgggatgctgattgcctgttacgtgatctctggaagctccgctgacctgtctctcgagaaagccgctgaggttagctgggaagaggaagccgagcattccggcgcctctcacaatattctggtggaagtccaggatgacgggacaatgaagatcaaagatgaggagcgggacgatacgcttaccatcctgctcaaggctacactgctcgcggtgagcggagtctatcctctgtccattcccgccaccctttttgtgtggtacttctggcaaaagaaaaagcagcgctctggcgttctgtgggacacacctagccctcccgaagtggagagagctgtcctggatgacggcatctatcggattatgcagcgcgggctcctgggaagatcccaggtgggcgttggggtgttccaagaaaacgtctttcataccatgtggcacgtgacgcggggagccgtgcttatgtaccagggcaaacgcctggagcccagctgggcctctgttaagaaagacctcatctcctacgggggaggctggagactgcagggcagctggaataccggggaggaagtccaggtgattgctgtggagcccggaaagaaccctaagaatgtccaaacagcccccggcaccttcaaaacaccggaaggggaggtgggagcgatcgctctcgattttaagcctggcacctctgggtcccccattgttaaccgggaaggaaaaatcgtgggcctgtatggcaatggggtcgtgacaacgagcggaacctacgtttccgccatcgcccaggctaaggcctctcaggagggccctcttcccgagattgaagacgaggtgttcagaaaacgcaacctgacaatcatggatctgcaccccgggagcggaaagacccggagatatctccctgcgattgtccgcgaagctatcaagcggaaactgagaacccttattctggccccgacacgcgtggttgcctccgagatggctgaagccctcaagggcatgcccatccggtaccaaacgaccgctgtgaaaagcgagcatacagggagagagatcgtcgacctgatgtgccacgccacctttacaatgcgcctgctctctcctgtgcgggtgcccaattataacatgattatcatggatgaagcgcatttcaccgacccttccagcattgccgctagaggctacatctctacgcgggtcggaatgggcgaggccgctgccatttttatgacagccacaccccctgggagcgttgaggctttcccgcagtccaatgcggtgatccaggatgaggaacgcgacatccccgagagatcttggaacagcggatatgagtggattaccgattttcctggcaagacagtgtggttcgtcccctccatcaaatctgggaatgacattgccaactgtcttcggaagaatggaaagcgcgtgatccagctgagcagaaaaacctttgatacagaataccaaaagaccaaaaacaacgactgggactacgttgtgacgacagatatttccgagatgggcgctaatttccgggccgacagagtcatcgatcctcgccggtgcctgaagcccgtgattctcaaagacgggccggaaagagttatcctggccggccctatgcccgtgaccgtcgctagcgccgcgcagcgccggggaagaatcggccgcaaccacaataaggagggggatcagtatatttacatgggacagccccttaacaatgacgaggatcatgctcactggacagaagccaagatgctgctcgacaacatcaatacccctgagggcattatccccgccctgttcgaacctgagcgggaaaaatctgctgccattgatggggagtatagactgcgcggagaggcgagaaagacgtttgtggaactcatgcggcgcggcgaccttccggtctggctgtcctacaaagtggccagcgaggggttccaatattccgatagacggtggtgctttgacggcgaacgcaacaatcaggttctggaggaaaacatggatgtggagatctggaccaaggagggagaacgcaagaagctccggcccagatggctggacgctcgcacatactctgaccctcttgccctgcgggagttcaaagaatttgctgccggcagacgcagcgtgtccggggatctcatcctggagattggaaagctgccccagcacctcacccagcgggctcaaaatgcccttgacaacctggtcatgctgcataattctgaacagggcgggagagcgtatcggcacgccatggaggagctccctgatacaatcgaaaccctgatgcttctggctctcattgccgttctgacaggaggcgtgaccctgttctttctcagcggccgcgggcttggaaagacgtccatcggcctgctgtgtgtgatggctagctctgccctcctgtggatggcctccgtcgagccccattggattgctgcgagcatcatccttgagttctttctgatggtgctcctgattccggagcctgacagacagcggacaccccaggataaccaactggcctacgttgtgatcgggctccttttcatgattctgaccgtcgctgccaatgagatgggactgctcgaaaccaccaagaaggacctgggcatcgggcacgtggccgtcgagaaccaccatcacgctaccatgcttgatattgacctgcatcctgcctctgcgtggacactctacgccgtggctacgaccatcattacacccatgatgcgccacaccatcgaaaacacaaccgccaatatctccctgacggctattgccaaccaggcggccatcctgatgggactcgataaaggctggcctattagcaagatggacatcggcgttccccttctggctctggggtgctattctcaggtgaatccgctcaccctgacagccgctgtccttatgctggtggcccattacgctattatcggacctggcctccaagccaaagcgaccagagaggcccagaagcggacagctgccgggatcatgaagaaccccaccgttgatggaattgtggctatcgacctggatcccgtcgtgtatgacgccaaatttgaaaagcagctgggccagattatgctccttatcctgtgtacgagccaaattctgctcatgcgcacaacctgggccctgtgcgagtccatcacacttgcgaccgggcctctgaccacactctgggagggatctccgggcaaattctggaatacgaccatcgctgtgagcatggccaacatttttagaggctcctacctggctggggccggactggccttcagcctcatgaagtcccttggcgggggacggcgcggcacaggggctcagggagaaaccctgggcgagaaatggaagagacagctgaatcagctctctaagagcgagttcaacacatataaacggtccggcatcatggaggttgacagatctgaagccaaggaggggctgcgccggggagagaccacgaaacacgcggtcagcagaggcacagccaaacttcgctggtttgtggaacggaatctggtgaaacccgaggggaaggtcattgatctcggatgtggcagagggggatggtcctactattgcgctggcctgaagaaagttaccgaagtgaagggctacaccaaagggggacctggccacgaggaacccatccctatggccacatacgggtggaacctggtgaagctccattctggaaaagacgtcttctttattccccctgagaagtgtgatacccttctgtgcgacatcggcgagagctccccgaatcccacaattgaagaggggcgcacgctgcgggtgctcaaaatggttgaaccttggctgagaggaaaccaattctgtatcaagatccttaatccctatatgcctagcgtggtcgagaccctggagcagatgcagcgcaagcacggcggcatgctcgtgcggaaccccctgtctagaaattccacacatgaaatgtactgggttagctgcgggaccggaaacattgtgtctgctgtcaatatgacatcccgcatgctgctcaaccggtttaccatggcccacagaaaaccgacgtatgagcgcgatgtggacctgggcgcggggaccagacacgtggccgtcgaacctgaggttgctaaccttgatatcattggacagcggatcgaaaatattaagcatgagcacaaaagcacatggcattacgacgaggataacccctataagacctgggcctaccacggctcttatgaagtgaaaccctccgggagcgcttccagcatggtgaatggagtcgtgaagctgctcacaaagccttgggacgttatccccatggtgacccaaatcgccatgacagataccacgcctttcggccagcagcgcgtctttaaagagaaggtggacacaagaaccccgaaagctaagcggggcaccgcccaaattatggaagttacagcgagatggctgtgggggttcctttctcggaacaaaaagccccgcatctgtacgagagaggaatttacccggaaggtgcgcagcaatgccgctattggagccgtcttcgtggacgagaaccagtggaactccgctaaagaggccgttgaagatgagagattttgggacctggtgcatcgggaacgcgagctccacaagcagggcaaatgcgccacatgcgtctacaacatgatggggaagagagagaagaagctgggagagttcggcaaggcgaaagggtctcgggctatctggtacatgtggctgggcgcccgctttctcgagttcgaagccctgggattcatgaatgaggatcactggtttagcagagaaaactccctttctggcgtggagggggagggactgcataagctcggctatattctgcgggacatcagcaaaatccctgggggaaatatgtacgctgatgacaccgccggctgggatacacgcattaccgaagacgatcttcagaacgaggctaagatcacagacattatggaacccgagcacgccctgctcgcgacctccatcttcaaactgacgtatcaaaataaggtcgtgagagttcagcggcctgcccgcaacgggaccgtgatggatgtcatttctagacgggaccagagaggcagcggacaggtgggcacatacgggctgaatacctttacaaacatggaagctcaactcatccgccagatggagtccgagggaatcttcagcccctctgaactggagaccccgaaccttgccgaacgggtgctggattggctcgagaaacatggcgttgaaagactgaagcgcatggctatttccggggacgactgtgtggtcaagcctatcgatgaccggtttgccacggcgcttagcgccctgaatgatatgggaaaagtgagaaaggacattccccagtgggagccttctaaaggctggaacgattggcagcaagttcccttctgctcccaccactttcatcagctcatcatgaaggacgggcgcgagattgtggtcccttgtcggaatcaggatgaactggtgggcagagctcgcgtcagccagggagccggctggtccctgcgggagacagcttgcctcgggaaatcttatgcccaaatgtggcagctgatgtacttccacagacgcgaccttcggctggctgccaacgcgatctgtagcgccgtgcccgttgattgggtgccgacctccagaacaacctggagcattcatgctcaccatcagtggatgacgaccgaagacatgctctctgtctggaatcgggtgtggatcgaggaaaacccttggatggaggataagacacacatctccagctggggagacgttccctatctgggcaagagagaggaccaatggtgcgggtctcttattggactgaccgcccgcgccacatgggctaccaatatccaggtggccattaaccaggtccggagactcatcggcaatgaaaactacctggattacatgacaagcatgaaacgctttaagaatgactccgatcccgagggggcgctgtggtga

SEQ ID NO: 19305 - RNA, 9879 nt, synthetic construct
  misc_feature 1..9879: note = derived and/or modified CDS sequence (opt5) from DENV-1__EU482496__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacataccttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccatcagctttgggccacactgctcagcctgaccttcattaagacgacattttctctgcactatgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttacgttattagcggatctagcgccgacctgtccctggagaaagctgccgaggtgtcttgggaagaggaagccgagcatagcggcgcttcccacaatatcctcgtcgaagtgcaggatgacgggaccatgaagatcaaagatgaggagagagacgatacactgaccattcttctgaaggcgacactcctggccgtttctggagtgtatcctctcagcatccccgctaccctgttcgtctggtacttctggcagaagaagaagcagcggtccggcgtgctttgggacacgccttctcccccggaagtcgagcgcgccgtgctggatgacggcatttatagaatcatgcagcgggggctgctcggacgcagccaggttggcgtgggggtctttcaagaaaacgtgttccataccatgtggcacgttacaagaggagccgtgctgatgtaccagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctatggcaatggggtggttaccacatccggaacctacgtgagcgccattgctcaggccaaggcgtcccaggagggccctctgcccgagatcgaagacgaggtctttcggaaaagaaaccttaccattatggatctgcaccccgggtctggaaagacacgccggtatctgcctgctatcgtgagagaagccattaaacgcaagctccggacgctgatccttgccccgaccagagttgtggctagcgagatggccgaagctctgaagggcatgcccatccgctaccaaacaaccgccgtcaaatccgagcatacagggaaggagattgtggacctcatgtgccacgcgaccttcacgatgcggctgctgagccctgttagagtgcccaattataacatgatcattatggatgaagcccattttacagacccttcttccatcgctgcccggggctacattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatatgagtggatcaccgatttccctggcaaaacagtctggtttgttcccagcattaagtccgggaatgacatcgctaactgtctccgcaaaaatggaaagagagtgattcagctttctcggaagaccttcgatacggaataccagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccacaataaagagggggatcagtatatctacatgggacagcccctgaacaatgacgaggatcatgcccactggacggaagccaagatgcttctggacaacattaatacccctgagggcatcattcccgctctctttgaacctgagagagaaaagagcgccgcgatcgatggggagtatcgcctgagaggagaggcccggaaaacattcgttgaactgatgcgcagaggcgacctcccggtgtggctttcttacaaggtcgcttccgaggggtttcaatatagcgatcggcgctggtgcttcgacggcgaaagaaacaatcaggtgctggaggaaaacatggatgtcgagatctggaccaaagagggagaacggaagaaactgagaccccgctggctcgacgcccggacatactccgaccctctggctcttagagagtttaaggagttcgccgctggccgccggtctgtgagcggggatctgattctcgagatcggaaaactgccccagcacctgacccagagagcccaaaatgcgctcgacaaccttgttatgctgcataattccgaacagggcgggcgggcctatcgccacgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccattggatcgctgcgtccatcattctggaatttttccttatggtgctgctcatcccggagcctgaccggcagcgcacaccccaggataaccaactggcctacgtcgtgattgggctgctctttatgatccttacagttgctgccaatgagatgggactgctggaaaccacaaagaaagacctcggcattgggcacgtggccgtcgagaaccaccatcacgctgccatgctggatgtggaccttcatcctgcgagcgcctggacgctgtacgctgtcgccaccacaatcattacccccatgatgagacacacaatcgaaaacaccacggctaatatctctctcaccgccattgcgaaccaggccgctatcctgatgggactggataagggctggcctatttccaaaatggacatcggcgtgcccctccttgccctggggtgctatagccaggttaatccgctgacactcaccgctgccgtgctgatgcttgtcgctcattacgccattatcggacctggcctgcaagcgaaggccacacgggaggctcagaaacgcaccgccgctgggatcatgaagaaccccacggtggatggaattgttgccatcgacctcgatcccgtggtctatgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctactattgcgccggcctcaagaaagtcaccgaagttaagggctacacaaaagggggacctggccacgaggaacccatccctatggctacctacgggtggaacctggtgaagctgcattccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctatatgccttccgttgtggagacacttgagcagatgcagcgcaagcacggcggcatgctggtccggaaccccctcagcagaaattctacccatgaaatgtactgggtgtcctgcgggacaggaaacattgttagcgccgtgaatatgacctctcgcatgctgctgaaccggttcacgatggcgcacagaaaaccgacctatgagcgcgatgtcgacctcggcgccgggacaagacacgtggctgtggaacctgaggtcgccaacctggatatcattggacagcggatcgaaaatattaagcatgagcacaaatccacctggcattacgacgaggataacccctataagacatgggcttaccacggcagctatgaagttaaaccctctgggtccgccagctccatggtgaatggagtggtcaaacttctgaccaagccttgggacgtgatccccatggttacacaaatcgctatgaccgatacgacaccttttggccagcagcgcgtgttcaaagagaaggtcgacaccagaaccccgaaagccaagcggggcacagcgcaaattatggaagtgacggccaaatggctctgggggtttctgagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggaccttgttcatagagaacgggagctgcacaaacagggcaagtgcgcgacctgcgtgtacaacatgatggggaaacgcgaaaagaagctcggagagtttggcaaagctaaggggtccagagccatctggtacatgtggctgggcgcccggttcctggagttcgaagctctcggatttatgaatgaggatcactggttctctcgcgaaaacagcctgtccggcgtcgagggggagggacttcataaactgggctatattctcagagacatctctaagatccctgggggaaatatgtacgccgatgacacagctggctgggatacccggattacagaagacgatctgcagaacgaggcccgcatcaccgacattatggaacccgagcacgcgcttctggccaaaagcatctttaagctcacgtatcaaaataaagtggtcagagtgcagcggcctgctaagaacgggaccgttatggatgtgatttcccgcagagaccagcggggctctggacaggtcggcacatacgggctgaataccttcacaaacatggaagcccaactgatcagacagatggagagcgagggaatcttttcccccagcgaactcgagaccccgaacctggctgaacgcgtgcttgattggctgaagaaatatggcgtggagcggctcaagagaatggccatttctggggacgactgtgttgtgaaacctatcgatgaccgcttcgcgacggccctgacagctcttaatgatatgggaaaggtccggaaagacattccccagtgggaaccttccaagggctggaacgattggcagcaagtgcccttttgcagccatcacttccaccagctgatcatgaaggacgggagagagattgttgtgccttgtcgcaatcaggatgagctcgtcggccgggccagagtgtctcagggagctggctggtccctgcgcgaaaccgcctgcctggggaaaagctacgctcaaatgtggcagctcatgtattttcatcggagagacctgcgccttgccgcgaacgccatctgttccgctgtccccgtggattggattccgacatctcggaccacgtggagcatccacgcccatcaccagtggatgaccacagaggacatgctgtccgtttggaatagagtgtggatcgaagagaacccttggatggaagataagacccatattagctcttggggagacgtcccctacctcggcaaacgggaggaccaatggtgcgggtccctgatcggacttacagccagagctacctgggccacaaatattcaggtggcgatcaaccaggttcgccggctgattggcaatgagaactacctcgattatatgaccagcatgaagagattcaaaaatgaatctgaccccgagggggctctgtggtga

SEQ ID NO: 19306 - RNA, 9879 nt, synthetic construct
  misc_feature 1..9879: note = derived and/or modified CDS sequence (opt5) from DENV-1__EU482497__SS-prME
  source 1..9879: mol_type = other RNA
agcgtgaccatgctgctcatgctgatgcccacagcccttgctttccacctgacgaccagaggaggggagcctcatatgatcgtctccaagcaggaacggggaaaatctctcctgtttaagacaagcgccggagttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaaggaacctggaatcgccaggacctgctcgtgaccttcaaaacagctcacgcgaagaagcaggaggtcgtggttctgggcagccaagaaggggccatgcacacggctctgaccggagccacagagattcagacctccggcacaaccacgatctttgccgggcatctcaaatgcagactgaagatggataaacttacactgaagggcatgagctatgtgatgtgtaccggatctttcaaactcgaaaaggaggtcgctgaaacccagcacggcacagtgctggttcagattaagtacgaggggaccgacgccccgtgcaaaatccctttctccacacaagatgagaagggagtgacgcagaacggccggctgatcaccgcgaatcccattgtcacagacaaagaaaagcctgtgaacatcgaggctgaaccgccctttggggagagctatattgtgatcggagccggcgagaaagcccttaagctctcttggttcaagaaagggagctccattggcaagatgtttgaagctaccgccagaggagctcgccggatggccatcctgggcgatacagcgtgggacttcgggtctatcggaggcgtttttaccagcgtcgggaaactggtgcatcagattttcggaacggcctacggcgtgctcttttccggggtcagctggaccatgaagatcggcattggagtgctgcttacatggctgggcctcaattctagatccaccagcctgtctatgacatgtatcgctgttgggctggtgaccctttacctcggagtcatggtgcaggccgattccggctgcgttattaactggaaagggcgcgagctgaagtgtggaagcggcatcttcgtgacaaatgaagtccacacctggacggagcaatataagtttcaggctgactcccctaaacggctgtctgccgcgattgggaaggcctgggaagagggcgtgtgcggaatcagaagcgctacacgcctcgagaacatcatgtggaaacagatttccaacgaactgaatcatatccttctggagaacgacatgaagttcaccgttgtggtcggcgatgtggccgggattctcgctcagggcaagaagatgatccggccgcaacccatggaatacaaatattcttggaaaagctggggcaaggccaagattatcggggccgacgtgcagaataccacatttatcattgatggacctaacacccccgagtgtcctgacgatcagagagcttggaatatctgggaagtcgaggactacggcttcggcatttttacgacaaacatctggctgaagctgcgcgattcctatacccaggtttgcgaccaccggcttatgagcgcggccattaaagattctaaggctgtgcacgccgacatggggtactggatcgagtccgagaaaaatgagacatggaagctcgccagagctagcttcatcgaagtgaagacctgtatttggcccaaatctcatacactgtggtccaacggagtcctggagagcgaaatgatcattccgaagatctatggcgggcctatttctcaacacaattaccgccccggatacttcacccagacggccggcccttggcatctcgggaaactggagcttgattttgacctgtgcgagggaaccacagtggttgtggatgaacactgcggcaaccggggccccagcctcagaaccacaaccgtcacggggaagatcatccacgagtggtgttgccggtcctgtacactgcctcccctgcgcttcagaggagaagacggctgctggtatgggatggagattcggccggtgaaagagaaggaagagaatcttgttaagagcatggtgtctgcgggatccggcgaagtcgacagcttttccctcgggctgctgtgtatctctattatgatcgaggaagtgatgagaagccgctggtcccggaaaatgctcatgaccggaacactggctgttttctttcttctgattatgggccagctcacctggaacgatctgatcagactgtgcattatggtgggcgccaatgcctctgaccgcatggggatgggaaccacataccttgctctgatggccacgttcaagatgagacctatgtttgcggtcggcctcctgttccggcgcctcaccagcagagaggtgctgcttctgacaatcgggctctccctggtggcttctgtcgagctgcccaacagccttgaagaactgggagatggcctcgccatggggatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttggaagcctgggctgcaagccgctgacgatgtttctcatcgctgaaaataaaatttggggccggcgctcttggcccctgaacgaggggatcatggccgtcggaatcgtgtccattcttctgagctccctcctgaagaacgatgttcctctcgcgggccccctgatcgccgggggaatgcttattgcttgttacgtgatcagcggctctagcgccgacctgtccctggaaaaagctgccgaggtctcttgggaggaagaggccgaacatagcggggcttcccacaatattctcgtggaggttcaggatgacggaaccatgaagatcaaagatgaagagagagacgatacactgaccatccttctgaaggcgacactcctggccgtgtctggcgtctatcctctcagcattcccgctaccctgttcgtgtggtacttctggcagaaaaagaagcagcggtccggcgtcctttgggacacgccttctcccccggaggtggaacgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgctatagccaggtgaatccgctgacactcaccgctgccgtcctgatgcttgtggctcattacgccatcattggccctgggctgcaagcgaaggccacacgggaagctcagaaacgcaccgccgctggaatcatgaagaaccccacggttgatggcatcgtggccattgacctcgatcccgtcgtgtatgacgccaagttcgagaaacagctggggcagatcatgctgctcattctttgtacatctcaaatcctgctgatgagaaccacatgggcgctctgcgaaagcattaccctggctaccggacctcttacaacgctgtgggagggctccccgggcaagttttggaataccacaatcgccgtgtctatggctaacatcttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcatcgatctgggctgtgggagaggaggctggagctactattgcgccggcctcaagaaagttaccgaggtgaaggggtacacaaaaggaggccctgggcacgaggagcccattcctatggctacctacggatggaacctggtgaagctgcattccggcaaagacgtctttttcattccccctgaaaagtgtgatacactcctttgcgacattggggagtctagcccgaatcccacgatcgaggaaggacgcaccctgcgggtgctgaaaatggttgagccttggctcagaggcaaccaattttgtattaagatcctgaatccctatatgccttccgtggtcgaaacacttgagcagatgcagcgcaagcacggcgggatgctggtgcggaaccccctcagcagaaattctacccatgagatgtactgggtttcctgcggaacaggcaacatcgtgagcgccgtcaatatgacctctcgcatgctgctgaaccggttcacgatggcgcacagaaaaccgacctatgaacgcgatgtggacctcggggccggaacaagacacgtggctgtcgagcctgaagttgccaacctggatattatcggccagcggattgagaatatcaagcatgaacacaaatccacctggcattacgacgaggataacccctataagacatgggcttaccacgggagctatgaggtgaaaccctctggatccgccagctccatggtgaatggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgagcagaaacaagaagccccggatttgtacccgcgaagagttcacaagaaaagtgcggtctaatgctgccatcggcgctgtctttgtggacgaaaaccagtggaatagcgccaaggaggccgttgaggatgaacgcttctgggaccttgtgcatagagagcgggaactgcacaaacaggggaagtgcgcgacctgcgtctacaacatgatgggaaaacgcgagaagaagctcggcgaatttgggaaagctaagggctccagagccatttggtacatgtggctgggagcccggttcctggagttcgaggctctcggctttatgaatgaagatcactggttctctcgcgagaacagcctgtccggggtggaaggagagggccttcataaactggggtatatcctcagagacatttctaagatccctggaggcaatatgtacgccgatgacacagctgggtgggatacccggatcacagaggacgatctgcagaacgaagcccgcattaccgacacgatggagcccgaacacgcgcttctggccagaagcatctttaaactcacctatcaaaataaggtcgtgcgggttcagcgccctgctaaaaacggcacagtgatggatgtcatttccagacgggaccagagaggatctggccaggtggggacctacggactgaatacattcaccaacatggaggcccaactgatccgccagatggaaagcgagggcatcttttcccccagcgagctcgaaacgccgaacctggctgagcgggtgcttgattggctggaaaagtatggggttgagagactcaagcgcatggccatctctggagacgactgtgtggtcaaacctatcgatgaccggttcgcgacagccctgaccgctcttaatgatatgggcaaggtgagaaaagacattccccagtgggaaccttccaaggggtggaacgattggcagcaagttcccttttgcagccatcacttccaccagctgatcatgaaagacggccgcgagattgtggtcccttgtcggaatcaggatgagctcgtgggcagagcccgcgtctctcagggcgctgggtggtccctgcgggaaacagcctgcctgggaaagagctacgctcaaatgtggcagctcatgtattttcatagacgcgacctgcggcttgccgcgaacgccatctgttccgctgtgcccgttgattggattccgacctctagaacgacctggagcatccacgcccatcaccagtggatgacaaccgaggacatgctgtccgtgtggaatcgggtctggattgaagagaacccttggatggaagataagacacatatcagctcttggggcgacgtgccctacctcgggaaaagagaggaccaatggtgcggatccctgatcggccttaccgcccgcgctacatgggccaccaatattcaggttgcgatcaaccaggtgcggagactgattgggaatgagaactacctcgattatatgacgagcatgaagcgcttcaaaaatgaatctgaccccgagggcgctctgtggtga

SEQ ID NO: 19307 - RNA, 9879 nt, synthetic construct
  misc_feature 1..9879: note = derived and/or modified CDS sequence (opt5) from DENV-1__EU482499__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcaccgatttccctggcaaaacagtctggtttgttcccagcattaagtccgggaatgacatcgctaactgtctccgcaaaaatggaaagagagtgattcagctttctcggaagaccttcgatacggaatatcagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccataataaagagggggatcagtacatctatatgggacagcccctgaacaatgacgaggatcacgcccactggacggaagccaagatgcttctggacaacattaatacccctgagggcatcattcccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatctggaccaaagagggagaacggaagaaactgagaccccgctggctcgacgcccggacatattccgaccctctggctcttagagagtttaaggagttcgccgctggccgccggtctgtgagcggggatctgattctcgagatcggaaaactgccccagcatctgacccagagagcccaaaatgcgctcgacaaccttgttatgctgcacaattccgaacagggcgggcgggcctaccgccatgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccactggatcgctgcgtccatcattctggaatttttccttatggtgctgctcatcccggagcctgaccggcagcgcacaccccaggataaccaactggcctatgtcgtgattgggctgctctttatgatccttacagttgctgccaatgagatgggactgctggaaaccacaaagaaagacctcggcattgggcacgtggccgtcgagaaccatcaccatgctgccatgctggatgtggaccttcaccctgcgagcgcctggacgctgtacgctgtcgccaccacaatcattacccccatgatgagacatacaatcgaaaacaccacggctaatatctctctcaccgccattgcgaaccaggccgctatcctgatgggactggataagggctggcctatttccaaaatggacatcggcgtgcccctccttgccctggggtgctacagccaggttaatccgctgacactcaccgctgccgtgctgatgcttgtcgctcactatgccattatcggacctggcctgcaagcgaaggccacacgggaggctcagaaacgcaccgccgctgggatcatgaagaaccccacggtggatggaattgttgccatcgacctcgatcccgtggtctacgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctattactgcgccggcctcaagaaagtcaccgaagttaagggctatacaaaagggggacctggccatgaggaacccatccctatggctacctacgggtggaacctggtgaagctgcactccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctacatgccttccgttgtggagacacttgagcagatgcagcgcaagcatggcggcatgctggtccggaaccccctcagcagaaattctacccacgaaatgtattgggtgtcctgcgggacaggaaacattgttagcgccgtgaatatgacctctcgcatgctgctgaaccggttcacgatggcgcacagaaaaccgacctacgagcgcgatgtcgacctcggcgccgggacaagacatgtggctgtggaacctgaggtcgccaacctggatatcattggacagcggatcgaaaatattaagcacgagcataaatccacctggcactatgacgaggataacccctacaagacatgggcttatcatggcagctacgaagttaaaccctctgggtccgccagctccatggtgaatggagtggtcaaacttctgaccaagccttgggacgtgatccccatggttacacaaatcgctatgaccgatacgacaccttttggccagcagcgcgtgttcaaagagaaggtcgacaccagaaccccgaaagccaagcggggcacagcgcaaattatggaagtgacggccaaatggctctgggggtttctgagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggaccttgttcacagagaacgggagctgcacaaacagggcaagtgcgcgacctgcgtgtataacatgatggggaaacgcgaaaagaagctcggagagtttggcaaagctaaggggtccagagccatctggtacatgtggctgggcgcccggttcctggagttcgaagctctcggatttatgaatgaggatcattggttctctcgcgaaaacagcctgtccggcgtcgagggggagggacttcacaaactgggctacattctcagagacatctctaagatccctgggggaaatatgtatgccgatgacacagctggctgggatacccggattacagaagacgatctgcagaacgaggcccgcatcaccgacattatggaacccgagcatgcgcttctggccaaaagcatctttaagctcacgtaccaaaataaagtggtcagagtgcagcggcctgctaagaacgggaccgttatggatgtgatttcccgcagagaccagcggggctctggacaggtcggcacatatgggctgaataccttcacaaacatggaagcccaactgatcagacagatggagagcgagggaatcttttcccccagcgaactcgagaccccgaacctggctgaacgcgtgcttgattggctgaagaaatacggcgtggagcggctcaagagaatggccatttctggggacgactgtgttgtgaaacctatcgatgaccgcttcgcgacggccctgacagctcttaatgatatgggaaaggtccggaaagacattccccagtgggaaccttccaagggctggaacgattggcagcaagtgcccttttgcagccaccacttccatcagctgatcatgaaggacgggagagagattgttgtgccttgtcgcaatcaggatgagctcgtcggccgggccagagtgtctcagggagctggctggtccctgcgcgaaaccgcctgcctggggaaaagctatgctcaaatgtggcagctcatgtactttcaccggagagacctgcgccttgccgcgaacgccatctgttccgctgtccccgtggattggattccgacatctcggaccacgtggagcatccatgcccaccatcagtggatgaccacagaggacatgctgtccgtttggaatagagtgtggatcgaagagaacccttggatggaagataagacccacattagctcttgggaggacgtcccctatctcggaaaacgggaggaccaatggtgcggctccctgatcgggcttacagccagagctacctgggccacaaatattcaggtggcgatcaaccaggttcgccggctgattggaaatgaaaactacctcgattacatgaccagcatgaagagattcaaaaatgagggcgaccccgaaggggctctgtggtga

SEQ ID NO: 19308 - RNA, 9879 nt, synthetic construct
  misc_feature 1..9879: note = derived and/or modified CDS sequence (opt5) from DENV-1__EU482500__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcaccgatttccctggcaaaacagtctggtttgttcccagcattaagtccgggaatgacatcgctaactgtctccgcaaaaatggaaagagagtgattcagctttctcggaagaccttcgatacggaatatcagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccataataaagagggggatcagtacatctatatgggacagcccctgaacaatgacgaggatcacgcccactggacggaagccaagatgcttctggacaacattaatacccctgagggcatcattcccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatctggaccaaagagggagaacggaagaaactgagaccccgctggctcgacgcccggacatattccgaccctctggctcttagagagtttaaggagttcgccgctggccgccggtctgtgagcggggatctgattctcgagatcggaaaactgccccagcatctgacccagagagcccaaaatgcgctcgacaaccttgttatgctgcacaattccgaacagggcgggcgggcctaccgccatgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccactggatcgctgcgtccatcattctggaatttttccttatggtgctgctcatcccggagcctgaccggcagcgcacaccccaggataaccaactggcctatgtcgtgattgggctgctctttatgatccttacagttgctgccaatgagatgggactgctggaaaccacaaagaaagacctcggcattgggcacgtggccgtcgagaaccatcaccatgctgccatgctggatgtggaccttcaccctgcgagcgcctggacgctgtacgctgtcgccaccacaatcattacccccatgatgagacatacaatcgaaaacaccacggctaatatctctctcaccgccattgcgaaccaggccgctatcctgatgggactggataagggctggcctatttccaaaatggacatcggcgtgcccctccttgccctggggtgctacagccaggttaatccgctgacactcaccgctgccgtgctgatgcttgtcgctcactatgccattatcggacctggcctgcaagcgaaggccacacgggaggctcagaaacgcaccgccgctgggatcatgaagaaccccacggtggatggaattgttgccatcgacctcgatcccgtggtctacgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctattactgcgccggcctcaagaaagtcaccgaagttaagggctatacaaaagggggacctggccatgaggaacccatccctatggctacctacgggtggaacctggtgaagctgcactccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctacatgccttccgttgtggagacacttgagcagatgcagcgcaagcatggcggcatgctggtccggaaccccctcagcagaaattctacccacgaaatgtattgggtgtcctgcgggacaggaaacattgttagcgccgtgaatatgacctctcgcatgctgctgaaccggttcacgatggcgcacagaaaaccgacctacgagcgcgatgtcgacctcggcgccgggacaagacatgtggctgtggaacctgagatcgccaacctggatattatcggacagcggattgaaaatatcaagcacgagcataaatccacctggcactatgacgaggataacccctacaagacatgggcttatcatggcagctacgaagtcaaaccctctgggtccgccagctccatggttaatggagtggtgaaacttctgaccaagccttgggacgtcatccccatggtgacacaaattgctatgaccgatacgacaccttttggccagcagcgcgttttcaaagagaaggtggacaccagaaccccgaaagccaagcggggcacagcgcaaatcatggaagtcacggccaaatggctctgggggtttctgagcagaaacaagaagccccggatttgtacccgcgaggagttcacaagaaaagtgcggtctaatgctgccatcggagctgtttttgtggacgagaaccagtggaatagcgccaaggaggccgtcgaagatgagcgcttctgggaccttgtgcacagagaacgggagctgcacaaacagggcaagtgcgcgacctgcgtttataacatgatggggaaacgcgaaaagaagctcggagagtttggcaaagctaaggggtccagagccatttggtacatgtggctgggcgcccggttcctggagttcgaagctctcggatttatgaatgaggatcattggttctctcgcgaaaacagcctgtccggcgtggagggggagggacttcacaaactgggctacatcctcagagacatctctaagattcctgggggaaatatgtatgccgatgacacagctggctgggatacccggatcacagaagacgatctgcagaacgaggcccgcattaccgacatcatggaagcggagcatgcccttctggctaaaagcatttttaagctcacgtaccaaaataaagtcgtgagagtccagcggcccgccaagaacgggaccgtgatggatgttatctcccgcagagaccagcggggctctggacaggtgggcacatatgggctgaataccttcacaaacatggaagctcaactgatcagacagatggagagcgagggaatcttttcccctagcgaactcgagacccccaacctggccgaacgcgtccttgattggctggagaagtacggcgtggaacggctcaaaagaatggcgatctctggggacgactgtgtggttaagccgattgatgaccgcttcgccacggctctgacagcccttaatgatatgggaaaagtgcggaaggacatccctcagtgggagccctccaaaggctggaacgattggcagcaagtccctttttgcagccaccacttccatcagctgattatgaaggacgggagagagatcgtggttccctgtcgcaatcaggatgaactcgtgggccgggctagagtctctcagggagccggctggtccctgcgcgagaccgcttgcctgggaaagagctatgcccaaatgtggcagctcatgtactttcaccggagagacctgcgccttgcggccaacgctatttgttccgccgtgcctgtcgattggatccccacatctcggaccacgtggagcatccatgcccaccatcagtggatgaccacagaagacatgctgtccgtgtggaatagagtttggattgaggaaaacccgtggatggaggataaaacccacatcagctcttggggagacgtgccttatctcggcaagcgggaggaccaatggtgcgggtccctgattggacttacagctagagccacctgggcgacaaatatccaggtcgctattaaccaggtgcgccggctgatcggcaatgaaaactacctcgattacatgaccagcatgaaaagattcaagaatgagggggaccccgaaggcgccctgtggtga

SEQ ID NO: 19309 - RNA, 9879 nt, synthetic construct
  misc_feature 1..9879: note = derived and/or modified CDS sequence (opt5) from DENV-1__EU482501__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgctatagccaggtgaatccgctgacactcaccgctgccgtcctgatgcttgtggctcattacgccatcattggccctgggctgcaagcgaaggccacacgggaagctcagaaacgcaccgccgctggaatcatgaagaaccccacggttgatggcatcgtggccattgacctcgatcccgtcgtgtatgacgccaagttcgagaaacagctggggcagatcatgctgctcattctttgtacatctcaaatcctgctgatgagaaccacatgggcgctctgcgaaagcattaccctggctaccggacctcttacaacgctgtgggagggctccccgggcaagttttggaataccacaatcgccgtgtctatggctaacatcttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcatcgatctgggctgtgggagaggaggctggagctactattgcgccggcctcaagaaagttaccgaggtgaaggggtacacaaaaggaggccctgggcacgaggagcccattcctatggctacctacggatggaacctggtgaagctgcattccggcaaagacgtctttttcattccccctgaaaagtgtgatacactcctttgcgacattggggagtctagcccgaatcccacgatcgaggaaggacgcaccctgcgggtgctgaaaatggttgagccttggctcagaggcaaccaattttgtattaagatcctgaatccctatatgccttccgtggtcgaaacacttgagcagatgcagcgcaagcacggcgggatgctggtgcggaaccccctcagcagaaattctacccatgagatgtactgggtttcctgcggaacaggcaacatcgtgagcgccgtcaatatgacctctcgcatgctgctgaaccggttcacgatggcgcacagaaaaccgacctatgaacgcgatgtggacctcggggccggaacaagacacgtggctgtcgagcctgaagttgccaacctggatattatcggccagcggattgagaatatcaagcatgaacacaaatccacctggcattacgacgaggataacccctataagacatgggcttaccacgggagctatgaggtgaaaccctctggatccgccagctccatggtgaatggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgagcagaaacaagaagccccggatttgtacccgcgaagagttcacaagaaaagtgcggtctaatgctgccatcggcgctgtctttgtggacgaaaaccagtggaatagcgccaaggaggccgttgaggatgaacgcttctgggaccttgtgcatagagagcgggaactgcacaaacaggggaagtgcgcgacctgcgtctacaacatgatgggaaaacgcgagaagaagctcggcgaatttgggaaagctaagggctccagagccatttggtacatgtggctgggagcccggttcctggagttcgaggctctcggctttatgaatgaagatcactggttctctcgcgagaacagcctgtccggggtggaaggagagggccttcataaactggggtatatcctcagagacatttctaagatccctggaggcaatatgtacgccgatgacacagctgggtgggatacccggatcacagaggacgatctgcagaacgaagcccgcattaccgacatcatggagcccgaacacgcgcttctggccaaaagcatttttaagctcacgtatcaaaataaagtcgtgagagttcagcggcctgctaagaacggcaccgtgatggatgtcatctcccgcagagaccagcggggatctggccaggtggggacatacggactgaataccttcacaaacatggaggcccaactgattagacagatggaaagcgagggcatcttttcccccagcgagctcgaaaccccgaacctggctgagcgcgtgcttgattggctggaaaagtatggggttgagcggctcaaaagaatggccatctctggagacgactgtgtggtcaagcctattgatgaccgcttcgcgacggccctgacagctcttaatgatatgggcaaagtgcggaaggacatcccccagtgggaaccttccaaagggtggaacgattggcagcaagttcccttttgcagccatcacttccaccagctgattatgaaggacggcagagagatcgtggtcccttgtcgcaatcaggatgagctcgtgggacgggccagagtctctcagggcgctgggtggtccctgcgcgaaaccgcctgcctgggaaagagctacgctcaaatgtggcagctcatgtattttcatcggagagacctgcgccttgccgcgaacgccatttgttccgctgtgcccgttgattggatcccgacatctcggaccacgtggagcattcacgcccatcaccagtggatgaccacagaggacatgctgtccgtgtggaatagagtctggatcgaagagaacccttggatggaagataaaacccatatcagctcttggggcgacgtgccctacctcgggaagcgggaggaccaatggtgcggatccctgattggccttacagccagagctacctgggccacaaatatccaggttgcgattaaccaggtgcgccggctgatcgggaatgagaactacctcgattatatgaccagcatgaaaagattcaagaatgaatctgaccccgagggcgctctgtggtga

SEQ ID NO: 19310 - RNA, 9879 nt, synthetic construct
  misc_feature 1..9879: note = derived and/or modified CDS sequence (opt5) from DENV-1__EU482504__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttatcgccatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggttacactgctcagcctgaccttcatcaagacgacattttctctgcactatgcctggaaaaccatggctatggtgctttccattgtgagcctgttccccctctgtctgtctaccacatcccagaagaccacatggctccctgtcctgcttgggagcctgggatgcaagccgctgacgatgtttctcatcgccgagaataaaatttggggccggcgctcttggcccctgaacgaaggcatcatggctgtggggatcgtttccattcttctgagctccctcctgaagaacgatgtgcctctcgccggacccctgatcgcgggcgggatgcttattgcctgttacgtcatcagcggatctagcgctgacctgtccctggagaaagccgctgaggtgtcttgggaagaggaagccgagcatagcggcgcctcccacaatattctcgttgaagtgcaggatgacgggaccatgaagatcaaagatgaggagagagacgatacactgaccatccttctgaaggctacactcctggcggtctctggagtgtatcctctcagcattcccgccaccctgttcgtctggtacttctggcagaaaaagaagcagcggtccggcgtgctttgggacacgccttctcccccggaagttgagcgcgctgtgctggatgacggcatctatagaattatgcagcgggggctgctcggacgcagccaggtcggcgtgggggtttttcaagaaaacgtgttccataccatgtggcacgtcacaagaggagccgtgctgatgtaccagggcaaacggcttgagccttcctgggccagcgtgaagaaagacctgatctcttacgggggaggctggagactccagggctcctggaataccggggaggaagttcaggtcattgctgtggagcccggaaagaaccctaaaaatgtgcaaacagcccccggcacctttaagacaccggaaggggaggtcggagcgatcgctctggatttcaagcctggcacgagcgggtctcccattgtgaaccgcgaaggaaaaatcgttggcctctatggcaatggggtggtcaccacatccggaacctacgtgagcgccatcgcccaggctaaggcctcccaggagggccctctgcccgagattgaagacgaggtttttcggaaaagaaaccttaccatcatggatctgcaccccgggtctggaaagacacgccggtatctgcctgcgattgtgagagaagctatcaaacgcaagctccggacgctgattcttgccccgaccagagtcgtggccagcgagatggctgaagccctgaagggcatgcccatccgctaccaaacaaccgctgttaaatccgagcatacagggaaggagatcgtggacctcatgtgccacgccaccttcacgatgcggctgctgagccctgtcagagtgcccaattataacatgattatcatggatgaagcgcattttacagacccttcttccattgccgctcggggctacatcagcacccgcgtgggaatgggcgaggccgctgccattttcatgaccgccacaccccctgggtctgtcgaggcttttccgcagagcaatgcggttatccaggatgaggaaagagacatccccgagcggtcctggaactctggatatgagtggattaccgatttccctggcaaaacagtgtggtttgtgcccagcatcaagtccgggaatgacattgccaactgtctccgcaaaaatggaaagagagtcatccagctttctcggaagaccttcgatacggaataccagaaaaccaagaacaacgactgggactacgtggttaccacagatattagcgagatgggcgctaatttcagagccgaccgcgtgatcgatcctcggagatgcctgaaacccgtcattctgaaggacgggccggaacgcgtgatcctcgccggccctatgcccgttaccgtggcttccgccgcgcagcggagaggacgcatcggccggaaccacaataaagagggggatcagtatatttacatgggacagcccctgaacaatgacgaggatcatgctcactggacggaagccaagatgcttctggacaacatcaatacccctgagggcattatccccgccctctttgaacctgagagagaaaagagcgctgccattgatggggagtatcgcctgagaggagaggcgcggaaaacattcgtcgaactgatgcgcagaggcgacctcccggtgtggctttcttacaaggtcgcctccgaggggtttcaatatagcgatcggcgctggtgcttcgacggcgaaagaaacaatcaggtgctggaggaaaacatggatgttgagatctggaccaaagagggagaacggaagaaactgagaccccgctggctcgacgctcggacatactccgaccctctggcccttagagagtttaaggagttcgctgccggccgccggtctgtgagcggggatctgatctccgagattggaaaactcccccagcacctgacccagagagctcaaaatgccctggacaacctcgtgatgcttcataattctgaacagggcgggcgggcgtatcgccacgccatggaggagctgcctgatacaatcgaaaccctgatgctcctggctcttattgccgtcctgacgggaggcgttacactctttttcctgagcggcagagggctgggaaagacctccatcggcctcctttgtgtgatggctagctctgtgctgctgtggatggcctccgtcgagccccattggattgccgctagcatcatcctcgaatttttcctgatggtgcttctgattccggagcctgaccggcagcgcacaccccaggataaccaactcgcgtacgttgtgatcgggctgctgtttatgattctcacagtcgccgctaatgagatgggacttctggaaaccacaaagaaagacctgggcatcgggcacgtggccgtcgagaaccaccatcacgccgctatgctcgatgtggacctgcatcctgcctctgcgtggacgctttacgccgttgctaccacaattatcacccccatgatgagacacacaattgaaaacaccacggccaatatctccctgaccgctatcgccaaccaggcggccattctcatgggactggataagggctggcctatcagcaaaatggacattggcgtgcccctgctcgctcttgggtgctattctcaggtcaatccgctgacactgaccgccgctgtgctcatgctggttgcccattacgctatcattggacctggccttcaagccaaggcgacacgggaggcccagaaacgcaccgctgccgggatcatgaagaaccccacggtggatggaatcgtcgctattgacctggatcccgtggtgtatgacgccaagttcgaaaaacagctcggccagatcatgctgctgattctctgtacaagccaaatccttctgatgagaaccacatgggccctgtgcgagtccattaccctcgcgaccgggcctctgacaacgctttgggagggatctccgggcaagttttggaataccacaatcgctgttagcatggccaacatcttccggggctcctacctggctggggccggactcgccttcagcctgatgaaatccctgggcgggggacgcagaggcaccggggctcagggagaaacactcggcgagaagtggaaacggcagcttaatcagctgtctaagagcgaatttaacacctataagagatccggcattatggaggtcgaccgctctgaagccaaagaggggctgaagcggggagagacgacaaaacacgcggtgagcagaggcaccgccaagctccgctggttcgtggaacggaatctggtcaaacccgaggggaaggttatcgatcttggatgtggcagagggggatggtcctactattgcgctggcctgaagaaagtgaccgaagtgaagggctacacaaaagggggacctggccacgaggaacccattcctatggccacctacgggtggaacctcgtcaagctgcattctggaaaagacgtgtttttcattccccctgagaagtgtgatacactgctctgcgacattggcgagagctccccgaatcccacgatcgaagaggggcgcacccttcgggttctgaaaatggtggaaccttggctgagaggaaaccaattttgtattaagatcctcaatccctatatgcctagcgtcgtggagacactggagcagatgcagcgcaagcacggcggcatgcttgttcggaaccccctgtctagaaattccacccatgaaatgtactgggtgagctgcgggacaggaaacatcgtctctgctgtgaatatgacctcccgcatgctcctgaaccggttcacgatggcccacagaaaaccgacctatgagcgcgatgtggacctgggcgcggggacaagacacgtcgccgttgaacctgaggtggctaacctcgatattatcggacagcggattgaaaatatcaagcatgagcacaaaagcacctggcattacgacgaggataacccctataagacatgggcctaccacggctcttatgaagtgaaaccctccgggagcgcttccagcatggtcaatggagtggttaagctgcttaccaagccttgggacgtgattcccatggtcacacaaatcgccatgaccgatacgacaccttttggccagcagcgcgtgttcaaagagaaggttgacaccagaaccccgaaagctaagcggggcacagcccaaatcatggaagtgacggcgaaatggctgtgggggtttctctctagaaacaagaagccccggatttgtacccgcgaggagttcacaagaaaagtccggagcaatgccgctatcggagccgtgtttgttgacgagaaccagtggaactccgctaaggaggccgtggaagatgagcgcttctgggacctggtccatagagaacgggagcttcacaaacagggcaagtgcgcgacctgcgtgtacaacatgatggggaaacgcgaaaagaagctgggagagtttggcaaagcgaaggggtctagagctatttggtacatgtggctcggcgcccggttcctggagttcgaagccctgggatttatgaatgaggatcactggttcagccgcgaaaactccctctctggcgtcgagggggagggactgcataaacttggctatatcctgagagacattagcaagatccctgggggaaatatgtacgctgatgacacagccggctgggatacccggatcacagaagacgatctccagaacgaggctcgcattaccgacatcatggaacccgagcacgccctgcttgcgaaatccatttttaagctgacgtatcaaaataaagtggttagagtgcagcggcctgccaagaacgggaccgtcatggatgtgatctctcgcagagaccagcggggcagcggacaggtgggcacatacgggctcaataccttcacaaacatggaagctcaactgattagacagatggagtccgagggaatctttagcccctctgaactggagaccccgaacctcgccgaacgcgttctggattggcttgagaagtatggcatcgaacggctgaaaagaatggctatttccggggacgactgtgtggtcaagcctatcgatgaccgcttcgccacggcgctcacagccctgaatgatatgggaaaagtgcggaaggacattccccagtgggagcctagcaaaggctggaacgattggcagcaagttcccttttgctctcatcacttccaccagcttatcatgaaggacgggagagagattgtggtcccttgtcgcaatcaggatgaactggtgggccgggctagagtctcccagggagccggctggagcctccgcgagaccgcttgcctggggaagtcctacgcccaaatgtggcagctgatgtattttcatcggagagacctccgcctggctgccaacgcgatctgttctgccgtgcccgttgattggattccgacaagccggaccacgtggtccatccacgctcatcaccagtggatgaccacagaagacatgcttagcgtgtggaatagagtctggatcgaggaaaacccttggatggaggataaaacccatatttcttcctggggagacgtgccctacctgggcaagcgggaggaccaatggtgcgggagcctcatcggactgacagccagagccacctgggctacaaatattcaggttgccatcaaccaggtgcgccggcttattggcaatgaaaactacctggattatatgacctctatgaaaagattcaagaatgagagcgaccccgaaggggcgctctggtga

SEQ ID NO: 19311 - RNA, 9879 nt, synthetic construct
  misc_feature 1..9879: note = derived and/or modified CDS sequence (opt5) from DENV-1__EU482505__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaggcttggcttgtccataagcagtggttcctggatctccctctgccctggacaagcggggcgtccacctctcaagagacatggaatcgcaaagaccttctggtgacctttaagaccgcccacgctaagaaacaggaagtcgtggttctcggaagccaggagggcgccatgcacacagccctgacgggggctaccgaaatccaaacatccggaaccacaaccattttcgccggccatctgaagtgcagactcaaaatggataagctgacgcttaaagggatgagctatgtgatgtgtacaggctctttcaagctggagaaggaagtcgcggagacccagcacggaaccgtgctcgttcagatcaaatacgagggcacagacgctccgtgcaagattcctttttccacccaggatgaaaaaggggtgacacaaaacggacggctgatcacggccaatcccatcgtcaccgacaaggagaaacctgtgaacattgaagccgagccgcccttcggcgagagctatatcgtgattggggctggagaaaaggccctgaaactttcttggtttaaaaagggcagctccatcgggaaaatgttcgaggctacagccagaggcgcgcgccggatggccattctcggagataccgcttgggactttggctctatcgggggagttttcacaagcgtcggcaagctggtgcatcagatctttgggaccgcctacggagtgctgttctccggcgtcagctggacgatgaaaattgggatcggcgtgctcctgacctggcttggactcaattctagatccacaagcctctctatgacctgtattgctgttggcctggtgacactgtaccttggggtcatggtgcaggccgattccggatgcgttatcaactggaagggccgcgaactcaagtgtgggagcggaatttttgtgaccaatgaggtccacacatggaccgaacagtataaattccaagcggactcccctaagcggctgtctgccgctatcggcaaagcctgggaggagggggtgtgcggcattagaagcgctacgcgcctggaaaacatcatgtggaagcagatctccaacgagctcaatcatattctgcttgaaaacgacatgaaatttacagttgtggtcggagatgtggccggcatcctggcccaggggaagaaaatgattcggccgcagcccatggagcacaagtactcttggaaaagctggggaaaggctaagatcattggcgcggacgtgcaaaatgccaccttcatcatcgatgggcctaacacccccgaatgtcctgacgatcagagagcttggaatatttgggaggtcgaggactatggatttggcatcttcacaaccaacatttggctcaaactgcgcgattcctacacgcaggtttgcgaccaccggctgatgagcgccgccatcaaggattctaaagctgtgcatgccgacatgggctattggattgaatccgagaagaatgaaacatggaaacttgcgagagctagcttcatcgaggtgaaaacctgtatctggcccaagtctcacacactctggtccaacggggtcctggaaagcgagatgattatcccgaaaatttacggaggccctatctctcagcataattatcgccccgggtactttacccaaacagccggaccttggcacctgggcaagctcgagctggatttcgacctttgcgaagggaccacggtggttgtggatgagcactgcggaaaccggggccccagcctgagaaccacaaccgtcacaggcaaaattatccatgaatggtgttgccggtcctgtaccctccctcccctgcgctttaagggggaggacggatgctggtacggcatggagatcagaccggtgaaggaaaaagaggaaaatctggttaagagcatggtgtctgccgggtccggagaggtcgacagcttctcccttggcctcctgtgtatttctatcatgattgaagaggtgatgcggagcagatggtcccgcaaaatgctgatgacggggacactcgctgtctttttcctgcttatcatgggacagctgacctggaacgatctcattcggctgtgcatcatggtgggcgccaatgcgtctgacagaatgggcatggggacaacctatctggctcttatggccacctttaagatgcgccctatgttcgccgtcggactgctctttagacggctgacaagccgcgaggtgctcctgcttacgattggcctgtccctcgtggcttctgtcgaactgcccaacagcctggaggaacttggggatggactggccatgggcatcatgatcctcaaactgctcaccgacttccagtcccaccaactgtgggctacacttctgagcctcacctttattaagacaaccttctctctgcattacgcctggaagacgatggcgatggttctgtccatcgtgagcctttttcccctgtgtctctctacaacctcccagaaaaccacatggctgcctgtgctcctggggagccttggatgcaagccgctgaccatgttcctgattgccgagaataaaatctggggcagaaagtcttggcccctcaacgaaggcattatggctgtcgggatcgtgtccatcctgcttagctccctgctcaaaaacgatgttcctctggccggacccctcattgctggcgggatgctgatcgcctgttatgtgattagcggatctagcgccgacctttccctggagaaggctgcggaggtctcttgggaagaggaagccgagcacagcggcgcttcccataatatcctggtggaagttcaggatgacgggacaatgaaaattaaggatgaggagcgggacgatacgctcaccatcctgcttaaggccacactgctcgccgtgtctggagtctaccctctgagcatccccgctaccctcttcgtgtggtatttttggcagaaaaagaaacaacgctccggcgtcctgtgggacacaccttctcccccggaagtggagagagccgttcttgatgacggcatttaccggatcatgcagcgcgggctgctgggaagaagccaggtgggcgtcggggtgttccaggaaaacgtttttcacaccatgtggcacgtgacgcggggagcggtcctcatgtatcaaggcaagcgcctggagccttcctgggctagcgtgaaaaaggaccttatttcttacgggggaggctggagactgcagggctcctggaataccggggaggaagtgcaggttatcgccgtcgagcccggaaagaaccctaaaaatgtgcagacagcccccggcaccttcaagacaagcgaaggggaggtgggagctattgccctcgattttaaaccgggcacctctgggtcccctatcgtcaaccgggaaggaaagattgtgggcctgtacggcaatggggttgtgacaacgagcggaacctatgtctccgcgatcgctcaagccaaagcctctcaggagggccccctccctgagatcgaagacgaggtgttcagaaagcgcaacctgacaattatggatcttcatcccgggagcggaaagacccggagatacctgcccgctatcgttcgcgaagccattaaacggaagctgagaaccctcatcctggctcctacacgcgtggtcgcctccgagatggcggaagcccttaaaggcatgccgattcggtatcagacgaccgctgtgaagtccgagcacacagggaaagagatcgttgacctgatgtgccatgccacctttacaatgagactcctgtctcccgtgcgcgtccctaattacaacatgatcattatggatgaagctcacttcaccgacccctccagcatcgccgcccggggctatatttctacgagagtgggaatgggcgaggctgcggccatctttatgacagctacccctcccgggagcgtggaagccttccctcaatccaatgccgtcattcaggatgaggaacgggacatcccggagcgctcttggaacagcggatacgagtggatcaccgattttcccggcaagacagtttggttcgtgccttccattaagtctgggaatgacatcgctaactgtctgcgcaagaatggaaagcgggtgattcagctcagccgcaaaaccttcgatacagaatatcagaagaccaaaaacaacgactgggactacgtcgtgacgacagatatctccgagatgggcgccaattttagagcggaccgggttattgatcccagacgctgccttaagcctgtgatcctgaaggacgggcccgaacgggtcattctggctggcccgatgcctgtgaccgttgccagcgccgctcaaagacgcggacggatcggcagaaaccataataaagagggggatcagtacatctatatgggacagcccctcaacaatgacgaggatcacgcccactggacagaagcgaagatgctgcttgacaacattaatacccccgagggcatcattcctgccctgttcgaacccgagcgcgaaaaatctgctgccatcgatggggagtaccggctcagaggagaggctcgcaagacgtttgtggaactgatgagacggggcgacctgcctgtctggctctcctataaagtggccagcgaggggttccagtactccgatcgcagatggtgctttgacggcgaacggaacaatcaagtccttgaggaaaacatggatgtggagatttggaccaaggagggagaacgcaaaaagctgagaccgcggtggctggacgctagaacatattctgaccccctcgccctgcgcgagttcaaggaatttgcggccggccggagaagcgtttccggggatcttatcctggagatcggaaaactccctcagcatctgacccagcgcgctcagaatgccctggacaacctcgtgatgcttcacaattctgaacaaggcgggcgggcttacagacatgccatggaggagctgcccgatacaattgaaaccctgatgctcctggcccttatcgctgtgctgacaggaggcgtcaccctcttctttctgagcggccgggggctgggaaagacgtccattggcctcctttgtgttatggcgagctctgtgctgctgtggatggcctccgtggagcctcactggatcgctgccagcattatcctcgagttctttctgatggtccttctgatccccgagccggaccgccagagaacacctcaggataaccagctcgcctatgtggttattgggctgctgttcatgatcctcaccgtggctgccaatgagatgggacttctggaaaccaccaagaaggacctgggcattgggcacgtcgcggtggagaaccatcaccatgccgctatgctcgatgtcgacctgcaccccgcctctgcttggaccctttacgccgtggcgacaacgatcattacccctatgatgcggcatacaatcgaaaacaccacagccaatatttccctgaccgctatcgccaaccaagctgccatcctcatgggactggataaaggctggcccattagcaagatggacatcggcgttcctctgctcgctcttgggtgctactctcaggtgaatcccctgacgctgaccgccgcggtcctcatgctggtggcccactatgctattatcggaccgggccttcaggccaaggctacacgcgaggcccagaagagaaccgccgcggggattatgaagaaccctacagttgatggaatcgtggctatcgacctggatcccgtcgtgtacgacaccaaatttgaaaagcagctcggccagattatgctgctgatcctctgtacgagccagattcttctgatgcggacaacctgggccctgtgcgagtccatcacactcgctaccgggcccctgaccacactttgggagggatctcctggcaaattctggaatacgaccattgccgtgagcatggccaacatcttccgcggctcctatctggctggggccggactcgcgtttagcctgatgaagtccctgggcgggggaagacggggcacaggggcccaaggagaaaccctcggcgagaagtggaaacgccagcttaatcagctgtctaagagcgagttcaacacatacaaaagatccggcatcatggaggttgaccggtctgaagctaaggaggggctgaaaagaggagagaccacgaagcacgccgtcagccgcggcacagctaagctccggtggtttgtggaaagaaatctggtgaaaccggaggggaaggtcattgatcttggatgtggccgcgggggatggtcctattactgcgccggcctgaaaaaggttaccgaagtgaaaggctataccaaagggggacccggccatgaggaacctatccccatggcgacatacgggtggaacctcgtgaaactgcactctggaaaggacgtcttctttattcctcccgagaagtgtgataccctgctctgcgacatcggcgagagctcccctaatccgacaattgaagaggggcggacgcttagagtgctgaaaatggttgaaccctggctgcgcggaaaccagttctgtatcaagattctcaatccttacatgcccagcgtggtcgagaccctggagcaaatgcagcggaaacatggcggcatgcttgtgagaaaccctctgtctcgcaattccacacacgaaatgtattgggttagctgcgggaccggaaacatcgtgtctgccgtcaatatgacatcccggatgctcctgaacagatttaccatggctcaccgcaagcccacgtacgagcgggatgtggacctgggcgccgggaccagacatgtggctgtcgaaccggaggttgccaacctcgatatcattggacagcgcatcgaaaatattaaacacgagcataagagcacatggcactatgacgaggataacccttacaagacctgggcttatcatggctcttacgaagtgaaaccctccgggagcgcctccagcatggtgaatggagtcgtgaagctgcttacaaaaccctgggacgttatccctatggtgacccagattgcgatgacagataccacgcccttcggccaacagagagtctttaaggagaaagtggacacacggacccctaaggccaagcgcggcaccgctcagatcatggaagttacagccaaatggctgtgggggttcctctctagaaacaagaaaccgcggatctgtacgagagaggaatttacccggaaggtgcgcagcaatgctgccattggagccgtcttcgtggacgagaaccaatggaactccgcgaaagaggctgttgaagatgagagattttgggacctggtgcaccgggaacgcgagcttcacaagcagggcaagtgcgccacatgcgtctataacatgatggggaaaagagaaaagaaactgggagagttcggcaaggccaaagggtctcgggctatctggtacatgtggctcggcgcccgcttcctggagtttgaagctctgggattcatgaatgaggatcattggtttaacagagaaaatagcctctccggcgtggagggggagggactgcacaaacttggctacattctgcgggacatctctaaaattcccgggggaaacatgtatgccgatgacaccgcgggctgggatacacgcatcaccgaagacgatctccagaatgaggccaagatcacagacattatggaacctgagcatgctctgcttgccaagagcatcttcaaactgacctaccagaacaaggtcgtgagagttcaacggcccgctaaaaatgggacggtgatggatgtcatttcccgcagagaccagcggggctctggacaggtgggcacctatgggctcaacacatttaccaacatggaagcccagctgatccgccaaatggagagcgagggaattttctcccctagcgaactggagacacccaatctcgcgggcagagtgctggattggcttgaaaagcacggggttgagcggctgaaaagaatggccatctctggagacgactgtgtggtcaagccgatcgatgaccgctttgctaccgccctcacggctctgaacgatatgggcaaggtgcggaaagacattcctcagtgggaaccctccaaggggtggaatgattggcagcaggttcctttctgcagccaccattttcaccaacttatcatgaaagacggcagagagattgtggtcccctgtcgcaaccaggatgagctggtgggacgggccagagtctctcagggcgctgggtggtccctccgcgaaacagcctgcctgggaaagagctacgcgcagatgtggcaactgatgtatttccatcggagagacctccgcctggccgctaatgccatctgttccgccgtgcctgttgattgggtgcccacctctcggacaacctggagcattcacgctcatcaccagtggatgacgaccgaggacatgctttccgtctggaacagagtgtggatcgaagagaatccgtggatggaagataaaacacacattagctcttggggcgacgttccttacctggggaagcgcgaggaccagtggtgcggatccctcatcggcctgaccgcccgggcgacatgggctaccaacatccaagtggccattaatcaggtcagacggcttatcgggaacgagaattatctggattacatgacaagcatgaagagatttaaaaacgaaattgaccccgagggcgccctctggtga

SEQ ID NO: 19312 - RNA, 9879 nt, synthetic construct
  misc_feature 1..9879: note = derived and/or modified CDS sequence (opt5) from DENV-1__EU482506__SS-prME
  source 1..9879: mol_type = other RNA
tccgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcattcttctgacatggctcggactgaatagcagatctacctccctgagcatgacatgtatcgctgtcggccttgtgaccctctacctgggggttatggtgcaggccgattctggatgcgtcattaactggaaaggccgcgaactgaagtgtgggtccggaatcttcgtgacaaatgaggttcacacctggacggaacaatataagtttcaggctgacagccctaaacggctctccgccgcgatcggcaaggcctgggaggagggggtgtgcggcattagatctgctacacgcctggaaaacatcatgtggaaacagattagcaacgagcttaatcatatcctgctcgaaaacgacatgaagttcaccgtcgtggttggagatgtggccggcattctggctcaggggaaaaagatgatccggccgcaacccatggagtacaaatattcctggaagtcttggggaaaggccaaaatcattggcgccgacgtccagaataccacatttatcattgatgggcctaacacccccgaatgtcctgacgatcagagagcttggaatatctgggaggtggaggactacggattcggcatttttacgacaaacatctggctgaaacttcgcgatagctatacccaggtgtgcgaccaccggctcatgtccgcggccatcaaagatagcaaggctgtccacgccgacatgggctactggattgaatctgagaaaaatgaaacatggaagctggccagagcttccttcatcgaggttaagacctgtatttggcccaaaagccatacactgtggtctaacggggtgctcgaatccgagatgatcattccgaagatctatggaggccctatcagccaacacaattaccgccccgggtacttcacccagacggccggaccttggcatctgggcaaacttgagctggattttgacctctgcgaagggaccacagtggtcgtggatgagcactgcggaaaccggggcccctctctgagaaccacaaccgttacgggcaagattatccacgaatggtgttgccggagctgtacactgcctccccttcgcttcagaggggaggacggatgctggtatggcatggagattcggccggtgaaagaaaaggaggaaaatctcgtcaagtccatggtgagcgcggggtctggagaggttgactcctttagcctgggcctgctctgtatctccattatcattgaagaggtgatgagatctcgctggagccggaaaatgctgatgaccgggacacttgctgtcttctttctgctcatcatgggacagctgacctggaacgatctgatcagactttgcattatggtgggcgccaatgcctccgaccgcatgggcatggggaccacatacctggctctcatggccacgttcaagatgagacctatgtttgcggttggactcctgttccggcgcctgacctctagagaggtgcttctgctcacaatcggcctgagcctggtcgcttccgtggaacttcccaactctctggaggaactcggggatggactggccatgggcattatgatcctcaaactgcttaccgactttcaaagccatcagctgtgggccacactcctgtccctgaccttcattaagacgacatttagccttcactatgcttggaaaaccatggccatggtgctgtctatcgtctccctcttccccctgtgtctcagcaccacatctcagaagaccacatggctgcctgttcttctggggtccctgggatgcaagccgctcacgatgtttctgatcgctgagaataaaatttggggccggcgcagctggccccttaacgaaggcatcatggccgtggggattgtgtctatcctgctctccagcctgctcaagaacgatgtccctctggcgggaccccttattgccggcgggatgctgatcgcttgttacgtgatctccggaagctctgccgacctgagcctcgagaaagctgccgaggtttcctgggaagaggaagccgagcattctggcgctagccacaatattctggtggaagtccaggatgacgggaccatgaagatcaaagatgaggagagagacgatacacttaccattctgctcaaggcgacactgctcgccgtgtccggagtttatcctctgtctatccccgctacccttttcgtgtggtacttctggcagaagaagaagcagcggagcggcgtcctgtgggacacgcctagccctcccgaagtggagcgcgccgtcctggatgacggcatttatagaatcatgcagcgggggctcctgggacgctctcaggtgggcgttggggtgtttcaagaaaacgtcttccataccatgtggcacgtgacaagaggagccgttcttatgtaccagggcaaacggctggagcccagctgggcttccgtgaagaaagacctcattagctacgggggaggctggagactgcagggctcttggaataccggggaggaagtccaggtgatcgccgtggagcccggaaagaaccctaaaaatgttcaaacagcgcccggcacctttaagacaccggaaggggaggtcggagctatcgccctcgatttcaagcctggcacgtccgggagccccattgtgaaccgcgaaggaaaaatcgtgggcctgtatggcaatggggtcgtgaccacatctggaacctacgtttccgccattgctcaggccaaggcgagccaggagggccctcttcccgagatcgaagacgaggtgtttcggaaaagaaacctgaccattatggatctgcaccccgggtccggaaagacacgccggtatctccctgctatcgtcagagaagccatcaaacgcaagctgcggacgcttattctggccccgaccagagtggttgcttctgagatggccgaagctctcaagggcatgcccatccgctaccaaacaaccgccgtgaaaagcgagcatacagggaaggagattgtcgacctgatgtgccacgcgaccttcacgatgcggctgctctcccctgtgagagttcccaattataacatgatcattatggatgaagcccattttacagaccctagctctatcgctgcccggggctacatctccacccgcgtgggaatgggcgaggctgccgccattttcatgaccgctacaccccctgggagcgtcgaagcgtttccgcagtctaatgccgtgatccaggatgaggaaagagacattcccgagcggagctggaactccggatatgagtggatcaccgatttccctggcaaaacagtgtggtttgtcccctctattaagagcgggaatgacatcgctaactgtcttcgcaaaaatggaaagagagttattcagctgtcccggaagaccttcgatacggaataccagaagaccaagaacaacgactgggactacgtggtgaccacagatatctctgagatgggcgccaatttcagagccgaccgcgtcatcgatcctcggagatgcctgaaacccgtgattctcaaggacgggccggaacgcgttatcctggctggccctatgcccgtgaccgtcgccagcgcggctcagcggagaggacgcattggccggaaccacaataaagagggggatcagtatatctacatgggacagccccttaacaatgacgaggatcatgcccactggacggaagccaagatgctgctcgacaacattaatacccctgagggcatcatccccgctctgtttgaacctgagagagaaaagtccgccgcgattgatggggagtatcgcctgagaggagaggcccggaaaacattcgtggaactcatgcgcagaggcgaccttccggtttggctgagctacaaggtggcttctgaggggtttcaatattccgatcggcgctggtgcttcgacggcgaaagaaacaatcaggtcctggaggaaaacatggatgtggagatctggaccaaagagggagaacggaagaaactcagaccccgctggctggacgcccggacatacagcgaccctcttgctctgagagagtttaaggagttcgccgctggccgccggtccgtctctggggatctcattctggagatcggaaaactgccccagcacctcacccagagagcccaaaatgcgcttgacaacctggtgatgctgcataatagcgaacagggcgggcgggcctatcgccacgctatggaggagctccctgatacaattgaaaccctgatgcttctggccctcatcgctgttctgacgggaggcgtgacactgtttttcctctccggcagagggcttggaaagacctctatcggcctgctgtgtgtgatggccagctccgtcctcctgtggatggccagcgttgagccccattggattgctgcgtctatcattcttgaatttttcctgatggtgctcctgatcccggagcctgaccggcagcgcacaccccaggataaccaactggcctacgtggtcattgggctcctttttatgatcctgacagtggctgccaatgagatgggactgctcgaaaccacaaagaaagacctgggcattgggcacgttgccgtggagaaccaccatcacgctgccatgcttgatgtcgacctgcatcctgcgtccgcctggacgctctacgctgtggccaccacaatcatcacccccatgatgagacacacaattgaaaacaccacggctaatatcagcctgaccgccattgcgaaccaggccgctatcctgatgggactcgataagggctggcctatttctaaaatggacatcggcgtcccccttctggccctggggtgctattcccaggtgaatccgctcacactgaccgctgccgttcttatgctggtggctcattacgccatcattggacctggcctccaagcgaaggccacacgggaggctcagaaacgcaccgccgctgggatcatgaagaaccccacggtcgatggaattgtggccatcgacctggatcccgttgtgtatgacgccaagttcgaaaaacagctgggccagattatgctccttatcctgtgtacaagccaaatcctgctcatgagaaccacatgggcgctgtgcgagtctattacccttgctaccgggcctctgacaacgctctgggagggaagcccgggcaagttttggaataccacaatcgccgtctccatggctaacattttccggggctcttacctggccggggccggactggctttcagcctcatgaaatcccttggcgggggacgcagaggcaccggggcccagggagaaacactgggcgagaagtggaaacggcagctgaatcagctcagcaagtccgaatttaacacctataagagatctggcatcatggaggtggaccgcagcgaagcgaaagaggggctgaagcggggagagacgacaaaacacgccgtgtccagaggcaccgctaaacttcgctggttcgttgaacggaatctggtcaaacccgaggggaaggtgattgatctcggatgtggcagagggggatggtcttactattgcgccggcctgaagaaagtgaccgaagtcaagggctacacaaaagggggacctggccacgaggaacccatccctatggctacctacgggtggaacctggttaagctccatagcggaaaagacgtgtttttcattccccctgagaagtgtgatacacttctgtgcgacatcggcgagtcctctccgaatcccacgatcgaagaggggcgcaccctgcgggtgctcaaaatggtcgaaccttggctgagaggaaaccaattttgtattaagatccttaatccctatatgcctagcgtggttgagacactggagcagatgcagcgcaagcacggcggcatgctcgtgcggaaccccctgtccagaaatagcacccatgaaatgtactgggtctcttgcgggacaggaaacattgtgtccgccgttaatatgaccagccgcatgctgctcaaccggttcacgatggcgcacagaaaaccgacctatgagcgcgatgtggacctgggcgccgggacaagacacgtcgctgtggaacctgaggtggccaaccttgatatcattggacagcggatcgaaaatatcaagcatgagcacaaatctacctggcattacgacgaggataacccctataagacatgggcttaccacggctcctatgaagtcaaacccagcgggtctgcctccagcatggttaatggagtggtgaagctgctcaccaagccttgggacgtcattcccatggtgacacaaatcgctatgaccgatacgacaccttttggccagcagcgcgttttcaaagagaaggtggacaccagaaccccgaaagccaagcggggcacagcgcaaattatggaagtcacggccaaatggctgtgggggtttctttccagaaacaagaagccccggatctgtacccgcgaggagttcacaagaaaagtgcggagcaatgctgccattggagctgtttttgtggacgagaaccagtggaactctgccaaggaggccgtcgaagatgagcgcttctgggacctggtgcatagagaacgggagctccacaaacagggcaagtgcgcgacctgcgtttacaacatgatggggaaacgcgaaaagaagctgggagagtttggcaaagctaaggggagcagagccatctggtacatgtggctgggcgcccggttcctcgagttcgaagctctgggatttatgaatgaggatcactggttctcccgcgaaaactctcttagcggcgtggagggggagggactgcataaactcggctatatcctgagagacatttccaagatccctgggggaaatatgtacgccgatgacacagctggctgggatacccggattacagaagacgatcttcagaacgaggcccgcatcaccgacattatggaacccgagcacgcgctgctcgccaaatctatctttaagctgacgtatcaaaataaagtcgtgagagtccagcggcctgctaagaacgggaccgtgatggatgttatcagccgcagagaccagcggggctccggacaggtgggcacatacgggctgaataccttcacaaacatggaagcccaactcattagacagatggagtctgagggaatctttagcccctccgaactggagaccccgaaccttgctgaacgcgtcctggattggctcgagaagtatggcgtggaacggctgaaaagaatggccattagcggggacgactgtgtggttaagcctatcgatgaccgcttcgcgacggcccttacagctctgaatgatatgggaaaagtgcggaaggacattccccagtgggagccttctaaaggctggaacgattggcagcaagtccccttttgctcccatcacttccaccagctcatcatgaaggacgggagagagattgtggttccttgtcgcaatcaggatgaactggtgggccgggccagagtcagccagggagctggctggtctctgcgcgagaccgcctgcctcgggaagtcctacgctcaaatgtggcagctgatgtattttcatcggagagaccttcgcctggccgcgaacgccatctgtagcgctgtgcccgtcgattggatcccgacatcccggaccacgtggtctattcacgcccatcaccagtggatgaccacagaagacatgctcagcgtgtggaatagagtttggatcgaggaaaacccttggatggaggataaaacccatatttccagctggggagacgtgccctacctgggcaagcgggaggaccaatggtgcgggtctcttatcggactgacagccagagctacctgggccacaaatattcaggtcgcgatcaaccaggtgcgccggctcatcggcaatgaaaactacctggattatatgacctccatgaaaagattcaagaatgagggggaccccgaaggcgctctgtggtga

SEQ ID NO: 19313 - RNA, 9879 nt, synthetic construct
  misc_feature 1..9879: note = derived and/or modified CDS sequence (opt5) from DENV-1__EU482509__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgccggcaaactcgttcatcagatcttcgggacggcttacggagtcctgtttagcggcgtgtcctggaccatgaagattgggatcggcgtgcttctgacatggctcggactgaatagcagatctacctccctgagcatgacatgtattgccgtcggccttgtgaccctctacctgggggttatggtgcaggctgattctggatgcgtcatcaactggaaaggccgcgaactgaagtgtgggtccggaattttcgtgacaaatgaggttcacacctggacggaacaatataagtttcaggccgacagccctaaacggctctccgcggccatcggcaaggcttgggaggagggggtgtgcggcatcagatctgccacacgcctggaaaacattatgtggaaacagatcagcaacgagcttaatcatattctgctcgaaaacgacatgaagttcaccgtcgtggttggagatgtggctggcatcctggcccaggggaaaaagatgattcggccgcaacccatggagtacaaatattcctggaagtcttggggaaaggccaaaatcatcggcgctgacgtccagaataccacatttattatcgatgggcctaacacccccgaatgtcctgacgatcagagagcgtggaatatttgggaggtggaggactacggattcggcatctttacgacaaacatttggctgaaacttcgcgatagctatacccaggtgtgcgaccaccggctcatgtccgccgctatcaaagatagcaaggccgtccacgccgacatgggctactggatcgaatctgagaaaaatgaaacatggaagctggctagagcctccttcattgaggttaagacctgtatctggcccaaaagccatacactgtggtctaacggggtgctcgaatccgagatgattgtgccgaagatctatggaggccctattagccaacacaattaccgccccgggtacttcacccagacggcgggaccttggcatctgggcaaacttgagctggattttgacctctgcgaagggaccacagtcgtggttgatgagcactgcggaaaccggggcccctctctgagaaccacaaccgtgacgggcaagatcatccacgaatggtgttgccggagctgtacactgcctccccttcgcttcagaggggaggacggatgctggtatggcatggagattcggccggtcaaagaaaaggaggaaaatctcgtgaagtccatggttagcgctgggtctggagaggtggactcctttagcctgggcctgctctgtatctccattatcattgaagaggtcatgagatctcgctggagccggaaaatgctgatgaccgggacacttgccgtgttctttctgctcatcatgggacagctgacctggaacgatctgattagactttgcatcatggttggcgccaatgcttccgaccgcatgggcatggggaccacatacctggccctcatggcgacgttcaagatgagacctatgtttgctgtgggactcctgttccggcgcctgacctctagagaggtccttctgctcacaatcggcctgagcctggtggcctccgtggaacttcccaactctctggaggaactcggggatggactggccatgggcattatgatcctcaaactgcttaccgactttcaaagccatcagctgtgggctacactcctgtccctgaccttcattaagacgacatttagccttcactatgcctggaaaaccatggctatggtcctgtctatcgtttccctcttccccctgtgtctcagcaccacatctcagaagaccacatggctgcctgtgcttctggggtccctgggatgcaagccgctcacgatgtttctgattgccgagaataaaatctggggccggcgcagctggccccttaacgaaggcatcatggcggtggggattgtctctatcctgctctccagcctgctcaagaacgatgtgcctctggccggaccccttattgctggcgggatgctgatcgcctgttacgttatttccggaagctctgctgacctgagcctcgagaaagccgccgaggtgtcctgggaagaggaagctgagcattctggcgcgagccacaatatcctggtcgaagtgcaggatgacgggaccatgaagatcaaagatgaggagagagacgatacacttaccattctgctcaaggccacactgctcgctgtttccggagtgtatcctctgtctatccccgccacccttttcgtctggtacttctggcagaagaagaagcagcggagcggcgtgctgtgggacacgcctagccctcccgaagtcgagcgcgccgtgctggatgacggcatttatagaatcatgcagcgggggctcctgggacgctctcaggttggcgtgggggtctttcaagaaaacgtgttccataccatgtggcacgttacaagaggagctgtgcttatgtaccagggcaaacggctggagcccagctgggcctccgtcaagaaagacctcattagctacgggggaggctggagactgcagggctcttggaataccggggaggaagtccaggtgatcgcggttgagcccggaaagaaccctaaaaatgtccaaacagctcccggcacctttaagacaccggaaggggaggtgggagccattgccctcgatttcaagcctggcacgtccgggagccccatcgtgaaccgcgaaggaaaaatcgtcggcctgtatggcaatggggtggttaccacatctggaacctacgtgtccgctattgcccaggcgaaggctagccaggagggccctcttcccgagatcgaagacgaggtctttcggaaaagaaacctgaccattatggatctgcaccccgggtccggaaagacacgccggtatctccctgccatcgtgagagaagccattaaacgcaagctgcggacgcttatcctggctccgaccagagttgtggcctctgagatggctgaagccctcaagggcatgcccatccgctaccaaacaaccgcggtcaaaagcgagcatacagggaaggagattgtggacctgatgtgccacgccaccttcacgatgcggctgctctcccctgttagagtgcccaattataacatgatcattatggatgaagctcattttacagaccctagctctatcgccgctcggggctacatttccacccgcgtcggaatgggcgaggccgccgctatcttcatgaccgcgacaccccctgggagcgtggaagcctttccgcagtctaatgctgtgatccaggatgaggaaagagacattcccgagcggagctggaactccggatatgagtggatcaccgatttccctggcaaaacagtctggtttgttccctctattaagagcgggaatgacatcgccaactgtcttcgcaaaaatggaaagagagtgattcagctgtcccggaagaccttcgatacggaataccagaagaccaagaacaacgactgggactacgtggtcaccacagatatctctgagatgggcgccaatttcagagctgaccgcgtgattgatcctcggagatgcctgaaacccgttatcctcaaggacgggccggaacgcgtgatcctggccggccctatgcccgtcaccgtggcgagcgctgcccagcggagaggacgcattggccggaaccacaataaagagggggatcagtatatctacatgggacagccccttaacaatgacgaggatcatgcccactggacggaagctaagatgctgctcgacaacattaatacccctgagggcatcattcccgccctgtttgaacctgagagagaaaagtccgcggccatcgatggggagtatcgcctgagaggagaggctcggaaaacattcgttgaactcatgcgcagaggcgaccttccggtgtggctgagctacaaggtcgcctctgaggggtttcaatattccgatcggcgctggtgcttcgacggcgaaagaaacaatcaggtgctggaggaaaacatggatgtcgagatctggaccaaagagggagaacggaagaaactcagaccccgctggctggacgctcggacatacagcgaccctcttgccctgagagagtttaaggagttcgctgccggccgccggtccgtgtctggggatctcattctggagatcggaaaactgccccagcacctcacccagagagcgcaaaatgcccttgacaacctggttatgctgcataatagcgaacagggcgggcgggcttatcgccacgccatggaggagctccctgatacaattgaaaccctgatgcttctggctctcatcgccgtgctgacgggaggcgtgacactgtttttcctctccggcagagggcttggaaagacctctattggcctgctgtgtgtcatggccagctccgttctcctgtggatggctagcgtggagccccattggatcgcggcctctatcattcttgaatttttcctgatggtgctcctgatcccggagcctgaccggcagcgcacaccccaggataaccaactggcttacgtcgtgattgggctcctttttatgatcctgacagttgccgccaatgagatgggactgctcgaaaccacaaagaaagacctgggcattgggcacgtggctgtcgagaaccaccatcacgccgcgatgcttgatgtggacctgcatcctgcctccgcttggacgctctacgccgtcgctaccacaatcattacccccatgatgagacacacaatcgaaaacaccacggccaatatcagcctgaccgcgattgccaaccaggctgccatcctgatgggactcgataagggctggcctatttctaaaatggacatcggcgtgccccttctggctctggggtgctattcccaggttaatccgctcacactgaccgccgctgtgcttatgctggtcgcccattacgcgattatcggacctggcctccaagccaaggctacacgggaggcccagaaacgcaccgctgccgggatcatgaagaaccccacggtggatggaattgttgccatcgacctggatcccgtggtctatgacgcgaagttcgaaaaacagctgggccagattatgctccttatcctgtgtacaagccaaattctgctcatgagaaccacatgggctctgtgcgagtctatcacccttgccaccgggcctctgacaacgctctgggagggaagcccgggcaagttttggaataccacaatcgctgtgtccatggccaacattttccggggctcttacctggccggggctggactggccttcagcctcatgaaatcccttggcgggggacgcagaggcaccggggcgcagggagaaacactgggcgagaagtggaaacggcagctgaatcagctcagcaagtccgaatttaacacctataagagatctggcatcatggaggtggaccgcagcgaagccaaagaggggctgaagcggggagagacgacaaaacacgctgtttccagaggcaccgccaaacttcgctggttcgtcgaacggaatctggtgaaacccgaggggaaggtgattgatctcggatgtggcagagggggatggtcttactattgcgctggcctgaagaaagtcaccgaagttaagggctacacaaaagggggacctggccacgaggaacccatccctatggccacctacgggtggaacctggtgaagctccatagcggaaaagacgtgtttttcattccccctgagaagtgtgatacacttctgtgcgacatcggcgagtcctctccgaatcccacgattgaagaggggcgcaccctgcgggtcctcaaaatggtggaaccttggctgagaggaaaccaattttgtatcaagatccttaatccctatatgcctagcgttgtggagacactggagcagatgcagcgcaagcacggcggcatgctcgtccggaaccccctgtccagaaatagcacccatgaaatgtactgggtgtcttgcgggacaggaaacattgtttccgcggtgaatatgaccagccgcatgctgctcaaccggttcacgatggcccacagaaaaccgacctatgagcgcgatgtcgacctgggcgctgggacaagacacgtggccgtggaacctgaggtcgctaaccttgatatcattggacagcggatcgaaaatattaagcatgagcacaaatctacctggcattacgacgaggataacccctataagacatgggcctaccacggctcctatgaagttaaacccagcgggtctgcttccagcatggtgaatggagtggtcaagctgctcaccaagccttgggacgtgatccccatggttacacaaatcgccatgaccgatacgacaccttttggccagcagcgcgtgttcaaagagaaggtcgacaccagaaccccgaaagcgaagcggggcacagcccaaattatggaagtgacggctaaatggctgtgggggtttctttccagaaacaagaagccccggatctgtacccgcgaggagttcacaagaaaagttcggagcaatgccgctattggagccgtgtttgtcgacgagaaccagtggaactctgccaaggaggcggtggaagatgagcgcttctgggacctggttcatagagaacgggagctccacaaacagggcaagtgcgctacctgcgtgtacaacatgatggggaaacgcgaaaagaagctgggagagtttggcaaagccaaggggagcagagccatctggtacatgtggctgggcgctcggttcctcgagttcgaagccctgggatttatgaatgaggatcactggttctcccgcgaaaactctcttagcggcgtcgagggggagggactgcataaactcggctatattctgagagacatctccaagatccctgggggaaatatgtacgctgatgacacagccggctgggatacccggattacagaagacgatcttcagaacgaggcgcgcatcaccgacattatggaacccgagcacgccctgctcgctaaatctatctttaagctgacgtatcaaaataaagtggtcagagtgcagcggcctgccaagaacgggaccgttatggatgtgattagccgcagagaccagcggggctccggacaggtcggcacatacgggctgaataccttcacaaacatggaagctcaactcatcagacagatggagtctgagggaatctttagcccctccgaactggagaccccgaaccttgccgaacgcgtgctggattggctcgagaagtatggcgtggaacggctgaaaagaatggcgattagcggggacgactgtgttgtgaagcctatcgatgaccgcttcgccacggctcttacagccctgaatgatatgggaaaagtccggaaggacattccccagtgggagccttctaaaggctggaacgattggcagcaagtgcccttttgctcccatcacttccaccagctcatcatgaaggacgggagagagattgttgtgccttgtcgcaatcaggatgaactggtcggccgggctagagtgagccagggagccggctggtctctgcgcgagaccgcttgcctcgggaagtcctacgcccaaatgtggcagctgatgtattttcatcggagagaccttcgcctggcggccaacgctatctgtagcgccgtccccgtggattggattccgacatcccggaccacgtggtctatccacgcccatcaccagtggatgaccacagaagacatgctcagcgtttggaatagagtgtggatcgaggaaaacccttggatggaggataaaacccatatttccagctggggagacgtcccctacctgggcaagcgggaggaccaatggtgcgggtctcttatcggactgacagctagagccacctgggcgacaaatattcaggtggctatcaaccaggttcgccggctcattggcaatgaaaactacctggattatatgacctccatgaaaagattcaagaatgagggggaacccgagggcgccctgtggtga

SEQ ID NO: 19314 - RNA, 9879 nt, synthetic construct
  misc_feature 1..9879: note = derived and/or modified CDS sequence (opt5) from DENV-1__EU482510__SS-prME
  source 1..9879: mol_type = other RNA
tccgtgaccatgctgctcatgctgatgcccacggcgcttgctttccacctgacgaccagaggaggggagcctcatatgatcgtctccaagcaggaacggggaaaatctctcctgtttaagaccagcgccggcgttaatatgtgcacccttattgcgatggacctgggggagctctgtgaagatacaatgacctacaaatgcccgcgcatcacagaggtggaacccgacgatgtggactgttggtgcaataccacggatacctgggtcacatatggaacctgttcccagacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctccggaccgaggttacaaaccctgctgtgctgcgcaaactttgcattgaagccaagatctccaataccacgacagatagcagatgtccgacccaaggagaggcgaccctggtggaagaacaagacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctacctctgagatccagctcacagactacggcgccctgaccctggattgtagcccccggacaggcctcgacttcaacgaaatggtcctgcttaccatgaaggagaaaagctggctggtgcataagcagtggtttctcgatctgcctcttccctggacgtccggggcctctacaagccaagagacctggaatcgccaggacctgctcgtcacattcaaaaccgctcacgcgaagaagcaggaagtggttgtgctgggatcccaagagggcgccatgcacaccgctctgacaggggccacggaaattcagaccagcggaacaaccacaatctttgccggccatctcaaatgcagactgaagatggataaacttaccctgaaggggatgtcttatgtcatgtgtacgggctccttcaaactcgagaaggaagtggctgagacacagcacggaaccgttctggtgcagattaagtacgagggcaccgacgccccgtgcaaaatccctttcagcacacaagatgggaagggagtcacccagaacggccggctgatcacagcgaatcccattgtgacggacaaagaaaagcctgtgaacatcgaggctgaaccgccctttggggagtcttatattgttatcggagccggcgagaaagcccttaagctcagctggttcaagaaagggtcctctattggcaagatgtttgaagctaccgccagaggagctcgccggatggccatcctgggcgatacagcgtgggacttcgggagcatcggaggcgtctttacctccgtggggaaactggtgcatcagattttcggaacagcctacggcgtcctctttagcggggtgtcttggaccatgaagatcggcattggagttctgcttacgtggctgggcctcaattccagaagcacctctctgtccatgacatgtatcgctgtggggctggtcaccctttacctcggagtgatggttcaggccgatagcggctgcgtgattaactggaaagggcgcgagctgaagtgtggatccggcatcttcgtcacaaatgaagtgcacacctggacagagcaatataagtttcaggctgactctcctaaacggctgagcgccgcgattgggaaggcctgggaagagggcgtttgcggaatcagatccgctacccgcctcgagaacatcatgtggcggcagatttctaacgaactgaatcatatccttctggagaacgacatgaaattcacggtggtcgtgggcgatgtggtcgggattctcgcccagggaaagaaaatgatcagaccgcaacccatggaacacaagtacagctggaaatcctggggcaaggctaagattatcggggccgacgttcagaatacaacctttatcattgatggacctaacacccccgagtgtcctgacgatcagcgcgcctggaatatctgggaagtggaggactatggcttcggcatttttacaaccaacatctggctgaaactgcgggatagctacacacaggtgtgcgaccacagacttatgtctgctgcgattaaggattccaaagccgtccatgctgacatggggtattggatcgagagcgaaaagaatgagacatggaaactcgcccgcgcctctttcatcgaagtgaagacctgtatttggcccaagtcccacacactgtggagcaacggagttctggagtctgaaatgatcattccgaaaatctacggcgggcctattagccaacataattatcggcccggatacttcacccagacagctggcccttggcacctcgggaagctggagcttgattttgacctgtgcgagggaaccacggtggtcgtggatgaacactgcggcaacagaggcccctccctccggaccacaaccgttacagggaaaatcatccatgagtggtgttgccgcagctgtaccctgcctcccctgagattcaagggagaagacggctgctggtacgggatggagattcggccggtgaaagagaaggaagagaatcttgtcaagtctatggtgtccgccggaagcggcgaagttgactccttttctctcgggctgctgtgtatcagcattatgatcgaggaagtgatgagatcccgctggtctcggaaaatgctcatgacgggaacactggcggtcttctttcttctgattatgggccagctcacctggaacgatctgatcagaagctgcattatggtgggcgctaatgcctccgaccgcatggggatgggaacaacctatctggcccttatggctaccttcaagatgagacctatgtttgccgtgggcctcctgttccggcgcctgacatctagagaggtcctcctgcttacgatcgggctgagcctcgttgcgtccgtggagctgcccaacagcctggaagaacttggagatggcctggctatggggatcatgattctcaaactgctcaccgactttcaatcttaccagctgtgggccacacttctgtccctcaccttcatcaagacaacctttagcctgcactatgcctggaaaacgatggctatggtgctgtctattgtctcccttctgcccctctgtctgagcacaacctctcagaagaccacatggctccctgtgctgcttggatccctgggctgcaagccgctgaccatgttcctcatcgccgaaaataaaatttggggccggaagtcctggcccctgaacgaggggatcatggctgttggaatcgtgtccattcttctgagctctctcctgaaaaacgatgtccctctcgccggccccctgatcgccgggggaatgcttattgcctgttacgtgatcagcggctcctctgctgacctgagcctggaaaaggccgctgaggtttcctgggaggaagaggccgaacattctggggccagccacaatattctcgtggaggtccaggatgacggaacaatgaaaatcaaggatgaggaacgcgacgatacgctgaccatccttctgaaagctacactcctggcggtgtccggcgtctatcctctctctattcccgccaccctgtttgtgtggtacttctggcaaaagaagaaacagagaagcggcgttctttgggacacacctagccctcccgaggtggaacgggctgtcctggatgacgggatctatcgcattatgcagagaggactgctcggccggagccaggtgggggttggagtgttccaagagaacgtctttcataccatgtggcacgtgacgcgcggcgccgtgctgatgtaccaggggaagagacttgaaccctcttgggcctccgttaaaaaggacctgatcagctacggaggcggctggcggctccaggggtcttggaataccggagaggaggtccaggtgattgctgtggaacccggcaaaaaccctaagaatgtccaaacagcccccgggaccttcaagacaccggagggagaagtgggcgcgatcgctctggattttaaacctgggacctccggaagccccattgttaacagagagggcaagatcgtgggcctctatgggaatggagtcgtgacaacgtccggcacctacgtttctgccatcgcccaggctaaagccagccaggaagggcctctgcccgagattgaggacgaagtgttccgcaagcggaaccttacaatcatggatctgcaccccggatccggcaaaaccagacgctatctgcctgcgattgtccgggaggctatcaagagaaagctccgcaccctgattcttgccccgacacgggtggttgccagcgaaatggctgaggccctgaaagggatgcccatcagataccaaacgaccgctgtgaagtctgaacatacaggccgcgagatcgtcgacctcatgtgccacgccacctttacaatgcggctgctgtcccctgtgagagtgcccaattataacatgattatcatggatgaggcgcatttcaccgaccctagctctattgccgctcggggatacatcagcacgcgcgtcggcatgggggaagccgctgccatttttatgacagccacaccccctggatccgttgaggctttcccgcagtctaatgcggtgatccaggatgaagagagagacatccccgaacggagctggaactccggctatgagtggattaccgattttcctgggaaaacagtgtggttcgtcccctctatcaagagcggaaatgacattgccaactgtctccgcaaaaatggcaagagagtgatccagctttcccggaagacctttgatacagagtaccagaaaaccaagaacaacgactgggactacgttgtgacgacagatattagcgaaatgggggctaatttcagagccgaccgcgtcatcgatcctcggagatgcctgaaacccgtgattctgaaggacggcccggagcgcgttatcctcgccggacctatgcccgtgaccgtcgcttctgccgcgcagcggagaggccgcatcgggcggaaccacaataaagaaggagatcagtatatttacatgggccagcccctgaacaatgacgaggatcatgctcactggacagaggccaagatgcttctggacaacatcaatacccctgaagggattatccccgccctcttcgagcctgaaagagagaagtccgctgccattgatggagaatatcgcctgagaggcgaggcgcggaaaacgtttgtggagctgatgcgcagaggggacctcccggtctggcttagctacaaggtggcctccgaaggcttccaatattctgatcggcgctggtgctttgacggagagagaaacaatcaggttctggaagagaacatggatgtggaaatctggaccaaagagggcgagcggaagaaactgagaccccgctggctcgacgctcggacatacagcgaccctctggcccttagagagttcaaggagtttgctgccgggcgccggtccgtgtctggagatctgatcctcgaaattggcaaactgccccagcacctgacccagagagctcaaaatgccctcgacaaccttgtcatgctgcataatagcgagcaagggggacgggcgtatcgccacgccatggaggaactgcctgatacaatcgagaccctcatgctgcttgctctgattgccgttctcacaggcggcgtgaccctgttctttctgtccgggagaggactcggcaagacgagcatcgggcttctgtgtgtgatggcttcttccgccctgctctggattgccagcgtcgaaccccattggatcgctgcgtctatcattctggagttctttcttatggtgctgctcatcccggaacctgaccggcagcgcacaccccaggataaccaactggcctacgttgtgattggactcctgttcatgatccttaccgtcgctgccaatgagatgggcctgctggagaccacaaagaaagacctcgggattggacacgtggccgtcgaaaaccaccatcacgctaccatgctggatgtggaccttcatcctgcctccgcgtggacactgtacgccgttgctacgaccatcattacacccatgatgagacacaccatcgagaacacaaccgccaatatcagcctcacggctattgccaaccaggcggccatcctgatgggcctggataagggctggcctatttctaaaatggacatcggggtgcccctccttgctctgggatgctatagccaggtcaatccgctgaccctcacagccgctgtgctgatgcttgttgcccattacgctattatcggccctgggctgcaagccaaggcgacccgggaagcccagaaacgcacagctgccggaatcatgaagaaccccaccgtggatggcattgtcgctatcgacctcgatcccgtggtgtatgacgccaagtttgagaaacagctggggcagattatgctgctcatcctttgtacgtcccaaattctgctgatgagaacaacctgggccctctgcgaatctatcacactggcgaccggacctcttaccacactgtgggagggcagcccgggcaagttctggaatacgaccatcgctgtttccatggccaacatttttcgggggagctacctcgctggagccggcctggccttctccctgatgaaatctctcgggggaggccgcagagggacaggagctcagggcgagacccttggcgaaaagtggaaacggcagctgaatcagctgagcaagtccgagttcaacacatataagagatctgggatcatggaagtcgaccgcagcgaggccaaagaaggactccggagaggcgagaccacgaagcacgcggtgtcccgcgggacagccaaactgcggtggtttgtggagagaaatcttgtcaagcccgaaggaaaagttattgatctgggctgtgggcgcggaggctggtcttactattgcgctggcctcaagaaggtgaccgaggtgaaagggtacaccaagggaggccctgggcacgaggaacccatccctatggccacatacggatggaacctggtcaaactgcatagcggcaaggacgtgttctttattccccctgaaaaatgtgataccctcctttgcgacatcggggagtccagcccgaatcccacaattgaggaaggacggacgctgagagttctgaagatggtggagccttggctccgcggcaaccaattctgtatcaaaatcctgaatccctatatgccttctgtcgtggaaacccttgagcagatgcagcggaagtacggcgggatgctggttagaaaccccctctcccgcaatagcacacacgagatgtattgggtgtcttgcggaaccggcaacattgtctccgctgtgaatatgacaagccggatgctgctgaacagatttaccatggcccatcgcaagccgacgtacgaaagagatgtggacctcggggcgggaacccggcacgtcgccgttgagcctgaagtggctaacctggatatcattggccagcgcatcgagaatattaaacacgaacataagtctacatggcactatgacgaggataacccctacaaaacctgggcctatcatgggtcctacgaggtgaagcccagcggatccgctagctctatggtcaatggcgtggttaaacttctgacaaagccttgggacgtgatccccatggtcacccaaatcgccatgacagataccacgcctttcggccagcagagagtgtttaaggaaaaagttgacacacggaccccgaaggctaaaagagggaccgcccaaattatggaggtgacagcgcggtggctctggggattcctgagccgcaacaagaaacccagaatctgtacgcgggaagagtttacccgcaaggtcagatccaatgccgctattggcgccgtgttcgttgacgaaaaccagtggaactctgctaaggaggccgtggaggatgaacggttttgggaccttgtccaccgcgagagagaactgcataaacaggggaagtgcgccacatgcgtgtacaacatgatgggaaaacgggagaagaaactcggcgagttcgggaaggcgaagggcagccgcgctatctggtatatgtggctgggagccagatttctggagttcgaggccctcggcttcatgaatgaagatcactggttttcccgggagaactctctgagcggggtcgaaggagagggccttcacaaactggggtacattctccgcgacatctccaagatccctggaggcaatatgtatgctgatgacaccgccgggtgggatacaagaattaccgaggacgatctgcagaacgaagctaaaatcacagacattatggagcccgaacatgcccttctggcgacctctatcttcaagctcacgtaccaaaataaagtggttcgggtgcagcgccctgccaagaacggcaccgtcatggatgtgattagcagacgggaccagagaggatccggccaggtggggacatatggactgaatacctttacaaacatggaggctcaactgatccgccagatggaaagcgagggcatcttctctccctccgagctcgaaaccccgaacctggccgagcgggttcttgattggctggaaaaatacggggtggagagactcaagcgcatggctattagcggagacgactgtgtcgtgaagcctatcgatgaccggtttgccacggcgctgacagcccttaatgatatgggcaaagttagaaaggacattccccagtgggaaccttctaaagggtggaacgattggcagcaagtgcccttctgctcccaccattttcaccagctgatcatgaaggacggccgcgagattgtcgtgccttgtcggaatcaggatgagctcgtcggcagagctcgcgtgagccagggcgccgggtggtccctgcgggaaaccgcttgcctgggaaaatcttatgcccaaatgtggcagctcatgtacttccacagacgcgacctgcggcttgctgccaacgcgatctgtagcgccgttcccgtggattgggtcccgacatccagaaccacgtggagcattcatgctcaccatcagtggatgaccacagaggacatgctgtctgtgtggaatcgggtttggatcgaagagaacccttggatggaagataagacccacatctccagctggggcgacgtgccctacctcgggaagagagaggaccaatggtgcggatctctgattggccttacagcccgcgccacctgggctacaaatatccaggtcgccattaaccaggtgcggagactgatcgggaatgagaactatctcgattacatgaccagcatgaaacgctttaagaatgaatccgaccccgagggcgcgctgtggtga

SEQ ID NO: 19315 - RNA, 9879 nt, synthetic construct
  misc_feature 1..9879: note = derived and/or modified CDS sequence (opt5) from DENV-1__EU482511__SS-prME
  source 1..9879: mol_type = other RNA
agcgtgaccatgctgctcatgctgatgcccacagcccttgctttccacctgacgaccagaggcggggaacctcatatgattgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatgtctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagattatccacgaatggtgttgccggtcctgtacactgcctccccttcgcttcagaggggaggacggatgctggtatggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgaccgggacacttgctgtgttctttctgctcatcatgggacagctgacctggaacgatctgattagactttgcatcatggttggcgccaatgcctctgaccgcatgggcatggggaccacatacctggctctcatggccacgttcaagatgagacctatgtttgcggtgggactgctgttccggcgcctgaccagcagagaggtccttctgctcacaattggcctgtccctggtggcttctgtggaacttcccaacagcctggaggaactcggggatggactggccatgggcatcatgatcctcaaactgcttaccgactttcaatcccatcagctgtgggccacactcctgagcctgaccttcattaagacgacattttctcttcactatgcttggaaaaccatggccatggtcctgtccatcgttagcctcttccccctgtgtctctctaccacatcccagaagaccacatggctgcctgtgcttctggggagcctgggatgcaagccgctcacgatgtttctgattgctgagaataaaatctggggccggcgctcttggccccttaacgaaggcattatggccgtggggatcgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagattaaagatgaggagagagacgatacacttaccatcctgctcaaggcgacactgctcgccgtttctggagtgtatcctctgagcatccccgctacccttttcgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtctttcaagaaaacgtgttccataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacagcgcccggcacctttaagacaccggaaggggaggtgggagctattgccctcgatttcaagcctggcacgagcgggtctcccatcgtgaaccgcgaaggaaaaattgtcggcctgtatggcaatggggtggttaccacatccggaacctacgtgagcgccatcgctcaggccaaggcgtcccaggagggccctcttcccgagatcgaagacgaggtctttcggaaaagaaacctgaccattatggatctgcaccccgggtctggaaagacacgccggtatctccctgctatcgtgagagaagccattaaacgcaagctgcggacgcttatcctggccccgaccagagttgtggctagcgagatggccgaagctctcaagggcatgcccattcgctaccaaacaaccgccgtcaaatccgagcatacagggaaggagatcgtggacctgatgtgccacgcgaccttcacgatgcggctgctcagccctgttagagtgcccaattataacatgatcattatggatgaagcccattttacagacccttcttccatcgctgcccggggctacattagcacccgcgtcggaatgggcgaggctgccgccatcttcatgaccgctacaccccctgggtctgtggaagcgtttccgcagagcaatgccgtgattcaggatgaggaaagagacatccccgagcggtcctggaactctggatatgagtggatcaccgatttccctggcaaaacagtctggtttgttcccagcattaagtccgggaatgacatcgctaactgtcttcgcaaaaatggaaagagagtgattcagctgtctcggaagaccttcgatacggaataccagaagaccaagaacaacgactgggactacgtggtcaccacagatatcagcgagatgggcgccaatttcagagccgaccgcgtgattgatcctcggagatgcctgaaacccgttatcctcaaggacgggccggaacgcgtgattctggctggccctatgcccgtcaccgtggcctccgcggctcagcggagaggacgcatcggccggaaccacaataaagagggggatcagtatatctacatgggacagccccttaacaatgacgaggatcatgcccactggacggaagccaagatgctgctcgacaacattaatacccctgagggcatcattcccgctctgtttgaacctgagagagaaaagagcgccgcgatcgatggggagtatcgcctgagaggagaggcccggaaaacattcgttgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgtcgagatttggaccaaagagggagaacggaagaaactcagaccccgctggctggacgcccggacatactccgaccctcttgctctgagagagtttaaggagttcgccgctggccgccggtctgtgagcggggatctcatcctggagatcggaaaactgccccagcacctcacccagagagcccaaaatgcgcttgacaacctggttatgctgcataattccgaacagggcgggcgggcctatcgccacgctatggaggagctccctgatacaattgaaaccctgatgcttctggccctcatcgctgtgctgacgggaggcgtgacactgtttttcctctctggcagagggcttggaaagaccagcattggcctgctgtgtgtcatggcctccagcgttctcctgtggatggcctctgtggagccccattggatcgctgcgtccattatccttgaatttttcctgatggtgctcctgatcccggagcctgaccggcagcgcacaccccaggataaccaactggcctacgtcgtgattgggctcctttttatgatcctgacagttgctgccaatgagatgggactgctcgaaaccacaaagaaagacctgggcattgggcacgtggccgtcgagaaccaccatcacgctgccatgcttgatgtggacctgcatcctgcgagcgcctggacgctctacgctgtcgccaccacaatcattacccccatgatgagacacacaatcgaaaacaccacggctaatatttctctgaccgccatcgcgaaccaggccgctatcctgatgggactcgataagggctggcctatttccaaaatggacatcggcgtgccccttctggccctggggtgctatagccaggttaatccgctcacactgaccgctgccgtgcttatgctggtcgctcattacgccattatcggacctggcctccaagcgaaggccacacgggaggctcagaaacgcaccgccgctgggattatgaagaaccccacggtggatggaatcgttgccatcgacctggatcccgtggtctatgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaattgccgtgtctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcatcatggaggtggaccgctccgaagcgaaagaggggctgaagcggggagagacgacaaaacacgccgtttctagaggcaccgctaaacttcgctggttcgtcgaacggaatctggtgaaacccgaggggaaggtgattgatctcggatgtggcagagggggatggagctactattgcgccggcctgaagaaagtcaccgaagttaagggctacacaaaagggggacctggccacgaggaacccatccctatggctacctacgggtggaacctggtgaagctccattccggaaaagacgtgtttttcattccccctgagaagtgtgatacacttctgtgcgacatcggcgagtctagcccgaatcccacgattgaagaggggcgcaccctgcgggtcctcaaaatggtggaaccttggctgagaggaaaccaattttgtatcaagattcttaatccctatatgccttccgttgtggagacactggagcagatgcagcgcaagcacggcggcatgctcgtccggaaccccctgagcagaaattctacccatgaaatgtactgggtgtcctgcgggacaggaaacatcgttagcgccgtgaatatgacctctcgcatgctgctcaaccggttcacgatggcgcacagaaaaccgacctatgagcgcgatgtcgacctgggcgccgggacaagacacgtggctgtggaacctgaggtcgccaaccttgatatcattggacagcggatcgaaaatattaagcatgagcacaaatccacctggcattacgacgaggataacccctataagacatgggcttaccacggcagctatgaagttaaaccctctgggtccgccagctccatggtgaatggagtggtcaagctgctcaccaagccttgggacgtgatccccatggttacacaaattgctatgaccgatacgacaccttttggccagcagcgcgtgttcaaagagaaggtcgacaccagaaccccgaaagccaagcggggcacagcgcaaatcatggaagtgacggccaaatggctgtgggggtttcttagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggacctggttcatagagaacgggagctccacaaacagggcaagtgcgcgacctgcgtgtacaacatgatggggaaacgcgaaaagaagctgggagagtttggcaaagctaaggggtccagagccatctggtacatgtggctgggcgcccggttcctcgagttcgaagctctgggatttatgaatgaggatcactggttctctcgcgaaaacagcctttccggcgtcgagggggagggactgcataaactcggctatattctgagagacatctctaagattcctgggggaaatatgtacgccgatgacacagctggctgggatacccggatcacagaagacgatcttcagaacgaggcccgcatcaccgacattatggaacccgagcacgcgctgctcgccaaaagcatctttaagctgacgtatcaaaataaagtggtcagagtgcagcggcctgctaagaacgggaccgttatggatgtgatttcccgcagagaccagcggggctctggacaggtcggcacatacgggctgaataccttcacaaacatggaagcccaactcatcagacagatggagagcgagggaatcttttcccccagcgaactggagaccccgaaccttgctaagcgcgtgctggattggctcgaaaaatatggcgtggagcggctgaagagaatggccatctctggggacgactgtgttgtgaaacctatcgatgaccgcttcgcgacggcccttacagctctgaatgatatgggaaaggtccggaaagacattccccagtgggaaccttccaagggctggaacgattggcagcaagtgcccttttgcagccatcacttccaccagctcatcatgaaggacgggagagagattgttgtgccttgtcgcaatcaggatgagctggtcggccgggccagagtgtctcagggagctggctggtccctgcgcgaaaccgcctgcctcgggaaaagctacgctcaaatgtggcagctgatgtattttcatcggagagaccttcgcctggccgcgaacgccatctgttccgctgtccccgtggattggattccgacatctcggaccacgtggagcatccacgcccatcaccagtggatgaccacagaggacatgctctccgtttggaatagagtgtggattgaagagaacccttggatggaagataagacccatatcagctcttggggagacgtcccctacctgggcaaacgggaggaccaatggtgcgggtcccttatcggactgacagccagagctacctgggccacaaatattcaggtggcgatcaaccaggttcgccggctcattggcaatgagaactacctggattatatgaccagcatgaagagattcaaaaatgaatctgaccccgagggggctctgtggtga

SEQ ID NO: 19316 - RNA, 9879 nt, synthetic construct
  misc_feature 1..9879: note = derived and/or modified CDS sequence (opt5) from DENV-1__EU482513__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcctgtgcttctggggagcctgggatgcaagccgctcacgatgtttctgatcgctgagaataaaatttggggccggcgctcttggccccttaacgaaggcatcatggccgtggggatcgtctccattctgctcagctccctgctcaagaacgatgtgcctctggcgggaccccttatcgccggcgggatgctgattgcttgttacgttatcagcggatctagcgccgacctgtccctcgagaaagctgccgaggtgtcttgggaagaggaagccgagcatagcggcgcttcccacaatattctggtcgaagtgcaggatgacgggaccatgaagatcaaagatgaggagagagacgatacacttaccatcctgctcaaggcgacactgctcgccgtttctggagtgtatcctctgagcattcccgctacccttttcgtctggtacttctggcagaagaagaagcagcggtccggcgtgctgtgggacacgccttctcccccggaagtcgagcgcgccgtgctggatgacggcatctatagaattatgcagcgggggctcctgggacgcagccaggttggcgtgggggtctttcaagaaaacgtgttccataccatgtggcacgttacaagaggagccgtgcttatgtaccagggcaaacggctggagccttcctgggctagcgtcaagaaagacctcatctcttacgggggaggctggagactgcagggctcctggaataccggggaggaagtccaggtgattgccgttgagcccggaaagaaccctaaaaatgtccaaacagcgcccggcacctttaagacaccggaaggggaggtgggagctatcgccctcgatttcaagcctggcacgagcgggtctcccattgtgaaccgcgaaggaaaaatcgtcggcctgtatggcaatggggtggttaccacatccggaacctacgtgagcgccatcgctcaggccaaggcgtcccaggagggccctcttcccgagattgaagacgaggtctttcggaaaagaaacctgaccatcatggatctgcaccccgggtctggaaagacacgccggtatctccctgctattgtgagagaagccatcaaacgcaagctgcggacgcttattctggccccgaccagagttgtggctagcgagatggccgaagctctcaagggcatgcccatccgctaccaaacaaccgccgtcaaatccgagcatacagggaaggagatcgtggacctgatgtgccacgcgaccttcacgatgcggctgctcagccctgttagagtgcccaattataacatgattatcatggatgaagcccattttacagacccttcttccattgctgcccggggctacatcagcacccgcgtcggaatgggcgaggctgccgccattttcatgaccgctacaccccctgggtctgtggaagcgtttccgcagagcaatgccgtgatccaggatgaggaaagagacatccccgagcggtcctggaactctggatatgagtggattaccgatttccctggcaaaacagtctggtttgttcccagcatcaagtccgggaatgacattgctaactgtcttcgcaaaaatggaaagagagtgatccagctgtctcggaagaccttcgatacggaataccagaagaccaagaacaacgactgggactacgtggtcaccacagatattagcgagatgggcgccaatttcagagccgaccgcgtgatcgatcctcggagatgcctgaaacccgttattctcaaggacgggccggaacgcgtgatcctggctggccctatgcccgtcaccgtggcctccgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagagcgccgcgattgatggggagtatcgcctgagaggagaggcccggaaaacattcgttgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgtcgagatctggaccaaagagggagaacggaagaaactcagaccccgctggctggacgcccggacatactccgaccctcttgctctgagagagtttaaggagttcgccgctggccgccggtctgtgagcggggatctcatcctggagattggaaaactgccccagcacctcacccagagagcccaaaatgcgcttgacaacctggttatgctgcataattccgaacagggcgggcgggcctatcgccacgctatggaggagctccctgatacaatcgaaaccctgatgcttctggccctcattgctgtgctgacgggaggcgtgacactgtttttcctctctggcagagggcttggaaagaccagcatcggcctgctgtgtgtcatggcctccagcgttctcctgtggatggcctctgtggagccccattggattgctgcgtccatcatccttgaatttttcctgatggtgctcctgattccggagcctgaccggcagcgcacaccccaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcctgcgagcgcctggacgctctacgctgtcgccaccacaattatcacccccatgatgagacacacaattgaaaacaccacggctaatatctctctgaccgccatcgcgaaccaggccgctattctgatgggactcgataagggctggcctatctccaaaatggacattggcgtgccccttctggccctggggtgctatagccaggttaatccgctcacactgaccgctgccgtgcttatgctggtcgctcattacgccatcattggacctggcctccaagcgaaggccacacgggaggctcagaaacgcaccgccgctgggatcatgaagaaccccacggtggatggaatcgttgccattgacctggatcccgtggtctatgacgccaagttcgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttttggaataccacaatcgccgtgtctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcattatggaggtggaccgctccgaagcgaaagaggggctgaagcggggagagacgacaaaacacgccgtttctagaggcaccgctaaacttcgctggttcgtcgaacggaatctggtgaaacccgaggggaaggtgatcgatctcggatgtggcagagggggatggagctactattgcgccggcctgaagaaagtcaccgaagttaagggctacacaaaagggggacctggccacgaggaacccattcctatggctacctacgggtggaacctggtgaagctccattccggaaaagacgtgtttttcattccccctgagaagtgtgatacacttctgtgcgacatcggcgagtctagcccgaatcccacgatcgaagaggggcgcaccctgcgggtcctcaaaatggtggaaccttggctgagaggaaaccaattttgtattaagatccttaatccctatatgccttccgttgtggagacactggagcagatgcagcgcaagcacggcggcatgctcgtccggaaccccctgagcagaaattctacccatgaaatgtactgggtgtcctgcgggacaggaaacatcgttagcgccgtgaatatgacctctcgcatgctgctcaaccggttcacgatggcgcacagaaaaccgacctatgagcgcgatgtcgacctgggcgccgggacaagacacgtggctgtggaacctgaggtcgccaaccttgatattatcggacagcggattgaaaatatcaagcatgagcacaaatccacctggcattacgacgaggataacccctataagacatgggcttaccacggcagctatgaagttaaaccctctgggtccgccagctccatggtgaatggagtggtcaagctgctcaccaagccttgggacgtgattcccatggttacacaaatcgctatgaccgatacgacaccttttggccagcagcgcgtgttcaaagagaaggtcgacaccagaaccccgaaagccaagcggggcacagcgcaaatcatggaagtgacggccaaatggctgtgggggtttcttagcagaaacaagaagccccggatttgtacccgcgaggagttcacaagaaaagttcggtctaatgctgccatcggagctgtgtttgtcgacgagaaccagtggaatagcgccaaggaggccgtggaagatgagcgcttctgggacctggttcatagagaacgggagctccacaaacagggcaagtgcgcgacctgcgtgtacaacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtcgagggggagggactgcataaactcggctatatcctgagagacatttctaagatccctgggggaaatatgtacgccgatgacacagctggctgggatacccggatcacagaagacgatcttcagaacgaggcccgcattaccgacatcatggaacccgagcacgcgctgctcgccaaaagcatttttaagctgacgtatcaaaataaagtggtcagagtgcagcggcctgctaagaacgggaccgttatggatgtgatctcccgcagagaccagcggggctctggacaggtcggcacatacgggctgaataccttcacaaacatggaagcccaactcattagacagatggagagcgagggaatcttttcccccagcgaactggagaccccgaaccttgctgaacgcgtgctggattggctcgagaagtatggcgtggaacggctgaaaagaatggccatctctggggacgactgtgttgtgaagcctattgatgaccgcttcgcgacggcccttacagctctgaatgatatgggaaaagtccggaaggacatcccccagtgggagccttccaaaggctggaacgattggcagcaagtgcccttttgcagccatcacttccaccagctcattatgaaggacgggagagagatcgttgtgccttgtcgcaatcaggatgaactggtcggccgggccagagtgtctcagggagctggctggtccctgcgcgagaccgcctgcctcggaaagagctacgctcaaatgtggcagctgatgtattttcatcggagagaccttcgcctggccgcgaacgccatttgttccgctgtccccgtggattggatcccgacatctcggaccacgtggagcattcacgcccatcaccagtggatgaccacagaagacatgctctccgtttggaatagagtgtggatcgaggaaaacccttggatggaggataaaacccatatcagctcttggggagacgtcccctacctgggcaagcgggaggaccaatggtgcgggtcccttattggactgacagccagagctacctgggccacaaatatccaggtggcgattaaccaggttcgccggctcatcggcaatgaaaactacctggattatatgaccagcatgaaaagattcaagaatgagtctgaccccgaaggggctctgtggtga

SEQ ID NO: 19317 - RNA, 9879 nt, synthetic construct
  misc_feature 1..9879: note = derived and/or modified CDS sequence (opt5) from DENV-1__EU482515__SS-prME
  source 1..9879: mol_type = other RNA
agcgtgaccacactgctcatgctgatgcccacggcccttgctttccacctgaccacccggggaggggaacctcatatgattgtgtccaagcaggaacggggaaaatctctcctgtttaagaccagcgccggcgttaacatgtgcacacttattgcgatggacctgggggaactctgtgaagataccatgacatacaaatgccccagaatcaccgagacggaacccgacgatgtggactgttggtgcaatgctaccgatacatgggtgacctatggaacatgttcccaaaccggcgagcaccggcgggacaagcgctctgtggccctggcccctcatgtggggctgggactcgagacgagaacagaaacctggatgagctccgagggcgcttggaaacagattcagcgggttgaaacatgggccctgcgccaccccggcttcaccgtgatcgctctttttctggcccatgcgattgggacctctatcacacagaagggaatcattttcatcctcctgatgcttgtcacgcctagcatggccatgagatgcgtgggcattgggtcccgggattttgttgagggactgagcggcgctacctgggtggacgtcgtgctcgagcacgggtcttgtgtgacaaccatggccaaggataaacccacactggacatcgaactgctcaagaccgaggtcacgaaccctgctgttctgcgcaaactttgcattgaagccaagatctccaatacaaccaccgatagcagatgtccgacacaaggagaggcgaccctggtggaagaacaggacgccaacttcgtgtgccggcgcacatttgtcgatagaggctggggcaatgggtgtggactcttcggcaaagggtctctgattacgtgcgctaagtttaagtgcgtgaccaaacttgagggaaagatcgttcagtacgaaaacctgaaatattccgtgatcgtcacagtgcacaccggcgaccagcatcaagttgggaatgagagcacagaacacggaaccacggccaccattacaccccaggctcctaccacagagatccagctcaccgactacggcgccctgacgctggattgttctccccggacaggcctcgacttcaacgaaatggtgctgcttaccatgaaggagaaatcctggctggtccataagcagtggtttctcgatctgcctcttccctggacaagcggggcctccacctctcaagagacctggaatcgccaggacctgctcgtgacattcaaaacggctcacgcgaagaagcaggaagtcgtggttctgggaagccaagagggcgccatgcacaccgctctgacaggggccaccgaaattcagacatccggaaccacgacaatctttgccggccatctcaaatgcagactgaagatggataaacttaccctgaaggggatgagctatgtgatgtgtaccggctctttcaaactcgagaaggaactggctgagacacagcacggaaccgtcctggtgcagattaagtacgagggcacagacgccccgtgcaaaatccctttctccacgcaagatgaaaagggggttacccagaacggacggcttatcacagcgaatcccattgtgaccgacaaagagaagcctgtcaacatcgaagctgagccgccctttggcgagagctatattgtgatcggggccggagaaaaagccctcaagctgtcttggttcaagaaaggcagctccattgggaagatgtttgaggctacagccagaggcgctcgccggatggccatcctgggagataccgcgtgggacttcggctctatcgggggagtgtttacgagcgttggcaaactcgtccatcagattttcgggaccgcctacggagtgctgttttccggcgtgagctggacaatgaagatcgggattggcgtccttctgacctggctcggactcaattctagatccacaagcctgtctatgacctgtatcgctgtgggccttgttacactctacctgggggtgatggtccaggccgattccggatgcgtgattaactggaaaggccgcgaactgaagtgtgggagcggaatcttcgttaccaatgaggtgcacacgtggacagaacaatataagtttcaggctgactcccctaaacggctctctgccgcgattggcaaggcctgggaggagggggtctgcggcatcagaagcgctacccgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaatacaacctttatcattgatgggcctaacacgcccgaatgtcctgacgatcagagagcttggaatatctgggaggtggaggactacggattcggcatttttacaaccaacatctggctgaaacttcgcgattcctatacacaggtctgcgaccaccggctcatgagcgcggccattaaagattctaaggctgttcacgccgacatgggctactggatcgaatccgagaaaaatgaaacctggaagctggccagagctagcttcatcgaggtgaagacatgtatttggcccaaatctcataccctgtggtccaacggggtgctcgaaagcgagatgatcattccgaagatctatggaggccctatgtctcaacacaattaccgccccgggtacttcacgcagaccgccggaccttggcatctgggcaaacttgagctggattttgacctctgcgaagggacaaccgtcgtggttgatgagcactgcggaaaccggggccccagcctgagaacaaccacggtgacaggcaagattatccacgaatggtgttgccggtcctgtaccctgcctccccttcgcttcagaggggaggacggatgctggtatggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtccaaaaagatgctgatgacagggacccttgctgtgttctttctgctcatcatgggacagctgacctggaacgatctgattcggctttgcatcatggttggcgccaatgcctctgacagaatgggcatggggacaacgtacctggctctcatggccaccttcaaaatgcgccctatgtttgcggtgggactgctgttcagacggctgacaagccgcgaggtccttctgctcaccattggcctgtccctggtggcttctgtggaacttcccaacagcctggaggaactcggggatggactggccatgggcatcatgatcctcaagctgcttacagactttcaatcccatcagctgtgggccaccctcctgagcctgacgttcattaaaacaaccttttctcttcactatgcttggaagaccatggccatggtcctgtccatcgttagcctcttccccctgtgtctctctacaacctcccagaagacaacgtggctgcctgtgcttctggggagcctgggatgcaaaccgctcaccatgtttctgattgctgagaataagatctggggcagacggtcttggccccttaacgaaggcattatggccgtggggatcgtctccatcctgctcagctccctgctcaaaaacgatgtgcctctggcgggaccccttattgccggcgggatgctgatcgcttgttacgttattagcggatctagcgccgacctgtccctcgagaaggctgccgaggtgtcttgggaagaggaagccgagcatagcggcgcttcccacaatatcctggtcgaagtgcaggatgacgggacaatgaaaattaaggatgaggagcgcgacgatacccttacaatcctgctcaaagcgaccctgctcgccgtttctggagtgtatcctctgagcatccccgctacgcttttcgtctggtacttctggcaaaagaagaaacagagatccggcgtgctgtgggacaccccttctcccccggaagtcgagcgggccgtgctggatgacggcatttatcgcatcatgcagagagggctcctgggacggagccaggttggcgtgggggtctttcaagaaaacgtgttccatacaatgtggcacgttacccgcggagccgtgcttatgtaccagggcaagagactggagccttcctgggctagcgtcaaaaaggacctcatttcttacgggggaggctggcggctgcagggctcctggaatacaggggaggaagtccaggtgatcgccgttgagcccggcaagaaccctaagaatgtccaaaccgcgcccggcacatttaagacgccggaaggggaggtgggagctattgccctcgatttcaaacctggcaccagcgggtctcccatcgtgaacagagaaggaaagattgtcggcctgtatggcaatggggtggttacaacctccggaacctacgtgagcgccatcgctcaggccaaagcgtcccaggagggccctcttcccgagatcgaagacgaggtctttcgcaagcggaacctgacaattatggatctgcaccccgggtctggaaaaacgagacgctatctccctgctatcgtgcgggaagccattaagagaaagctgcgcacccttatcctggccccgacacgggttgtggctagcgagatggccgaagctctcaaaggcatgcccattagataccaaaccacagccgtcaagtccgagcataccgggaaagagatcgtggacctgatgtgccacgcgacgttcacaatgcgcctgctcagccctgttcgggtgcccaattataacatgatcattatggatgaagcccattttaccgacccttcttccatcgctgccagaggctacattagcacccgggtcggaatgggcgaggctgccgccatcttcatgacagctacaccccctgggtctgtggaagcgtttccgcagagcaatgccgtgattcaggatgaggaacgcgacatccccgagagatcctggaactctggatatgagtggatcacagatttccctggcaagaccgtctggtttgttcccagcattaaatccgggaatgacatcgctaactgtcttcggaagaatggaaagcgcgtgattcagctgtctagaaaaacgttcgatacagaataccaaaagaccaaaaacaacgactgggactacgtggtcacaaccgatatcagcgagatgggcgccaatttccgggccgacagagtgattgatcctcgccggtgcctgaagcccgttatcctcaaagacgggccggaaagagtgattctggctggccctatgcccgtcacggtggcctccgcggctcagcgccggggaagaatcggccgcaaccacaataaggagggggatcagtatatctacatgggacagccccttaacaatgacgaggatcatgcccactggaccgaagccaagatgctgctcgacaacattaatacacctgagggcatcattcccgctctgtttgaacctgagcgggaaaagagcgccgcgatcgatggggagtatagactgcgcggagaggccagaaagaccttcgttgagctcatgcggcgcggcgaccttccggtgtggctgtcttacaaagtcgcttccgaggggtttcaatatagcgatagacggtggtgcttcgacggcgaacgcaacaatcaggtgctggaggaaaacatggatgtcgagatttggacaaaggagggagaacgcaagaagctccggcccagatggctggacgcccgcacctactccgaccctcttgctctgcgggagtttaaagagttcgccgctggcagacgctctgtgagcggggatctcatcctggagatcggaaagctgccccagcacctcacacagcgggcccaaaatgcgcttgacaacctggttatgctgcataattccgaacagggcgggagagcctatcggcacgctatggaggagctccctgataccattgaaacgctgatgcttctggccctcatcgctgtgctgacaggaggcgtgaccctgtttttcctctctggccgcgggcttggaaagaccagcattggcctgctgtgtgtcatggcctccagcgttctcctgtggatggcctctgtggagccccattggatcgctgcgtccattatccttgaatttttcctgatggtgctcctgatcccggagcctgacagacagcggacaccccaggataaccaactggcctacgtcgtgattgggctcctttttatgatcctgaccgttgctgccaatgagatgggactgctcgaaacaacgaaaaaggacctgggcattgggcacgtggccgtcgagaaccaccatcacgctgccatgcttgatgtggacctgcatcctgcgagcgcctggaccctctacgctgtcgccacaaccatcattacacccatgatgcgccacaccatcgaaaacacgaccgctaatatttctctgacagccatcgcgaaccaggccgctatcctgatgggactcgataaaggctggcctatttccaagatggacatcggcgtgccccttctggccctggggtgctatagccaggttaatccgctcaccctgacagctgccgtgcttatgctggtcgctcattacgccattatcggacctggcctccaagcgaaagccaccagagaggctcagaagcggacggccgctgggattatgaagaaccccacagtggatggaatcgttgccatcgacctggatcccgtggtctatgacgccaaattcgaaaagcagctgggccagattatgctccttatcctgtgtacctctcaaattctgctcatgcgcacaacctgggcgctgtgcgagagcatcacccttgctacagggcctctgacgaccctctgggagggatccccgggcaaattttggaatacaaccattgccgtgtctatggctaacatcttcagaggcagctacctggccggggccggactggctttctccctcatgaaaagccttggcgggggacggcgcggcacaggggcccagggagaaaccctgggcgagaaatggaagagacagctgaatcagctctccaagtctgaatttaacacgtataaacggagcggcatcatggaggtggacagatccgaagcgaaggaggggctgaaacgcggagagacaaccaagcacgccgtttctcggggcaccgctaaacttagatggttcgtcgaacgcaatctggtgaagcccgaggggaaggtgattgatctcggatgtggcagaggcgggtggagctactattgcgccgggctgaaaaaggtcacagaagttaaaggctacaccaaagggggacctggccacgaggaacccatccctatggctacatacgggtggaacctggtgaaactccattccggaaaggacgtgtttttcattccccctgagaaatgtgatacgcttctgtgcgacatcggcgagtctagcccgaatcccaccattgaagaggggagaacactgcgcgtcctcaagatggtggaaccttggctgcggggaaaccaattttgtatcaagattcttaatccctatatgccttccgttgtggagaccctggagcagatgcagagaaaacacggcggcatgctcgtccgcaaccccctgagcagaaattctacacatgaaatgtactgggtgtcctgcgggaccggaaacatcgttagcgccgtgaatatgacgtctagaatgctgctcaaccgcttcaccatggcgcaccggaagccgacatatgagagagatgtcgacctgggcgccgggacccgccacgtggctgtggaacctgaggtcgccaaccttgatatcattggacagagaatcgaaaatattaaacatgagcacaagtccacatggcattacgacgaggataacccctataaaacctgggcttaccacggcagctatgaagttaagccctctgggtccgccagctccatggtgaatggagtggtcaagctgctcacaaaaccttgggacgtgatccccatggttacccaaattgctatgacggatacaaccccttttggccagcagcgggtgttcaaggagaaagtcgacacccgcacaccgaaggccaaaagaggcacggcgcaaatcatggaagtgaccgccaagtggctgtgggggtttcttagccggaacaagaaacccagaatctgtacacgggaggagttcacccgcaaggttagatctaatgctgccattggagctgtgtttgtcgacgagaaccagtggaatagcgccaaagaggccgtggaagatgagcggttctgggacctggttcatcgcgaaagagagctccacaagcagggcaaatgcgcgacatgcgtgtacaacatgatggggaagcgggaaaagaaactgggagagtttggcaaggctaaagggtcccgcgccatctggtacatgtggctgggcgccagattcctcgagttcgaagctctgggatttatgaatgaggatcactggttctctcgggaaaacagcctttccggcgtcgagggggagggactgcataagctcggctatattctgcgcgacatctctaaaattcctgggggaaatatgtacgccgatgacaccgctggctgggatacaagaatcaccgaagacgatcttcagaacgaggcccggatcacggacattatggaacccgagcacgcgctgctcgccaagagcatctttaaactgacctatcaaaataaggtggtccgcgtgcagagacctgctaagaacgggacagttatggatgtgatttcccggcgcgaccagagaggctctggacaggtcggcacctacgggctgaatacattcaccaacatggaagcccaactcatccggcagatggagagcgagggaatcttttcccccagcgaactggagacgccgaaccttgctaaaagagtgctggattggctcgaaaagtatggcgtggagcgcctgaaacggatggccatctctggggacgactgtgttgtgaagcctatcgatgacagattcgcgacagcccttaccgctctgaatgatatgggaaaagtccgcaaggacattccccagtgggaaccttccaagggctggaacgattggcagcaagtgcccttttgcagccatcacttccaccagctcatcatgaaagacgggcgggagattgttgtgccttgtagaaatcaggatgagctggtcggccgcgcccgggtgtctcagggagctggctggtccctgagagaaacagcctgcctcggaaagagctacgctcaaatgtggcagctgatgtattttcatcgccgggaccttagactggccgcgaacgccatctgttccgctgtccccgtggattggattccgacctctcgcacgacctggagcatccacgcccatcaccagtggatgacaaccgaggacatgctctccgtttggaatcgggtgtggattgaagagaacccttggatggaagataaaacacatatcagctcttggggagacgtcccctacctgggcaagagagaggaccaatggtgcgggtcccttatcggactgaccgcccgggctacatgggccaccaatattcaggtggcgatcaaccaggttagacgcctcattggcaatgagaactacctggattatatgacgagcatgaaacggttcaagaatgaatctgaccccgagggggctctgtggtga

SEQ ID NO: 19318 - RNA, 9879 nt, synthetic construct
  misc_feature 1..9879: note = derived and/or modified CDS sequence (opt5) from DENV-1__EU482516__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacactgtctcttcactatgcttggaaaaccatggccatggttctgtccattgtgagcctctttcccctgtgtctctctaccacatcccagaagaccacatggctgcctgtgcttctggggagcctgggatgcaagccgctcacgatgttcctgatcgctgagaataaaatttggggccggcgctcttggccccttaacgaaggcatcatggccgtcgggatcgtgtccattctgctcagctccctgctcaagaacgatgttcctctggcgggaccccttatcgccggcgggatgctgattgcttgttacgtgatcagcggatctagcgccgacctgtccctcgagaaagctgccgaggtctcttgggaagaggaagccgagcatagcggcgcttcccacaatattctggtggaagttcaggatgacgggaccatgaagatcaaagatgaggagagagacgatacacttaccatcctgctcaaggcgacactgctcgccgtgtctggagtctatcctctgagcattcccgctaccctttttgtgtggtacttctggcagaagaagaagcagcggtccggcgtcctgtgggacacgccttctcccccggaagtgggccgcgccgttctggatgacgggatctatagaattatgcagcggggactcctgggccgcagccaggtgggggtcggagtgttccaagagaacgtttttcataccatgtggcacgtgacaagaggcgccgtccttatgtaccaggggaaacggctggaaccttcctgggctagcgtgaagaaagacctcatctcttacggaggcggctggagactgcaggggtcctggaataccggagaggaggtgcaggttattgccgtcgaacccggcaagaaccctaaaaatgtgcaaacagcgcccgggaccttcaagacaccggagggagaagtgggcgctatcgccctcgattttaagcctgggacgagcggatctcccattgtcaaccgcgagggcaaaatcgtgggcctgtatgggaatggagttgtgaccacatccggcacctacgtcagcgccatcgctcaggccaaggcgtcccaggaagggcctcttcccgagattgaggacgaagtgttccggaaaagaaacctgaccatcatggatctgcaccccggatctggcaagacacgccggtatctccctgctattgttagagaggccatcaaacgcaagctgcggacgcttattctggccccgaccagagtggtcgctagcgaaatggccgaggctctcaaggggatgcccatccgctaccaaacaaccgccgtgaaatccgaacatacaggcaaggagatcgttgacctgatgtgccacgcgacctttacgatgcggctgctcagccctgtgagagtccccaattataacatgattatcatggatgaggcccatttcacagacccttcttccattgctgcccggggatacatcagcacccgcgtgggcatgggggaagctgccgccatttttatgaccgctacaccccctggatctgtggaggcgttcccgcagagcaatgccgtcatccaggatgaagagagagacatccccgaacggtcctggaactctggctatgagtggattaccgattttcctgggaaaacagtttggttcgtgcccagcatcaagtccggaaatgacattgctaactgtcttcgcaaaaatggcaagagagtgatccagctgtctcggaagacctttgatacggagtaccagaaaaccaagaacaacgactgggactacgtcgtgaccacagatattagcgaaatgggggccaatttcagagccgaccgcgttatcgatcctcggagatgcctgaaacccgtgattctcaaggacggcccggagcgcgtcatcctggctggacctatgcccgtgaccgttgcctccgcggctcagcggagaggccgcatcgggcggaaccacaataaagaaggagatcagtatatttacatgggccagccccttaacaatgacgaggatcatgcccactggacggaggccaagatgctgctcgacaacatcaatacccctgaagggattatccccgctctgttcgagcctgaaagagaaaagagcgccgcgattgatggagaatatcgcctgagaggcgaggcccggaaaacatttgtggagctcatgcgcagaggggaccttccggtctggctgtcttacaaggtggcttccgaaggcttccaatatagcgatcggcgctggtgctttgacggagagagaaacaatcaggtcctggaagagaacatggatgtggaaatctggaccaaagagggcgagcggaagaaactcagaccccgctggctggacgcccggacatactccgaccctcttgctctgagagagttcaaggagtttgccgctgggcgccggtctgttagcggagatctcatcctggaaattggcaaactgccccagcacctcacccagagagcccaaaatgcgcttgacaacctggtgatgctgcataattccgagcaagggggacgggcctatcgccacgctatggaggaactccctgatacaatcgagaccctgatgcttctggccctcattgctgtgctgacgggcggcgtcacactgttctttctctctgggagaggacttggcaagaccagcatcgggctgctgtgtgttatggcctccagcgtgctcctgtggatggcctctgtggaaccccattggattgctgcgtccatcatccttgagttctttctgatggtcctcctgattccggaacctgaccggcagcgcacaccccaggataaccaactggcctacgtggttatcggactccttttcatgattctgacagtggctgccaatgagatgggcctgctcgagaccacaaagaaagacctggggatcggacacgtcgccgtggaaaaccaccatcacgctgccatgcttgatgtcgacctgcatcctgcgagcgcctggacgctctacgctgtggccaccacaattatcacccccatgatgagacacacaattgagaacaccacggctaatatctctctgaccgccatcgcgaaccaggccgctattctgatgggcctcgataagggctggcctatctccaaaatggacattggggttccccttctggccctgggatgctatagccaggtgaatccgctcacactgaccgctgccgtccttatgctggtggctcattacgccatcattggccctgggctccaagcgaaggccacacgggaagctcagaaacgcaccgccgctggaatcatgaagaaccccacggttgatggcatcgtggccattgacctggatcccgtcgtgtatgacgccaagtttgagaaacagctggggcagatcatgctccttattctgtgtacatctcaaatcctgctcatgagaaccacatgggcgctgtgcgaaagcattacccttgctaccggacctctgacaacgctctgggagggctccccgggcaagttctggaataccacaatcgccgtgtctatggctaacatctttcgggggagctacctggccggagccggcctggctttctccctcatgaaaagccttgggggaggccgcagagggaccggagcccagggcgagacactgggcgaaaagtggaaacggcagctgaatcagctctccaagtctgagttcaacacctataagagaagcgggattatggaagttgaccgctccgaggcgaaagaaggactgaagcggggcgagacgacaaaacacgccgtctctagagggaccgctaaacttcgctggtttgtggagcggaatctggtgaaacccgaaggaaaggtcatcgatctcggctgtgggagaggaggctggagctactattgcgccggcctgaagaaagttaccgaggtgaaggggtacacaaaaggaggccctgggcacgaggaacccattcctatggctacctacggatggaacctggtgaagctccattccggcaaagacgtcttctttattccccctgaaaagtgtgatacacttctgtgcgacattggggagtctagcccgaatcccacgatcgaggaaggacgcaccctgcgggtgctcaaaatggttgagccttggctgagaggcaaccaattctgtattaagatccttaatccctatatgccttccgtggtcgaaacactggagcagatgcagcgcaagcacggcgggatgctcgtgcggaaccccctgagcagaaattctacccatgagatgtactgggtttcctgcggaacaggcaacatcgtgagcgccgtcaatatgacctctcgcatgctgctcaaccggtttacgatggcgcacagaaaaccgacctatgaacgcgatgtggacctgggggccggaacaagacacgtggctgtcgagcctgaagttgccaaccttgatattatcggccagcggattgagaatatcaagcatgaacacaaatccacctggcattacgacgaggataacccctataagacatgggcttaccacgggagctatgaggtgaaaccctctggatccgccagctccatggtgaatggcgtcgtgaagctgctcaccaagccttgggacgttattcccatggtgacacaaatcgctatgaccgatacgacacctttcggccagcagcgcgtctttaaagaaaaggtggacaccagaaccccgaaagccaagcgggggacagcgcaaatcatggaggttacggccaaatggctgtggggattccttagcagaaacaagaagccccggatttgtacccgcgaagagtttacaagaaaagtgcggtctaatgctgccatcggcgctgtcttcgtggacgaaaaccagtggaatagcgccaaggaggccgttgaggatgaacgcttttgggacctggtgcatagagagcgggaactccacaaacaggggaagtgcgcgacctgcgtctacaacatgatgggaaaacgcgagaagaagctgggcgagttcgggaaagctaagggctccagagccatttggtacatgtggctgggagcccggtttctcgagttcgaggctctgggcttcatgaatgaagatcactggttttctcgcgagaacagcctttccggggtggaaggagagggcctgcataaactcgggtatatcctgagagacatttctaatatccctggaggcaacatgtacgccgatgacacagctgggtgggatacccggatcacagaggacgatcttcagaatgaagcccgcattaccgacatcatggagcccgaacacgcgctgctcgccaagagcattttcaaactgacgtatcaaaacaaggtcgtgagagttcagcggcctgctaaaaatggcaccgtgatggatgtcatctcccgcagagaccagcggggatctggccaggtggggacatacggactgaacacctttacaaacatggaggcccaactcattagacagatggaaagcgagggcatcttctcccccagcgagctggaaaccccgaatcttgctgagcgcgtgctggattggctcgaaaagtatggggttgagcggctgaagagaatggccatctctggagacgactgtgtggtcaaacctattgatgaccgctttgcgacggcccttacagctctgaacgatatgggcaaggtgcggaaagacatcccccagtgggaaccttccaaggggtggaatgattggcagcaagttcccttctgcagccatcactttcaccagctcattatgaaagacggcagagagatcgtggtcccttgtcgcaaccaggatgagctggtgggacgggccagagtctctcagggcgctgggtggtccctgcgcgaaaccgcctgcctcggaaagagctacgctcaaatgtggcagctgatgtatttccatcggagagaccttcgcctggccgcgaatgccatttgttccgctgtgcccgttgattggatcccgacatctcggaccacgtggagcattcacgcccatcaccagtggatgaccacagaggacatgctctccgtgtggaacagagtctggatcgaagagaatccttggatggaagataagacccatatcagctcttggggcgacgtgccctacctggggaaacgggaggaccaatggtgcggatcccttattggcctgacagccagagctacctgggccacaaacatccaggttgcgattaatcaggtgcgccggctcatcgggaacgagaattacctggattatatgaccagcatgaagagatttaaaaacgaatctgaccccgagggcgctctgtggtga

SEQ ID NO: 19319 - RNA, 9879 nt, synthetic construct
  misc_feature 1..9879: note = derived and/or modified CDS sequence (opt5) from DENV-1__EU482517__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagacaagcgccggcgttaacatgtgcacccttatcgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaacacagctcacgcgaaaaagcaggaagtcgtggttctgggaagccaagagggcgccatgcacacggctctgaccggggccacagaaattcagacctccggaacaaccacgatctttgccggccatctcaagtgcagactgaaaatggataaacttacactgaaagggatgagctatgtgatgtgtaccggctctttcaagctcgagaaagaactggctgagacccagcacggaacagtcctggtgcagattaagtacgagggcaccgacgccccgtgcaagatccctttctccacacaagatgaaaaaggggttacgcagaatggacggcttatcaccgcgaaccccattgtgacagacaaggagaaacctgtcaatatcgaagctgagccgccctttggcgagagctatattgtgatcggggccggagaaaaggccctcaaactgtcttggttcaagaagggcagctccattgggaaaatgtttgaggctaccgccagaggcgctcgccggatggccatcctgggagatacagcgtgggacttcggctctatcgggggagtgtttaccagcgttggcaagctcgtccatcagattttcgggacggcctacggagtgctgttttccggcgtgagctggaccatgaaaatcgggattggcgtccttctgacatggctcggactgaactctagatccaccagcctgtctatgacatgtatcgctgtgggccttgttaccctctacctgggggtgatggtccaggccgattccggatgcgtgattaattggaagggccgcgaactgaaatgtgggagcggaatcttcgttacaaacgaggtgcacacctggacggaacaatataagtttcaggctgactcccctaagcggctctctgccgcgattggcaaagcctgggaggagggggtctgcggcatcagaagcgctacacgcctggaaaacatcatgtggaagcagatttccaatgagcttaaccatatcctgctcgaaaatgacatgaaattcaccgtggttgtgggagatgtcgccggcattctggctcaggggaagaaaatgatccggccgcaacccatggagcacaagtactcttggaaaagctggggaaaggccaagattatcggcgccgacgtgcagaacaccacatttatcattgatgggcctaatacccccgaatgtcctgacgatcagagagcttggaacatctgggaggtggaggactatggattcggcatttttacgacaaatatctggctgaaacttcgcgattcctacacccaggtctgcgaccaccggctcatgagcgcggccattaaggattctaaagctgttcatgccgacatgggctattggatcgaatccgagaagaacgaaacatggaaactggccagagctagcttcatcgaggtgaagacctgtatttggcccaagtctcacacactgtggtccaatggggtgctcgaaagcgagatgatcattccgaaaatctacggaggccctatttctcaacataactatcgccccgggtacttcacccagacggccggaccttggcacctgggcaaacttgagctggattttgacctctgcgaagggaccacagtcgtggttgatgagcactgcggaaatcggggccccagcctgagaaccacaaccgtgacgggcaaaatcatccatgaatggtgttgccggtcctgtacactgcctccccttcgcttcagaggggaggacggatgctggtacggcatggagattcggccggtcaaggaaaaagaggaaaacctcgtcaagagcatggtttctgcggggtccggagaggtggacagcttttccctgggcctgctctgtatctctattatgatcgaagaggtcatgagaagccgctggtcccggaagatgctgatgaccgggacacttgctgtgttctttctgctcattatgggacagctgacctggaatgatctgatcagactttgcattatggttggcgccaacgcctctgaccgcatgggcatggggaccacatatctggctctcatggccacgttcaaaatgagacctatgtttgcggtgggactcctgttccggcgcctgaccagcagagaggtccttctgctcacaatcggcctgtccctggtggcttctgtggaacttcccaatagcctggaggaactcggggatggactggccatgggcatcatgattctcaagctgcttaccgactttcaatcccaccagctgtgggccacactcctgagcctgaccttcatcaaaacgacattttctcttcattacgcttggaagaccatggccatggtcctgtccattgttagcctcttccccctgtgtctctctaccacatcccagaaaaccacatggctgcctgtgcttctggggagcctgggatgcaagccgctcacgatgtttctgatcgctgagaacaagatttggggccggcgctcttggccccttaacgaaggcatcatggccgtggggatcgtctccattctgctcagctccctgctcaaaaatgatgtgcctctggcgggaccccttatcgccggcgggatgctgattgcttgttatgttatcagcggatctagcgccgacctgtccctcgagaaggctgccgaggtgtcttgggaagaggaagccgagcacagcggcgcttcccataacattctggtcgaagtgcaggatgacgggaccatgaaaatcaaggatgaggagagagacgatacacttaccatcctgctcaaagcgacactgctcgccgtttctggagtgtaccctctgagcattcccgctacccttttcgtctggtatttctggcaaaagaaaaagcagcggtccggcgtgctgtgggacacgccttctcccccggaagtcgagcgcgccgtgctggatgacggcatctacagaattatgcagcgggggctcctgggacgcagccaggttggcgtgggggtctttcaagaaaatgtgttccacaccatgtggcacgttacaagaggagccgtgcttatgtatcagggcaagcggctggagccttcctgggctagcgtcaaaaaggacctcatctcttacgggggaggctggagactgcagggctcctggaacaccggggaggaagtccaggtgattgccgttgagcccggcaagaatcctaagaacgtccaaacagcgcccggcacctttaaaacaccggaaggggaggtgggagctatcgccctcgatttcaagcctggcacgagcgggtctcccattgtgaatcgcgaaggaaagatcgtcggcctgtacggcaacggggtggttaccacatccggaacctatgtgagcgccatcgctcaggccaaagcgtcccaggagggccctcttcccgagattgaagacgaggtctttcggaagagaaatctgaccatcatggatctgcatcccgggtctggaaaaacacgccggtacctccctgctattgtgagagaagccatcaagcgcaaactgcggacgcttattctggccccgaccagagttgtggctagcgagatggccgaagctctcaagggcatgcccatccgctatcaaacaaccgccgtcaagtccgagcacacagggaaagagatcgtggacctgatgtgccatgcgaccttcacgatgcggctgctcagccctgttagagtgcccaactacaatatgattatcatggatgaagcccactttacagacccttcttccattgctgcccggggctatatcagcacccgcgtcggaatgggcgaggctgccgccattttcatgaccgctacaccccctgggtctgcggaagcctttccgcagagcaacgctgtgatccaggatgaggaaagagacatccccgagcggtcctggaactctggatacgagtggattaccgatttccctggcaagacagtgtggtttgtccccagcatcaaatccgggaacgacattgccaattgtcttcgcaagaacggaaaaagagttatccagctgtctcggaagaccttcgatacggaatatcaaaagaccaagaataatgactgggactacgtggtgaccacagatattagcgagatgggcgccaacttcagagctgaccgcgtcatcgatcctcggagatgcctgaagcccgtgattctcaaagacgggccggaacgcgttatcctggccggccctatgcccgtgaccgtcgcgtccgctgcccagcggagaggacgcatcggccggaatcataacaaggagggggatcagtacatttatatgggacagccccttaataacgacgaggatcacgcccactggacggaagctaaaatgctgctcgacaatatcaacacccctgagggcattatccccgccctgtttgaacctgagagagaaaagagcgcggccattgatggggagtaccgcctgagaggagaggctcggaagacattcgtggaactcatgcgcagaggcgaccttccggtttggctgtcttataaagtggcctccgaggggtttcaatacagcgatcggcgctggtgcttcgacggcgaaagaaataaccaggtcctggaggaaaatatggatgtggagatctggaccaaggagggagaacggaaaaagctcagaccccgctggctggacgctcggacatattccgaccctcttgccctgagagagtttaaagagttcgctgccggccgccggtctgtcagcggggatctcatcctggagattggaaagctgccccagcatctcacccagagagcgcaaaacgcccttgacaatctggtgatgctgcacaactccgaacagggcgggcgggcttaccgccatgccatggaggagctccctgatacaatcgaaaccctgatgcttctggctctcattgccgttctgacgggaggcgtgacactgtttttcctctctggcagagggcttggaaaaaccagcatcggcctgctgtgtgtgatggcctccagcgtcctcctgtggatggcttctgttgagccccactggattgcggcctccatcatccttgaatttttcctgatggtgctcctgattccggagcctgaccggcagcgcacaccccaggataatcaactggcttatgtggtcatcgggctcctttttatgattctgacagtggccgccaacgagatgggactgctcgaaaccacaaagaaggacctgggcatcgggcacgttgctgtggagaaccatcaccatgccgcgatgcttgatgtcgacctgcaccctgccagcgcttggacgctctacgccgtggctaccacaattatcacccccatgatgagacatacaattgaaaataccacggccaacatctctctgaccgcgatcgccaatcaggctgccattctgatgggactcgataaaggctggcctatctccaagatggacattggcgtcccccttctggctctggggtgctacagccaggtgaacccgctcacactgaccgccgctgttcttatgctggtggcccactatgcgatcattggacctggcctccaagccaaagctacacgggaggcccagaagcgcaccgctgccgggatcatgaaaaatcccacggtcgatggaatcgtggccattgacctggatcccgttgtgtacgacgcgaagttcgaaaagcagctgggccagatcatgctccttattctgtgtacatctcaaatcctgctcatgagaaccacatgggctctgtgcgagagcattacccttgccaccgggcctctgacaacgctctgggagggatccccgggcaaattttggaacaccacaatcgctgtctctatggccaatatcttccggggcagctatctggccggggctggactggccttctccctcatgaaaagccttggcgggggacgcagaggcaccggggcgcagggagaaacactgggcgagaaatggaagcggcagctgaaccagctctccaaatctgaatttaatacctacaagagaagcggcattatggaggtggaccgctccgaagccaaggaggggctgaaacggggagagacgacaaagcacgctgtgtctagaggcaccgccaaacttcgctggttcgttgaacggaacctggtcaagcccgaggggaaagtgatcgatctcggatgtggcagagggggatggagctattactgcgctggcctgaagaaggtgaccgaagtcaaaggctatacaaaaggcgggcctgggcatgaggaacccattcctatggccacctacgggtggaatctggttaaactccactccggaaaggacgtgtttttcattccccctgagaaatgtgatacacttctgtgcgacattggcgagtctagcccgaaccccacgatcgaagaggggcgcaccctgcgggtgctcaagatggtcgaaccttggctgagaggaaatcaattttgtattaaaatccttaacccctacatgccttccgtggttgagacactggagcagatgcagcgcaagcatggcggcatgctcgtgcggaatcccctgagcagaaactctacccacgaaatgtattgggtctcctgcgggacaggaaatatcgtgagcgcggttaacatgacctctcgcatgctgctcaaccggttcacgatggcccacagaaagccgacctacgagcgcgatgtggacctgggcgctgggacaagacatgtcgccgtggaacctgaggtggctaatcttgatattatcggacagcggattgaaaacatcaaacacgagcataagtccacctggcactatgacgaggataatccctacaaaacatgggcctatcatggcagctacgaagtcaagccctctgggtccgctagctccatggttaacggagtggtgaaactgctcaccaagccttgggacgtcattcccatggtgacacaaatcgccatgaccgatacgacaccttttggccagcagcgcgttttcaaggagaaagtggacaccagaaccccgaaggcgaaacggggcacagcccaaatcatggaagtcacggctaagtggctgtgggggtttcttagcagaaataaaaagccccggatttgtacccgcgaggagttcacaagaaaggtgcggtctaacgccgctatcggagccgtttttgtggacgagaatcagtggaacagcgccaaagaggcggtcgaagatgagcgcttctgggacctggtgcacagagaacgggagctccacaagcagggcaaatgcgctacctgcgtttataatatgatggggaagcgcgagaagaagctgggagagtttggcaaggccaaagggtccagagccatttggtacatgtggctgggcgctcggttcctcgagttcgaagccctgggatttatgaacgaggatcattggttctctcgcgaaaatagcctttccggcgtggagggggagggactgcacaagctcggctacatcctgagagacatttctaaaatccctgggggaaacatgtatgctgatgacacagccggctgggatacccggatcacagaagacgatcttcagaatgaggcgcgcattaccgacatcatggaacccgagcatgccctgctcgctaagagcatttttaaactgacgtaccaaaacaaggtcgtgagagtccagcggcctgccaaaaatgggaccgtgatggatgttatctcccgcagagaccagcggggctctggacaggtgggcacatatgggctgaacaccttcacaaacatggaagctcaactcattagacagatggatagcgagggaatcttttcccccagcgagctggaaaccccgaatcttgccgagcgcgtcctggactggctcgaaaagtacggcgtggagcggctgaagagaatggcgatctctggggacgattgtgtggttaaacctattgacgatcgcttcgccacggctcttacagccctgaacgacatgggaaaggtgcggaaagatatcccccagtgggaaccttccaagggctggaatgactggcagcaagtccccttttgcagccaccacttccatcagctcattatgaaagatgggagagagatcgtggttccttgtcgcaaccaggacgagctggtgggccgggctagagtctctcagggagccggctggtccctgcgcgaaaccgcttgcctcggaaagagctatgcccaaatgtggcagctgatgtactttcaccggagagatcttcgcctggcggccaatgctatttgttccgccgtgcccgtcgactggatcccgacatctcggaccacgtggagcattcatgcccaccatcagtggatgaccacagaggatatgctctccgtgtggaacagagtttggatcgaagagaatccttggatggaagacaagacccacatcagctcttggggagacgtgccctatctgggcaaacgggaggatcaatggtgcgggtcccttattggactgacagctagagccacctgggcgacaaacatccaggtcgctattaatcaggtgcgccggctcatcggcaacgagaattacctggactacatgaccagcatgaagagattcaaaaacgaatctgatcccgagggggccctgtggtga

SEQ ID NO: 19320 - RNA, 9879 nt, synthetic construct
  misc_feature 1..9879: note = derived and/or modified CDS sequence (opt5) from DENV-1__EU482519__SS-prME
  source 1..9879: mol_type = other RNA
agcgtgaccatgctgctcatgctgatgcccaccgcccttgctttccacctgacgacccggggcggggaacctcatatgatcgtgaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatggccctttttctggcgcatgccatcgggacctccattacccagaagggaatcatcttcattctcctgatgcttgtcacaccttctatggctatgagatgcgtgggcatcgggagccgggattttgttgagggactgtccggcgccacgtgggtggacgtcgtgctcgagcacgggagctgtgtgaccacaatggctaaggataaacccaccctggacattgaactgctcaagacagaggtcaccaaccctgccgttctgcgcaaactttgcatcgaagcgaagatttctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgatcacatgcgccaagtttaagtgcgtcacgaaacttgagggaaaggtggttcagtacgaaaacctgaaatattctgtgattgtcaccgtgcacacaggcgaccagcatcaagttgggaatgagtccaccgaacacggaacaaccgctacgatcacaccccaggcccctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgattcagaacggacggctgatcacagctaatcccatcgtcacggacaaagagaagcctgtgaacattgaagccgagccgccctttggcgagagctatatcgtgattggggttggagaaaaagcccttaagctctcttggttcaagaaaggcagctccatcgggaagatgtttgaggctaccgccagaggcgctcgccggatggccattctgggagatacagcgtgggacttcggctctatcgggggagtctttaccagcgtgggcaaactggtgcatcagatcttcgggacagcctacggagtcctcttttccggcgtgagctggaccatgaagattgggatcggcgttctgcttacgtggctgggactcaattctagatccaccagcctgtctatgacatgtattgctgtgggcctggtcaccctttacctcggggtgatggttcaggccgattccggatgcgtgatcaactggaaaggccgcgaactgaagtgtgggagcggaattttcgtcacaaatgaggtgcacacctggacagaacaatataagtttcaggctgactcccctaaacggctgtctgccgcgatcggcaaggcctgggaggagggggtttgcggcattagaagcgctacccgcctcgaaaacatcatgtggaaacagatctccaacgagctgaatcatattcttctggaaaacgacatgaagttcacggtggtcgtgggagatgtggtcggcatcctcgcccaggggaaaaagatgattcggccgcaacccatggagcacaaatactcttggaaaagctggggaaaggctaagatcattggcgccgacgttcagaatacaacctttatcatcgatgggcctaacacccccgaatgtcctgacgatcagagagcctggaatatttgggaggtggaggactatggattcggcatctttacaaccaacatttggctgaagctgcgcgattcctacacgcaggcttgcgaccaccggcttatgagcgcggccatcaaagattctaaggctgtgcatgccgacatgggctattggattgaatccgagaaaaatgaaacatggaagctcgccagagctagcttcatcgaggtcaagacctgtatctggcccaaatctcacacactgtggtccaacggggtgctggaaagcgagatggttattccgaagatctacggaggccctatttctcaacataattatcgccccgggtacttcacccagacagccggaccttggcacctcggcaaactggagcttgattttgacctgtgcgaagggaccacggtggtcgtggatgagcactgcggaaaccggggccccagcctcagaaccacaaccgttacaggcaagatcattcatgaatggtgttgccggtcctgtaccctgcctcccctgcgcttcaaaggggaggacggatgctggtacggcatggagatcagaccggtgaaggaaaaggaggaaaatcttgtcaaaagcatggtgtctgcggggtccggagaggttgacagcttttccctcggcctgctgtgtatctctattatgatcgaagaggtgatgcggagcagatggtcccgcaagatgctcatgacggggacactggctgtcttccttctgctcattatgggacagctgacctggaacgatctgacacggctttgcatcatggtgggcgccaatgcctctgacagaatgggcatggggaccacctatctggctctcatggccacatttaaaatgcgccctatgttcgcggtgggactgctctttagacggctgacgagccgcgaggtccttctgctcaccattggcctgtccctggttgcttctgtggaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggtgctctccatcgtcagcctgttccccctctgtctgtctaccacctcccagaagacaacctggcttcctgtgctgctggggagcctcggatgcaaaccgctgacaatgtttcttattgctgagaataagatctggggcagaaaatcttggcccctgaacgaaggcattatggccgttggggtggtctccatcctcctgagctccctcctgaagaacgatgtgcctcttgcgggacccctgattgccggcgggatgctgatcgcttgttatgttatcagcggatctagcgccgacctctccctggagaaagctgccgaggtgtcttgggaagaggaagccgagcacagcggcgcttcccataatattcttgtcgaagtgcaggatgacgggacgatgaagatcaaagatgaggagcgggacgataccctgacaattctcctgaaggcgaccctcctggccgtctctggagtgtaccctcttagcatccccgctacactgttcgtttggtatttttggcaaaagaaaaagcagcgctccggcgtgctgtgggacaccccttctcccccggaagtcgagagagccgtgctcgatgacggcatttaccggatcatgcagcgcgggctgcttggaagaagccaggttggcgtgggggtcttccaagaaaacgtgttccacacgatgtggcacgtgacccggggagccgttctgatgtatcagggcaaacgcctcgagccttcctgggctagcgtcaagaaagacctgatctcttacgggggaggctggagactccagggctcctggaatacaggggaggaagtccaggtgattgccgtcgagcccggaaagaaccctaagaatgtgcaaaccgcgcccggcacatttaaaaccccggaaggggaggttggagctatcgccctggatttcaagcctggcacaagcgggtctcccattgtgaaccgggaaggaaaaatcgtcggcctttacggcaatggggtggttacgacctccggaacatatgtgagcgccattgctcaggccaaggcgtcccaggagggccctctgcccgagatcgaagacgaggtctttagaaaacgcaacctgaccattatggatctccatcccgggtctggaaagacccggagatacctgcctgctatcgtgcgcgaagccatcaagcggaaacttagaacactgattctcgccccgacgcgcgttgtggctagcgagatggccgaagctctgaagggcatgcccatccggtatcaaaccacagccgtcaaatccgagcacaccgggaaggagattgtggacctgatgtgccatgcgacattcaccatgagactccttagccctgtgcgcgtccccaattacaacatgatcattatggatgaagcccactttacggacccttcttccatcgctgcccggggctatatcagcacaagagttggaatgggcgaggctgccgccattttcatgaccgctacaccccctgggtctgtggaagcgtttccgcagagcaatgccgtgatccaggatgaggaacgggacattcccgagcgctcctggaactctggatacgagtggatcacagatttccctggcaaaaccgtctggtttgtgcccagcattaagtccgggaatgacatcgctaactgtctgagaaagaatggaaaacgggttatccagctgtctcgcaagacattcgataccgaatatcagaagacgaagaacaacgactgggactacgtggtcacaaccgatattagcgagatgggcgccaattttagagccgaccgggtgatcgatcctagacgctgcctcaaacccgttattctgaaggacgggccggaacgggtgatccttgctggccctatgcccgtcacagtggcctccgcggctcagagacgcggacggattggcagaaaccataataaggagggggatcagtacatctatatgggacagcccctgaacaatgacgaggatcacgcccactggaccgaagccaaaatgctcctggacaacattaatacgcctgagggcatcatccccgctctgttcgaacctgagcgcgaaaagagcgccgcgattgatggggagtaccggctcagaggagaggcccgcaaaaccttcgtcgaacttatgagacggggcgacctgccggtgtggctgtcttataaggttgcttccgaggggtttcaatacagcgatcgcagatggtgcttcgacggcgaacggaacaatcaggtgctcgaggaaaacatggatgtggagatctggacaaaagagggagaacgcaagaaactgagaccccggtggcttgacgccagaacctattccgaccctctggctctccgcgagtttaaggagttcgccgctggccggagatctgtcagcggggatctgattctggagatcggaaagctcccccagcatcttacacagcgcgcccaaaatgcgctggacaacctggttatgctccacaattccgaacagggcgggcgggcctacagacatgctatggaggagctgcctgataccattgaaacacttatgctgctcgccctgatcgctgtgctgaccggaggcgtgacgctctttttcctttctggccgggggctgggaaaaacaagcatcggcctgctctgtgtcatggcctccagcgtgctgctttggatggcctctgttgagccccactggattgctgcgtccatcattctggaatttttcctcatggtgctgctgatcccggagcctgaccgccagagaacaccccaggataaccaactcgcctatgtcgtgattgggcttctgtttatgatcctgaccgtcgctgccaatgagatgggactcctggaaacaaccaagaaagaccttggcatcgggcacgtggccgttgagaaccatcaccatgctacaatgctggatgtggacctccaccctgccagcgcgtggacgctgtacgccgtcgctaccacaattatcacccccatgatgcggcatacaattgaaaacaccacggccaatatctctctgaccgctattgccaaccaggcggccatcctcatgggacttgataagggctggcctatttccaaaatggacatcggcgtgcccctgctggctctcgggtgctacagccaggttaatccgctgacacttaccgccgctgtgctgatgctcgtcgcccactatgctatcattggacctggcctgcaagccaaggcgacacgcgaggcccagaagagaaccgctgccgggatcatgaaaaaccccacggtggatggaattgtggctatcgacctggatcccgttgtctacgacgccaagttcgaaaaacagctcggccagattatgcttctgatcctgtgtacatctcaaatcctcctgatgcggaccacatgggccctttgcgagagcattaccctggcgaccgggcctctcacaacgctgtgggagggatccccgggcaagttttggaataccacaatcgctgtgtctatggccaacattttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatctacaagagaagcggcattatggaggtggaccggtccgaagccaaagaggggcttaagagaggagagaccacgcgccacgcggtctctcggggcacagccaaactgagatggttcgttgaacgcaatctcgtgaagcccgaggggaaggtgatcgatctgggatgtggcagagggggatggagctattactgcgctggcctgaaaaaggtcaccgaagtgaaaggctataccaaagggggacctggccatgaggaacccatccctatggccacatacgggtggaacctcgttaaacttcactccggaaaggacgtgtttttcacaccccctgagaaatgtgatacactgctgtgcgacattggcgagtctagcccgaatcccacgatcgaagaggggagaaccctccgcgtcctgaagatggtggaaccttggcttcggggaaaccaattttgtattaagatcctgaatccctacatgccttccgttgtggagacactcgagcagatgcagagaaaacatggcggcatgctggtccgcaaccccctgagcagaaattctacccacgaaatgtattgggtgtcctgcgggacaggaaacattgtgagcgctgtcaatatgacctctagaatgctcctgaaccgcttcacgatggcccaccggaagccgacctacgagagagatgttgaccttggcgcggggacacgccatgtggccgtggaacctgaggtcgctaacctggatatcattggacagagaatcgaaaatatcaaacacgagcataagtccacctggcactatgacgaggataacccctacaaaacatgggcctatcatggcagctacgaagtgaagccctctgggtccgctagctccatggttaatggagtggtcaagctcctgaccaaaccttgggacgtgattcccatggttacacaaatcgccatgaccgatacgacaccttttggccagcagcgggtgttcaaggagaaagtcgacacccgcaccccgaaggctaaaagaggcacagcccaaattatggaagtgacggcgcggtggctttgggggtttctgagcagaaacaagaagccccggatctgtacccgcgaggagttcacaagaaaagttcggtctaatgccgctattggagccgtgtttgtcgacgagaaccagtggaatagcgctaaggaggccgtggaagatgagcgcttctgggacctcgtccagaaagaaagagagctgcacaagcagggcaaatgcgcgacctgcgtgtataacatgatggggaagcgggaaaagaaactgggagagtttggcaaggcgaaagggtcccgcgctatctggtacatgtggctcggcgccagattcctggagtttgaagcccttggattcatgaatgaggatcactggttctctcgggaaaacagcctgtccggcgttgagggggagggactccataagctgggctacatccttcgcgacatttctaaaatccctgggggaaatatgtatgctgatgacacagccggctgggataccagaattacagaagacgatctgcaaaacgaggctaagatcaccgacattatggaacccgagcacgccctcctggcgacgagcatctttaaactgacctaccagaataaggtggtccgggtgcagcgccctgccaagaacgggacagtgatggatgttatctccagacgggaccagcgcggctctggacaagtgggcacctatgggctcaatacattcaccaacatggaagctcagctgattagacagatggagagcgagggaatctttcttccctccgaactggagacgccgaacctcgccgaacgggtcctggattggcttgagaaacatggcgtggaaagactgaagcgcatggctattagcggggacgactgtgttgtgaaacctatcgatgaccggttcgccacagcgctcaccgccctgaatgatatgggaaaggtcagaaaagacattccccagtgggagccttctaagggctggaacgattggcaacaggtgcccttttgctcccaccacttccatcagctgatcatgaaggacgggcgcgagatcgtcgtgccttgtcggaatcaggatgaactcgttggcagagctcgcgtgagccaaggagccggctggtctctgcgggagacagcttgccttgggaaatcctacgcccagatgtggcagctgatgtattttcacagacgcgacctccggctggctgccaacgcgatttgtagcgccgtccccgtggattgggttccgacctccagaacgacctggtctatccatgctcaccatcaatggatgacaaccgaagacatgcttagcgtgtggaatcgcgtctggattgaggaaaacccttggatggaggataagacacacgtgtccagctggggagacgtgccctacctgggcaaacgggaggaccagtggtgcgggtctctcatcggactgaccgccagagccacatgggcttccaatattcaggttgccatcaaccaggtccggagactgattggcaatgaaaactatctcgattacatgaccagcatgaagcgcttcaaaaatgagggggaccccgaaggcgcgctgtggtga

SEQ ID NO: 19321 - RNA, 9879 nt, synthetic construct
  misc_feature 1..9879: note = derived and/or modified CDS sequence (opt5) from DENV-1__EU482520__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagagcaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattaccccccaggctcctacaaccgagatccagctcacagactacggcgccctgaccctggattgttctccccggacgggcctcgacttcaacgaaatggtgctgcttacaatgcgcgagaagtcctggctggtccataaacagtggtttctcgatctgcctcttccctggaccagcggggcctccacatctcaagagacctggaatagacaggacctgctcgtgaccttcaagacagctcacgcgaaaaagcaggaagtcgtggttctgggaagccaagagggcgccatgcacacggctctgaccggggccacagaaattcagacctccggaacaaccacgatctttgccggccatctcaagtgccggctgaaaatggataagcttacactgaaagggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagcccccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatggacactgcggcaacagaggccccagcctccggaccacaaccgtcacggggaaaatcatccacgagtggtgttgccgctcctgtacactgcctcccctgagattccggggagaagacggctgctggtatgggatggagattagaccggtgaaggagaaagaagagaatcttgttaagagcatggtgtctgcgggatccggcgaagtcgacagcttttccctcgggctgctgtgtatctctattatgatcgaggaagtgatgcgcagccggtggtccagaaagatgctcatgaccggaattctggctgttttctttcttctgatcatgggccagctcacatggaacgatctgattcgcctgtgcatcatggtgggcgccaatgcctctgacagaatggggatgggaaccacctaccttgctctgatggccacattcaaaatgcggcctatgtttgcggtcggcctcctgttccgcagactcacgagccgggaggtgctgcttctgaccatcgggctctccctggtggcttctgtcgagctgcccaacagccttgaagagctgggagatggcctcgccatggggattatgatcctgaagctcctgacagactttcaatcccatcagctttgggccaccctgctcagcctgacattcattaaaaccacgttttctctgcactatgcttggaagacaatggccatggttctttccatcgtgagcctgttccccctctgtctgtctaccacctcccagaaaacaacctggctccctgtgctgcttggaagcctgggctgcaagccgctgacaatgtttctcattgctgaaaataagatctggggccgcagatcttggcccctgaacgaggggatcatggccgtcggaattgtgtccatccttctgagctccctcctgaaaaacgatgttcctctcgcgggccccctgattgccgggggaatgcttatcgcttgttacgtgattagcggctctagcgccgacctgtccctggaaaaggctgccgaggtctcttgggaggaagaggccgaacatagcggggcttcccacaatatcctcgtggaggttcaggatgacggaacgatgaaaatcaaggatgaagagcgggacgataccctgacaattcttctgaaagcgaccctcctggccgtgtctggcgtctatcctctcagcatccccgctacactgttcgtgtggtacttctggcaaaagaaaaagcagcgctccggcgtcctttgggacaccccttctcccccggaggtggggagagccgttctggatgacggaatttatcggatcatgcagcgcggcctgctcgggagaagccaggtgggagtcggcgtgtttcaagaaaacgttttccatacgatgtggcacgtgacccggggggccgtcctgatgtaccagggaaagagacttgagccttcctgggctagcgtgaaaaaggacctgatttcttacggcggcgggtggcgcctccagggatcctggaatacaggcgaagaggtgcaggttatcgccgtcgagcccgggaaaaaccctaagaatgtgcaaaccgcgcccggaacatttaaaaccccggaaggcgaggtgggggctattgccctggatttcaagcctggaacaagcggctctcccatcgtcaaccgggaaggcaagatcgtggggctctatggaaatggcgttgtgacgacctccgggacatacgtcagcgccattgctcaggccaaagcgtcccaggagggacctctgcccgaaatcgaggacgaggtgtttagaaagcgcaaccttaccattatggatctgcaccccggctctgggaaaacccggagatatctgcctgctatcgttcgcgaagccattaagcggaaactcagaacactgatccttgccccgacgcgcgtggtcgctagcgagatggccgaagctctgaagggcatgcccatccggtaccaaaccacagccgtgaagtccgagcataccggaaaagaaattgttgacctcatgtgccacgcgacattcaccatgagactgctgagccctgtgcgggtccccaattataacatgatcattatggatgaggcccattttacggacccttcttccatcgctgcccgcggctacattagcacaagagtggggatgggagaggctgccgccatcttcatgaccgctaccccccctggctctgtggaagcgtttccgcagagcaatgccgtcatccaggatgaggaacgggacattcccgagcgctcctggaactctgggtatgaatggatcacagatttccctggaaagaccgtttggtttgtgcccagcattaaatccggcaatgacatcgctaactgtctcagaaagaatgggaaacgggtgattcagctttctagaaagacattcgataccgagtaccaaaagacgaaaaacaacgactgggactacgtcgtgacaaccgatatcagcgagatgggcgccaatttccgcgccgaccgggttattgatcctagacgctgcctgaagcccgtgatcctgaaagacggaccggaacgggtcatcctcgctggccctatgcccgtgacagttgcctccgcggctcagagacgcgggcggattggaagaaaccacaataaggagggcgatcagtatatctacatggggcagcccctgaacaatgacgaagatcatgcccactggaccgaggccaaaatgcttctggacaacattaatacgcctgagggaatcattcccgctctctttgaacctgagcgcgaaaagagcgccgcgatcgatggcgagtatagactgcggggggaagcccgcaagaccttcgtggagctgatgagacggggcgacctcccggtctggctttcttacaaagtggcttccgagggatttcaatatagcgatcgcagatggtgcttcgacggcgaacggaacaatcaggtcctggaggaaaacatggatgtggagatctggacaaaggaaggggagagaaaaaagctgcgcccccggtggctcgacgccagaacctactccgaccctctggctcttcgcgagtttaaagaattcgccgctggacggagatctgttagcggcgatctgattctcgagatcgggaagctgccccagcacctgacacagcgggcccaaaatgcgctcgacaaccttgtgatgctgcataattccgaacagggaggccgcgcctatagacacgctatggaggaactgcctgataccattgagacactcatgctgcttgccctgatcgctgtgctcaccggcggggtcacgctgtttttcctgtctggacggggcctcgggaaaacaagcattggacttctgtgtgttatggcctccagcgtgctgctctggatggcctctgtggagccccattggatcgctgcgtccatcattctggaatttttccttatggtcctgctcatcccggagcctgaccgccagagaaccccccaggataaccaactggcctacgtggttattggcctgctctttatgatccttaccgtggctgccaatgaaatggggctgctggagacaaccaagaaggacctcggaattggccacgtcgccgtggagaaccaccatcacgctgccatgctggatgtcgaccttcatcctgcgagcgcctggacactgtacgctgtggccacgaccatcattacacccatgatgcggcacaccatcgaaaacacaaccgctaatatctctctcacggccattgcgaaccaggccgctatcctgatgggcctggataaagggtggcctatttccaagatggacatcggagttcccctccttgccctgggctgctatagccaggtgaatccgctgaccctcacagctgccgtcctgatgcttgtggctcattacgccattatcgggcctggactgcaagcgaaagccacccgcgaggctcagaagagaacagccgctggcatcatgaaaaaccccaccgttgatgggattgtggccatcgacctcgatcccgtcgtgtatgacgccaagttcgaaaagcagctgggacagattatgctgctcatcctttgtacgtctcaaattctgctgatgcggacaacctgggcgctctgcgagagcatcacactggctaccggccctcttaccacactgtgggaaggctccccggggaaattttggaatacgaccatcgccgtgtctatggctaacattttccgcggaagctacctcgccggcgccgggctggctttctccctgatgaagagcctcggaggcgggagacggggaacaggcgcccagggcgagacccttggggagaaatggaagagacagctgaatcagctgtccaaatctgaatttaacacatataagcgcagcggaatcatggaggttgaccggtccgaagcgaaggagggcctcaaaagaggggaaaccacgaagcacgccgtctctcgcggaacagctaaactgcggtggttcgtggagagaaatcttgtgaagcccgagggcaaagtcattgatctggggtgtggacgcggcggctggagctactattgcgccgggctcaagaaggttaccgaagtgaaaggatacaccaagggcgggcctggacacgaggaacccatccctatggctacatacggctggaacctggtgaaactgcattccgggaaggacgtctttttcattccccctgagaaatgtgataccctcctttgcgacatcggagaatctagcccgaatcccacaattgaggagggccggacgctgagagtgctgaagatggttgaaccttggctccgcggcaaccaattttgtatcaaaatcctgaatccctatatgccttccgtggtcgagacccttgaacagatgcagcggaagcacgggggaatgctggtgagaaaccccctcagccgcaattctacacatgagatgtactgggtttcctgcggcaccgggaacattgtgagcgccgtcaatatgacatctcggatgctgctgaacagattcaccatggcgcaccgcaagccgacgtatgagagagatgtggacctcggagccggcacccggcacgtggctgtcgaacctgaggttgccaacctggatatcattgggcagcgcatcgaaaatattaaacatgagcacaagtccacatggcattacgacgaagataacccctataaaacctgggcttaccacggaagctatgaggtgaagccctctggctccgccagctccatggtgaatggcgtcgtgaaacttctgacaaagccttgggacgttatccccatggtgacccaaatcgctatgacagataccacgccttttgggcagcagagagtcttcaaggagaaagtggacacacggaccccgaaggccaaaagaggaaccgcgcaaattatggaagttacagccaagtggctctggggctttctgagccggaacaaaaagccccgcatctgtacgagagaggaattcacccggaaggtgcgctctaatgctgccattggggctgtctttgtggacgagaaccagtggaatagcgccaaagaagccgttgaggatgagagattctgggaccttgtgcatcgggaacgcgagctgcacaagcagggaaaatgcgcgacatgcgtctacaacatgatgggcaagagagaaaaaaagctcggggagtttggcaaggctaaaggatcccgggccatctggtacatgtggctgggcgcccgcttcctggaattcgaggctctcgggtttatgaatgaggatcactggttctctagagaaaacagcctgtccggagtggagggcgaagggcttcataagctgggatatattctccgggacatctctaatatccctggcgggaacatgtacgccgatgacaccgctggctgggatacacgcattaccgaggacgatctgcagaatgaggccagaatcacagacattatggaacccgagcacgcgcttctggccaaaagcatctttaagctcacctatcaaaacaaagtcgtgcgggttcagcgccctgctaagaatggaacggtgatggatgtcatttccagacgggaccagagaggctctgggcaggtgggaacctacggcctgaacacattcaccaacatggaagcccaactgatccgccagatggagagcgaagggatcttttcccccagcgagctcgagacaccgaatctggctgaacgggtgcttgattggctggagaaatatggagttgaaagactcaagcgcatggccatttctggcgacgactgtgtggtcaagcctatcgatgaccggttcgcgaccgccctgacggctcttaacgatatggggaaagtgagaaaggacattccccagtgggagccttccaaaggctggaatgattggcagcaagttcccttttgcagccatcacttccaccagctgatcatgaaggacggacgcgaaattgtggtcccttgtcggaaccaggatgagctcgtgggcagagcccgcgtctctcagggggctggatggtccctgcgggagacagcctgcctgggcaaaagctacgctcaaatgtggcagctcatgtattttcatagacgcgacctgcggcttgccgcgaatgccatctgttccgctgtgcccgttgattggattccgacctctagaacaacctggagcatccacgcccatcaccagtggatgacgaccgaagacatgctgtccgtgtggaaccgggtctggatcgaggaaaatccttggatggaggataagacacatattagctcttggggggacgtgccctacctcggaaagagagaagaccaatggtgcggctccctgatcgggcttaccgcccgcgctacatgggccaccaacattcaggttgcgatcaatcaggtgcggagactgattggcaacgagaattacctcgattatatgacaagcatgaaacgcttcaagaacgagtctgaccccgaaggagctctgtggtga

SEQ ID NO: 19322 - RNA, 9879 nt, synthetic construct
  misc_feature 1..9879: note = derived and/or modified CDS sequence (opt5) from DENV-1__EU482521__SS-prME
  source 1..9879: mol_type = other RNA
agcgtgaccatgctgctcatgctgatgcccaccgcccttgctttccacctgacgacccggggcggggaacctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaggacgctaacttcgtgtgccggcgcacatttgtggatagaggctggggcaatgggtgtggactcttcggcaaagggtctctgattacctgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggagaatgtttgaggccacagctcgcggcgcccggagaatggcgatcctgggagataccgcctgggacttcggctctattgggggagtgtttacaagcgttggcaagctggtccatcagatcttcgggaccgcttacggagtgctcttttccggcgtgagctggacgatgaaaattgggatcggcgtcctgcttacctggctgggactcaattctcgctccaccagcttctctatgacctgtattgccgtgggcctggttacactgtaccttggggtgatggtccaggctgattccggatgcgtgatcaactggaagggccgggaactcaaatgtgggagcggaatttttgttaccaatgaggtgcacacatggaccgaacaatataagttccaggccgactcccctaagagactgtctgcggccatcggcaaggcttgggaggagggggtctgcggcatccgcagcgccacgcggctggaaaacattatgtggaagcagatctccaacgagctcaatcatattctgcttgaaaacgacatgaaatttacagtggttgtgggagatgtcgctggcatcctggcccaggggaagaaaatgattagaccgcaacccatggagtacaagtattcttggcgcagctggggaaaagccaagatcatcggcgctgacgtgcagaataccaccttcattatcgatgggcctaacacacccgaatgtcctgacgatcagcgggcgtggaatatttgggaggtggaggactacggatttggcatcttcaccacgaacatttggctcaagctgagagattcctatacacaggtctgcgaccaccgcctgatgagcgccgctatcaaagattctaaggccgttcacgccgacatgggctactggatcgaatccgagaaaaatgaaacctggaaacttgctcgggccagcttcattgaggtgaaaacatgtatctggcccaagtctcataccctctggtccaacggggtgctggaaagcgagatgattatcccgaagatttatggaggccctatctctcaacacaattacagacccgggtactttacacagaccgcgggaccttggcatctgggcaaactcgagctggatttcgacctttgcgaagggacgaccgtcgtggttgatgagcactgcggaaaccggggccccagcctgcgcacaaccacagtgaccggcaagatcattcacgaatggtgttgcagatcctgtacgctccctcccctgcggtttagaggggaggacggatgctggtatggcatggagatccgcccggtcaaagaaaaggaggaaaatctggtgaaaagcatggtttctgctgggtccggagaggtggacagcttctcccttggcctcctgtgtatttctatcatgattgaagaggtcatgcggagcagatggtcccgcaagatgctgatgacagggaccctcgccgtgtttctgcttctgatcatgggacagctcacatggaacgatctgattagactgtgcatcatggttggcgccaatgcttctgaccggatgggcatggggaccacctaccttgccctgatggcgacattcaagatgcgccctatgtttgctgtgggactcctgttcagacggctcacgagccgcgaggtcctgcttctgaccatcggcctctccctggtggcctctgtggaactgcccaacagccttgaggaactgggggatggactcgccatgggcattatgatcctgaaactcctgacagactttcaatcccatcagctttgggctaccctgctcagcctgacattcattaagaccacgttttctctgcactatgcctggaaaacaatggctatggtcctttccatcgttagcctgttccccctctgtctgtctaccacctcccagaagacaacctggctccctgtgctgcttgggagcctgggatgcaaaccgctgacaatgtttctcattgccgagaataagatctggggcagacggtcttggcccctgaacgaaggcatcatggcggtggggattgtctccatccttctgagctccctcctgaagaacgatgtgcctctcgccggacccctgattgctggcgggatgcttatcgcctgttacgttattagcggatctagcgctgacctgtccctggagaaagccgccgaggtgtcttgggaagaggaagctgagcatagcggcgcgtcccacaatatcctcgtcgaagtgcaggatgacgggacgatgaagatcaaagatgaggagcgcgacgataccctgacaattcttctgaaggccaccctcctggctgtttctggagtgtatcctctcagcatccccgccacactgttcgtctggtacatttggcagaagaagaaacagagatccggcgtgctttgggacaccccttctcccccggaagtcgagcgggccgtgctggatgacggcatctatcgcattatgcagagagggctgctcggacggagccaggttggcgtgggggtcttccaagaaaacgtgtttcatacgatgtggcacgttaccagaggagctgtgctgatgtaccagggcaagcgccttgagccttcctgggccagcgtcaagaaagacctgatctcttacgggggaggctggcggctccagggctcctggaatacaggggaggaagtccaagtgattgcggttgagcccggaaagaaccctaaaaatgtccaaaccgctcccggcacattcaagaccccggaaggggaggtgggagccatcgccctggattttaaacctggcacaagcgggtctcccatcgtgaacagagaaggaaagattgtcggcctctatggcaatggggtggttacgacctccggaacatacgtgagcgctatcgcccaggcgaaggcttcccaggagggccctctgcccgagattgaagacgaggtcttccgcaaacggaaccttaccatcatggatctgcaccccgggtctggaaagaccagacgctatctgcctgccattgtgcgggaagccatcaaaagaaagctccgcacactgatccttgctccgacgcgggttgtggccagcgagatggctgaagccctgaaaggcatgcccattagataccaaaccacagcggtcaagtccgagcataccgggaaggagatcgtggacctcatgtgccacgccacatttaccatgcggctgctgagccctgttcgcgtgcccaattataacatgattatcatggatgaagctcatttcacggacccttcttccattgccgctagaggctacatcagcacacgggtcggaatgggcgaggccgccgctatctttatgaccgcgacaccccctgggtctgtggaagccttcccgcagagcaatgctgtgattcaggatgaggaacgcgacatccccgagagatcctggaactctggatatgagtggattacagattttcctggcaaaaccgtctggttcgttcccagcatcaagtccgggaatgacattgccaactgtctccggaaaaatggaaagagagtgatccagctttctcgcaaaacatttgataccgaataccaaaagacgaagaacaacgactgggactacgtggtcacaaccgatattagcgagatgggcgccaatttccgggctgacagagtgatcgatcctcgccggtgcctgaaacccgttatcctgaaggacgggccggaaagagtgattctcgccggccctatgcccgtcacagtggcgtccgctgcccagcgccggggaagaatcggccgcaaccacaataaagagggggatcagtatatttacatgggacagcccctgaacaatgacgaggatcatgcccactggaccgaagctaagatgcttctggacaacatcaatacgcctgagggcattatccccgccctcttcgaacctgagagagagaaaagcgcggccatcgatggggagtatcggctgcgcggagaggctagaaagacctttgttgaactgatgcggcgcggcgacctcccggtgtggctttcttacaaggtcgcctccgaggggttccaatatagcgatagacggtggtgctttgacggcgaaagaaacaatcaggtgctggaggaaaacatggatgtcgagatttggacaaaagagggagaacgcaagaaactgcggcccagatggctcgacgctcgcacctactccgaccctctggcccttcgggagttcaaggaatttgctgccggcagacggtctgtgagcggggatctgatcctcgagattggaaaactgccccagcacctgacacagcgcgcgcaaaatgccctcgacaaccttgttatgctgcataattccgaacagggcgggagagcttatcggcacgccatggaggagctgcctgataccatcgaaacactcatgctgcttgctctgattgccgtgctcaccggaggcgtgacgctgttctttctgtctggccgcgggctcggaaagacaagcatcggccttctgtgtgtcatggcctccagcgttctgctctggatggcttctgtggagccccattggatcgcggcctccattatcctggagttctttcttatggtgctgctcattccggagcctgacagacagcggacaccccaggataaccaactggcttacgtcgtgatcgggctcctgttcatgattcttaccgttgccgccaatgagatgggactgctggaaacaaccaaaaaggacctcggcatcgggcacgtggctgtcggaaaccaccatcacgccgcgatgctggatgtggaccttcatcctgccagcgcttggacactgtacgccgtcgctacgaccattatcacacccatgatgcgccacaccatcgagaacacaaccgccaatatttctctcacggcgatcgccaaccaggctgccattctgatgggcctggataagggctggcctatctccaaaatggacattggggtgcccctccttgctctgggatgctatagccaggttaatccgctgaccctcacagccgctgtgctgatgcttgtcgcccattacgcgatcatcggccctgggctgcaagccaaggctaccagagaagcccagaaacggacagctgccggaattatgaagaaccccaccgtggatggcatcgttgccattgacctcgatcccgtggtctatgacgcgaaatttgagaagcagctggggcagatcatgctgctcattctttgtacgtctcaaatcctgctgatgcgcacaacctgggctctctgcgaaagcatcacactggccaccggacctcttaccacactgtgggagggctccccgggcaagttctggaatacgaccattgctgtgtctatggccaacatctttagagggagctacctcgccggagctggcctggccttctccctgatgaaaagcctcgggggaggccggagagggacaggagcgcagggcgagacccttggcgaaaagtggaaacgccagctgaatcagctgtccaagtctgagttcaacacatataaacggagcgggattatggaagtggacagatccgaggccaaggaaggactcaagcgcggcgagatcaccaaacacgctgtttctcgggggacggccaagctgagatggtttgtcgagcgcaatcttgtgaaacccgaaggaaaggtgattgatctgggctgtgggcggggaggctggagctactattgcgctggcctcaaaaaggtcacagaggttaaggggtacaccaaaggaggccctgggcacgaagaacccatccctatggccacctacggatggaacctggtgaagctgcattccggcaaagacgtgttctttgtgccccctgaaaagtgtgatacactcctttgcgacattggggagtctagcccgaatcccaccatcgaggaaggaagaacactgcgcgtgctgaaaatggttgagccttggctccggggcaaccaattctgtatcaagattctgaatccctatatgccttccgtggtcgaaacgcttgagcagatgcagagaaaacacggcgggatgctggtgcgcaaccccctcagcagaaattctacccatgagatgtactgggtttcctgcggaacaggcaacatcgtgagcgcggtcaatatgacctctagaatgctgctgaaccgctttacaatggcccacagaaagccgacctatgaacgggatgtggacctcggggctggaacgcgccacgtggccgtcgagcctgaagttgctaacctggatattatcggccagagaattgagaatatcaagcatgaacacaaatccacctggcattacgacgaggataacccctataagacatgggcctaccacgggagctatgaggtgaaaccctctggatccgctagctccatggtgaatggcgtcgtgaaacttctgaccaaaccttgggacgttatccccatggtgacacaaattgccatgaccgatacaacccctttcggccagcagcgggtctttaaggaaaaggtggacacgagaacaccgaaagcgaagcgggggaccgcccaaatcatggaggttaccgctaaatggctctggggattcctgagccgcaacaagaaacccagaatttgtacacgggaagagtttacgcgcaaggtgagatctaatgccgctatcggcgccgtcttcgtggacgaaaaccagtggaatagcgccaaggaggcggttgaggatgaacggttttgggaccttgtgcatcgcgagagagaactgcacaaacaggggaagtgcgctacctgcgtctacaacatgatgggaaaacgggagaagaaactcggcgagttcgggaaggccaagggctcccgcgccatttggtacatgtggctgggagctagatttctggagttcgaggccctcggcttcatgaatgaagatcactggttttctcgggagaacagcctgtccggggtggaaggagagggccttcataaactggggtatatcctccgcgacatctctaagattcctggaggcaatatgtacgctgatgacacagccgggtgggataccagaatcacagaggacgatctgcagaacgaagcgcggattaccgacatcatggagcccgaacacgcccttctggctaaaagcattttcaagctcacatatcaaaataaagtcgtgcgcgttcagagacctgccaagaacggcaccgtgatggatgtcatctcccggagagaccagcgcggatctggccaggtggggacgtacggactgaatacctttacaaacatggaggctcaactgatccggcagatggaaagcgagggcattttctcccccagcgagctcgaaaccccgaacctggccgagagagtgcttgattggctggaaaaatatggggttgagcgcctcaagcggatggcgatctctggagacgactgtgtggtcaagcctattgatgacagatttgccacagctctgaccgcccttaatgatatgggcaaagtgcgcaaggacatcccccagtgggaaccttccaaagggtggaacgattggcagcaagttcccttctgcagccatcactttcaccagctgattatgaaggacggccgggagatcgtggtcccttgtagaaatcaggatgagctcgtgggacgcgctcgggtctctcagggcgccgggtggtccctgagagaaacggcttgcctgggaaaaagctacgcccaaatgtggcagctcatgtatttccatcgccgggacctgagacttgcggccaacgctatttgttccgccgtgcccgttgattggatcccgacatctcggaccacatggagcatccacgcccatcaccagtggatgaccacggaggacatgctgtccgtgtggaatagagtctggattgaagagaacccttggatggaagataagacccatatcagctcttggggcgacgtgccctacctcgggaagcgcgaggaccaatggtgcggatccctgattggccttacagctcgggccacctgggcgacaaatatccaggttgctattaaccaggtgagacgcctgatcgggaatgagaactacctcgattatatgaccagcatgaaaagatttaagaatgaatctgaccccgagggcgccctgtggtga

SEQ ID NO: 19323 - RNA, 9879 nt, synthetic construct
  misc_feature 1..9879: note = derived and/or modified CDS sequence (opt5) from DENV-1__EU482523__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttatcgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccgtgctcaccggaggcgtcacgctgtttttcctgtctggccgggggctcggaaaaacaagcatcggccttctgtgtgttatggcctccagcgtgctgctctggatggcttctgtggagccccattggattgcggcctccatcatcctggaatttttccttatggtcctgctcattccggagcctgaccgccagagaacaccccaggataaccaactggcttacgtggttatcgggctgctctttatgattcttaccgtggccgccaatgagatgggactgctggaaacaaccaagaaggacctcggcatcgggcacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatgggactggataaaggctggcctatctccaagatggacattggcgttcccctccttgctctggggtgctatagccaggtgaatccgctgaccctcacagccgctgtcctgatgcttgtggcccattacgcgatcattggacctggcctgcaagccaaagctacccgcgaggcccagaagagaacagctgccgggatcatgaaaaaccccaccgttgatggaatcgtggccattgacctcgatcccgtcgtgtatgacgcgaagttcgaaaagcagctgggccagatcatgctgctcattctttgtacgtctcaaatcctgctgatgcggacaacctgggctctctgcgagagcattacactggccaccgggcctcttaccacactgtgggagggatccccgggcaaattttggaatacgaccatcgctgtgtctatggccaacatcttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcattatggaggttgaccggtccgaagccaaggaggggctcaaaagaggagagaccacgaagcacgctgtctctcgcggcacagccaaactgcggtggttcgtggaaagaaatcttgtgaagcccgaggggaaagtcatcgatctgggatgtggccgcgggggatggagctactattgcgctggcctcaagaaggttaccgaagtgaaaggctacaccaaaggcgggcctgggcacgaggaacccattcctatggccacatacgggtggaacctggtgaaactgcattccggaaaggacgtctttttcattccccctgagaaatgtgataccctcctttgcgacattggcgagtctagcccgaatcccacaatcgaagaggggcggacgctgagagtgctgaagatggttgaaccttggctccgcggaaaccaattttgtattaaaatcctgaatccctatatgccttccgtggtcgagacccttgagcagatgcagcggaagcacggcggcatgctggtgagaaaccccctcagccgcaattctacacatgaaatgtactgggtttcctgcgggaccggaaacatcgtgagcgcggtcaatatgacatctcggatgctgctgaacagattcaccatggcccaccgcaagccgacgtatgagagagatgtggacctcggcgctgggacccggcacgtggccgtcgaacctgaggttgctaacctggatattatcggacagcgcattgaaaatatcaaacatgagcacaagtccacatggcattacgacgaggataacccctataaaacctgggcctaccacggcagctatgaagtgaagccctctgggtccgctagctccatggtgaatggagtcgtgaaacttctgacaaagccttgggacgttattcccatggtgacccaaatcgccatgacagataccacgccttttggccagcagagagtcttcaaggagaaagtggacacacggaccccgaaggcgaaaagaggcaccgcccaaatcatggaagttacagctaagtggctctgggggtttctgagccggaacaaaaagccccgcatttgtacgagagaggagttcacccggaaggtgcgctctaatgccgctatcggagccgtctttgtggacgagaaccagtggaatagcgccaaagaggcggttgaagatgagagattctgggaccttgtgcatcgggaacgcgagctgcacaagcagggcaaatgcgctacatgcgtctacaacatgatggggaagagagagaaaaagctcggagagtttggcaaggccaaagggtcccgggccatttggtacatgtggctgggcgctcgcttcctggagttcgaagccctcggatttatgaatgaggatcactggttctctagagaaaacagcctgtccggcgtggagggggagggacttcataagctgggctatatcctccgggacatttctaaaatccctgggggaaatatgtacgctgatgacaccgccggctgggatacacgcatcaccgaagacgatctgcagaacgaggcgagaattacagacatcatggaacccgagcacgcccttctggctaagagcatttttaaactcacctatcaaaataaggtcgtgcgggttcagcgccctgccaaaaacgggacggtgatggatgtcatctccagacgggaccagagaggctctggacaggtgggcacctacgggctgaatacattcaccaacatggaagctcaactgattcgccagatggagagcgagggaatcttttcccccagcgaactcgagacaccgaacctggccgaacgggtgcttgattggctggagaagtatggcgttgaaagactcaagcgcatggcgatctctggggacgactgtgtggtcaaacctattgatgaccggttcgccaccgctctgacggcccttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagctcgcgtctctcagggagccggctggtccctgcgggagacagcttgcctgggaaagagctacgcccaaatgtggcagctcatgtattttcatagacgcgacctgcggcttgcggccaacgctatttgttccgccgtgcccgttgattggatcccgacctctagaacaacctggagcattcacgcccatcaccagtggatgacgaccgaagacatgctgtccgtgtggaatcgggtctggatcgaggaaaacccttggatggaggataagacacatatcagctcttggggagacgtgccctacctcggcaaaagagaggaccaatggtgcgggtccctgattggacttaccgctcgcgccacatgggcgaccaatatccaggttgctattaaccaggtgcggagactgatcggcaatgaaaactacctcgattatatgacaagcatgaagcgcttcaaaaatgagtctgaccccgaaggggccctgtggtga

SEQ ID NO: 19324 - RNA, 9879 nt, synthetic construct
  misc_feature 1..9879: note = derived and/or modified CDS sequence (opt5) from DENV-1__EU482525__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccaccagcttctctatgacctgtatcgccgttggcctggtgacactgtaccttggggtcatggtgcaggctgattccggatgcgttattaactggaaaggccgcgaactcaagtgtgggagcggaatctttgtgaccaatgaggtccacacatggaccgaacaatataagttccaggccgactcccctaaacggctgtctgcggccattggcaaggcttgggaggagggggtgtgcggcatcagaagcgccacgcgcctggaaaacatcatgtggaaacagatttccaacgagctcaatcatatcctgcttgaaaacgacatgaagctgacagttgtggtcggagatgtggctggcattctcgggcagggcaagaaaatgatccggccgcaacccatggagtacaaatattcttggaaaagctggggcaaggccaagattatcggggccgacgctcagaataccacctttatcattgatggacctaacacacccgaatgtcctgacgatcagagagcgtggaatatctgggaggtggaggactacggcttcggcatttttaccacgaacatctggctgaagctgcgcgattcctatacacaggtctgcgaccaccggcttatgagcgccgctattaaagattctaaggccgttcacgccgacatggggtactggatcgaatccgagaaaaatgaaacctggaagctcgctagagccagcttcatcgaggtgaagacatgtatttggcccaaatctcataccctgtggtccaacggagtgctggaaagcgagatgatcattccgaagatctatggcgggcctatttctcaacacaattaccgccccggatacttcacacagaccgcgggcccttggcatctcgggaaactggagcttgattttgacctgtgcgaaggaacgaccgtcgtggttgatgagcactgcggcaaccggggccccagcctcagaacaaccacagtgaccgggaagatcatccacgaatggtgttgccggtcctgtacgctgcctcccctgcgcttcagaggagaggacggctgctggtatgggatggagattcggccggtcaaagaaaaggaggaaaatcttgtcaagagcatggtttctgctggatccggcgaggtggacagcttttccctcgggctgctgtgtatctctattatgatcgaagaggtcatgagaagccgctggtcccggaaaatgctcatgacaggaaccctggccgtgttctttcttctgattatgggccagctcacatggaacgatctgatcagactgtgcattatggttggcgccaatgcttctgaccgcatggggatgggaaccacctaccttgccctgatggcgacattcaagatgagacctatgtttgctgtgggcctcctgttccggcgcctcacgagcagagaggtcctgcttctgaccatcgggctctccctggtggcctctgtggaactgcccaacagccttgaggaactgggagatggcctcgccatggggatcatgattctgaaactcctgacagactttcaatcccatcagctttgggctaccctgctcagcctgacattcatcaagaccacgttttctctgcactatgcctggaaaacaatggctatggtcctttccattgttagcctgttccccctctgtctgtctaccacctcccagaagacaacctggctccctgtgctgcttggaagcctgggctgcaagccgctgacaatgtttctcatcgccgagaataaaatttggggccggaagtcttggcccctgaacgaagggatcatggcggtgggaatcgtctccattcttctgagctccctcctgaaaaacgatgtgcctctcgccggccccctgatcgctgggggaatgcttattgcctgttacgttatcagcggctctagcgctgacctgtccctggagaaggccgccgaggtgtcttgggaagaggaagctgagcatagcggggcgtcccacaatattctcgtcgaagtgcaggatgacggaacgatgaaaatcaaggatgaggagcgcgacgataccctgacaatccttctgaaagccaccctcctggctgtttctggcgtgtatcctctcagcattcccgccacactgttcgtctggtacttctggcaaaagaagaaacagagatccggcgtgctttgggacaccccttctcccccggaagtcgagcgggccgtgctggatgacgggatctatcgcattatgcagagaggactgctcggccggagccaggttggggtgggagtctttcaagaaaacgtgttccatacgatgtggcacgttacccgcggcgctgtgctgatgtaccaggggaagagacttgagccttcctgggccagcgtcaaaaaggacctgatctcttacggaggcggctggcggctcagagggtcctggaatacaggagaggaagtccaggtgattgcggttgagcccggcaaaaaccctaagaatgtccagaccgctcccgggacatttaagaccccggaaggagaggtgggcgccatcgccctggatttcaaacctgggacaagcggatctcccattgtgaaccgcgaaggcaagatcgtcggcctctatgggaatggagtggttacgacctccggcacatacgtgagcgctatcgcccaagcgaaggcttcccaggaggggcctctgcccgagattgaagacgaggtctttcggaagagaaaccttaccatcatggatctgcaccccggatctggcaaaacccgccggtatctgcctgccattgtgagagaagccatcaagcgcaagctccggacactgattcttgctccgacgagagttgtggccagcgagatggctgaagccctgaaagggatgcccatccgctaccagaccacagcggtcaagtccgagcataccggcaaagagatcgtggacctcatgtgccacgccacattcaccatgcggctgctgagccctgttagagtgcccaattataacatgattatcatggatgaagctcattttacggacccttcttccattgccgctcggggatacatcagcacacgcgtcggcatgggggaggccgccgctattttcatgaccgcgacaccccctggatctgtggaagcctttccgcaaagcaatgctgtgatccaggatgaggaaagagacatccccgagcggtcctggaactctggctatgagtggattacagatttccctgggaagaccgtctggtttgttcccagcatcaaatccggaaatgacattgccaactgtctccgcaagaatggcaagagagtgatccagctttctcggaaaacattcgataccgaataccagaagacgaaaaacaacgactgggactacgtggtcacaaccgatattagcgagatgggggccaatttcagagctgaccgcgtgatcgatcctcggagatgcctgaagcccgttattctgaaagacggcccggaacgcgtgatcctcgccggacctatgcccgtcacagtggcgtccgctgcccaacggagaggccgcatcgggcggaaccacaataaggagggagatcagtatatttacatgggccagcccctgaacaatgacgaggatcatgcccactggaccgaagctaagatgcttctggacaacatcaatacgcctgaggggattatccccgccctctttgaacctgagagagaaaagagcgcggccgttgatggagagtatcgcctgagaggcgaggctcggaagaccttcgtggagctgatgcgcagaggggacctcccggtctggctttcttacaaagtggcctccgagggctttcagtatagcgatcggcgctggtgcttcgacggagaaagaaacaatcaagtcctggaggaaaacatggatgtggagatttggacaaaggagggcgaacggaaaaagctgagaccccgctggctcgacgctcggacctactccgaccctctggcccttagagagtttaaagagttcgctgccgggcgccggtctgttagcggagatctgatcctcgagatcggcaagctgccccagcacctgacacagagagcgcagaatgccctcgacaaccttgtgatgctgcataattccgaacaagggggacgggcttatcgccacgccatggaggagctgcctgataccattgaaacactcatgctgcttgctctgatcgccgtgctcaccggcggcgtcacgctgtttttcctgtctgggagaggactcggcaagacaagcattgggcttctgtgtgttatggcctccagcgtgctgctctggatggcttctgtggagccccattggatcgcggcctccattatcctggaatttttccttatggtcctgctcatcccggagcctgaccggcagcgcacaccccaggataaccagctggcttacgtggttattggactgctctttatgatccttaccgtggccgccaatgagatgggcctgctggaaacaaccaaaaaggacctcgggattggacacgtcgctgtggagaaccaccatcacgccgcgatgctggatgtcgaccttcatcctgccagcgcttggacactgtacgccgtggctacgaccatcattacacccatgatgagacacaccatcgaaaacacaaccgccaatatttctctcacggcgatcgccaaccaagctgccatcctgatgggcctggataaaggctggcctatttccaagatggacatcggggttcccctccttgctctgggatgctatagccaggtgaatccgctgaccctcacagccgctgtcctgatgcttgtggcccattacgcgattatcggccctgggctgcaggccaaagctacccgggaggcccaaaagcgcacagctgccggaattatgaagaaccccaccgttgatggcatcgtggccatcgacctcgatcccgtcgtgtatgacgcgaaattcgaaaagcagctggggcagattatgctgctcatcctttgtacgtctcagattctgctgatgagaacaacctgggctctctgcgagagcatcacactggccaccggacctcttaccacactgtgggagggctccccgggcaaattttggaatacgaccattgctgtgtctatggccaacatcttccgggggagctacctcgccggagctggcctggccttctccctgatgaaaagcctcgggggaggccgcagagggacaggagcgcaaggcgaaacccttggcgagaaatggaagcggcagctgaatcagctgtccaagtctgaatttaacacatataaaagaagcgggatcatggaggttgaccgctccgaagccaaggagggactcaaacggggcgagaccacgaagcacgctgtctctagagggacagccaaactgcgctggttcgtggaacggaatcttgtgaagcccgagggaaaggtcattgatctgggctgtgggagaggaggctggagctactattgcgctggcctcaaaaaggttaccgaagtgaaagggtacaccaagggaggccctgggcacgaggaacccatccctatggccacatacggatggaacctggtgaaactgcattccggcaaggacgtctttttcattccccctgagaaatgtgataccctcctttgcgacatcggggagtctagcccgaatcccacaattgaagagggacgcacgctgcgggtgctgaagatggttgaaccttggctcagaggcaaccagttttgtatcaagattctgaatccctatatgccttccgtggtcgagacccttgagcaaatgcagcgcaaacacggcgggatgctggtgcggaaccccctcagcagaaattctacacatgaaatgtactgggtttcctgcggaaccggcaacatcgtgagcgcggtcaatatgacatctcgcatgctgctgaaccggttcaccatggcccacagaaagccgacgtatgagcgcgatgtggacctcgggaccggaacaagacacgtggctgtcgaacctgaggttgccaacctggatatcattggccagcggatcgaaaatattaaacatgagcacaagtccacctggcattacgacgaggataacccctataaaacatgggcttaccacgggagctatgaagtgaagccctctggatccgccagctccatggtgaatggcgtcgtgaaacttctgaccaaaccttgggacgttatccccatggtgacacagattgctatgaccgatacgacaccttttggccaacagcgcgtcttcaaggagaaagtggacaccagaaccccgaaggccaaacgggggacagcgcagatcatggaagttacggccagatggctctggggatttctgagccggaacaagaagccccgcatctgtaccagagaggagttcacacggaaagtgcgctctaatgctgccattggcgctgtctttgtggacgagaaccaatggaatagcgccaaggaggccgttgaagatgagagattctgggaccttgtgcatcgggaacgcgagctgcacaaacaggggaagtgcgcgacctgcgtctacaacatgatgggaaaaagagaaaagaagctcggcgagtttgggaaagctaagggctcccgggccatctggtacatgtggctgggagcccgcttcctggagttcgaagctctcggctttatgaatgaggatcactggttctctagagaaaacagcctgtccggggtggagggagagggccttcataaactggggtatattctccgggacatctctaagattcctggaggcaatatgtacgccgatgacacagctgggtgggatacccgcatcacagaagacgatctgcagaacgaggccaaaatcaccgacattatggaacccgagcacgcgcttctggccaaggctatctttaaactcacgtatcagaataaggtcgtgagagttcaacggcctgccaagaacggcaccgtgatggatgtcattagccgcagagaccagcggggatccggccaggtggggacatacggactgaataccttcacaaacatggaagctcagctgatcagacaaatggagtctgagggcatttttagcccctccgaactcgagaccccgaacctggccgaacgcgcgcttgattggctggagaaatatgggatcgaacggctcaagagaatggccatcagcggagacgactgtgtggttaaacctattgatgaccgcttcgctacggccctgacagctcttaatgatatgggcaaggtgcggaaagacatcccccagtgggagccttctaaggggtggaacgattggcagcaggtccccttttgctcccatcacttccaccaactgattatgaaggacggcagagagatcgtggttccttgtcgcaatcaggatgaactcgtgggacgggccagagtcagccagggcgctgggtggtctctgcgcgagaccgcctgcctgggaaaatcctacgcgcagatgtggcaactcatgtattttcatcggagagacctgcgccttgccgctaacgccatttgtagcgccgtgcccgtcgattgggtgccgacatcccggaccacgtggtctatccacgctcatcaccagtggatgaccacagaagacatgctgagcgtttggaatagagtgtggattgaggaaaacccttggatggaggataagacccatatctccagctgggaggacgtcccctacctcggcaaacgggaagaccagtggtgcgggtctctgatcggacttacagccagagcgacctgggctacaaatattcaagtggccatcaaccaggttcgccggctgattggcaatgagaactacctcgattatatgacctccatgaagagattcaaaaatgaaacggaccccgagggggccctgtggtga

SEQ ID NO: 19325 - RNA, 9879 nt, synthetic construct
  misc_feature 1..9879: note = derived and/or modified CDS sequence (opt5) from DENV-1__EU482526__SS-prME
  source 1..9879: mol_type = other RNA
agcgtgaccatgctgctcatgctgatgcccaccgcccttgctttccacctgacgacccggggcggggaacctcatatgattgtcaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctggggagcctcggatgcaaaccgctgacaatgtttcttatcgctgagaataagatttggggcagaaaatcttggcccctgaacgaaggcatcatggccgtcggggtggtttccatcctcctgagctccctcctgaagaacgatgtgcctcttgcgggacccctgattgccggcgggatgctgatcgcttgttatgtcattagcggatctagcgccgacctctccctggagaaagctgccgaggtgtcttgggaagaggaagccgagcacagcggcgcttcccataatatccttgttgaagtgcaggatgacgggacgatgaagattaaagatgaggagcgggacgataccctgacaatcctcctgaaggcgaccctcctggccgtctctggagtgtaccctcttagcatccccgctacactgttcgtctggtatttttggcaaaagaaaaagcagcgctccggcgtgctgtgggacaccccttctcccccggaagttgagagagccgtgctcgatgacggcatttaccggatcatgcagcgcgggctgcttggaagaagccaggtcggcgtgggggttttccaagaaaacgtgttccacacgatgtggcacgtcacccggggagccgtgctgatgtatcagggcaaacgcctcgagccttcctgggctagcgtgaagaaagacctgatttcttacgggggaggctggagactccagggctcctggaatacaggggaggaagttcaggtcatcgccgtggagcccggaaagaaccctaagaatgtgcaaaccgcgcccggcacatttaaaaccccggaaggggaggtcggagctattgccctggatttcaagcctggcacaagcgggtctcccatcgtgaaccgggaaggaaaaattgttggcctttacggcaatggggtggtcacgacctccggaacatatgtgagcgccatcgctcaggccaaggcgtcccaggagggccctctgcccgagatcgaagacgaggtttttagaaaacgcaacctgaccattatggatctccatcccgggtctggaaagacccggagatacctgcctgctatcgtgcgcgaagccattaagcggaaacttagaacactgatcctcgccccgacgcgcgtcgtggctagcgagatggccgaagctctgaagggcatgcccattcggtatcaaaccacagccgttaaatccgagcacaccgggaaggagatcgtggacctgatgtgccatgcgacattcaccatgagactccttagccctgtccgcgtgcccaattacaacatgatcattatggatgaagcccactttacggacccttcttccatcgctgcccggggctatattagcacaagagtgggaatgggcgaggctgccgccatcttcatgaccgctacaccccctgggtctgtcgaagcgtttccgcagagcaatgccgttattcaggatgaggaacgggacatccccgagcgctcctggaactctggatacgagtggatcacagatttccctggcaaaaccgtgtggtttgtgcccagcattaagtccgggaatgacatcgctaactgtctgagaaagaatggaaaacgggtcattcagctgtctcgcaagacattcgataccgaatatcagaagacgaagaacaacgactgggactacgtggttacaaccgatatcagcgagatgggcgccaattttagagccgaccgggtgattgatcctagacgctgcctcaaacccgtcatcctgaaggacgggccggaacgggtgattcttgctggccctatgcccgttacagtggcctccgcggctcagagacgcggacggatcggcagaaaccataataaggagggggatcagtacatctatatgggacagcccctgaacaatgacgaggatcacgcccactggaccgaagccaaaatgctcctggacaacattaatacgcctgagggcatcattcccgctctgttcgaacctgagcgcgaaaagagcgccgcgatcgatggggagtaccggctcagaggagaggcccgcaaaaccttcgtcgaacttatgagacggggcgacctgccggtgtggctgtcttataaggtcgcttccgaggggtttcaatacagcgatcgcagatggtgcttcgacggcgaacggaacaatcaggtgctcgaggaaaacatggatgttgagatttggacaaaagagggagaacgcaagaaactgagaccccggtggcttgacgccagaacctattccgaccctctggctctccgcgagtttaaggagttcgccgctggccggagatctgtgagcggggatctgatcctggagatcggaaagctcccccagcatcttacacagcgcgcccaaaatgcgctggacaacctggtgatgctccacaattccgaacagggcgggcgggcctacagacatgctatggaggagctgcctgataccattgaaacacttatgctgctcgccctgatcgctgtcctgaccggaggcgttacgctctttttcctttctggccgggggctgggaaaaacaagcattggcctgctctgtgtgatggcctccagcgtgctgctttggatggcctctgtcgagccccactggatcgctgcgtccattatcctggaatttttcctcatggtgctgctgatcccggagcctgaccgccagagaacaccccaggataaccaactcgcctatgttgtgattgggcttctgtttatgatcctgaccgtcgctgccaatgagatgggactcctggaaacaaccaagaaagaccttggcattgggcacgtggccgtcgagaaccatcaccatgctacaatgctggatgtggacctccaccctgccagcgcgtggacgctgtacgccgttgctaccacaatcattacccccatgatgcggcatacaatcgaaaacaccacggccaatatttctctgaccgctatcgccaaccaggcggccatcctcatgggacttgataagggctggcctatttccaaaatggacatcggcgtgcccctgctggctctcgggtgctacagccaggtcaatccgctgacacttaccgccgctgtgctgatgctcgttgcccactatgctattatcggacctggcctgcaagccaaggcgacacgcgaggcccagaagagaaccgctgccgggattatgaaaaaccccacggtggatggaatcgtcgctatcgacctggatcccgtggtgtacgacgccaagttcgaaaaacagctcggccagattatgcttctgatcctgtgtacatctcaaattctcctgatgcggaccacatgggccctttgcgagagcatcaccctggcgaccgggcctctcacaacgctgtgggagggatccccgggcaagttttggaataccacaattgctgtttctatggccaacatcttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatctacaagagaagcggcattatggaggtcgaccggtccgaagccaaagaggggcttaagagaggagagaccacgcgccacgcggtgtctcggggcacagccaaactgagatggttcgtggaacgcaatctcgtcaagcccgaggggaaggttatcgatctgggatgtggcagagggggatggagctattactgcgctggcctgaaaaaggtgaccgaagtgaaaggctataccaaagggggacctggccatgaggaacccattcctatggccacatacgggtggaacctcgtcaaacttcactccggaaaggacgtgtttttcacaccccctgagaaatgtgatacactgctgtgcgacatcggcgagtctagcccgaatcccacgattgaagaggggagaaccctccgcgttctgaagatggtggaaccttggcttcggggaaaccaattttgtatcaagattctgaatccctacatgccttccgtcgtggagacactcgagcagatgcagagaaaacatggcggcatgctggttcgcaaccccctgagcagaaattctacccacgaaatgtattgggtgtcctgcgggacaggaaacatcgtcagcgctgtgaatatgacctctagaatgctcctgaaccgcttcacgatggcccaccggaagccgacctacgagagagatgtggaccttggcgcggggacacgccatgtcgccgttgaacctgaggtggctaacctggatatcattggacagagaatcgaaaatattaaacacgagcataagtccacctggcactatgacgaggataacccctacaaaacatgggcctatcatggcagctacgaagtgaagccctctgggtccgctagctccatggtcaatggagtggttaagctcctgaccaaaccttgggacgtgatccccatggtcacacaaattgccatgaccgatacgacaccttttggccagcagcgggtgttcaaggagaaagttgacacccgcaccccgaaggctaaaagaggcacagcccaaatcatggaagtgacggcgcggtggctttgggggtttctgagcagaaacaagaagccccggatctgtacccgcgaggagttcacaagaaaagtccggtctaatgccgctattggagccgtgtttgttgacgagaaccagtggaatagcgctaaggaggccgtggaagatgagcgcttctgggacctcgtccagaaagaaagagagctgcacaagcagggcaaatgcgcgacctgcgtgtataacatgatggggaagcgggaaaagaaactgggagagtttggcaaggcgaaagggtcccgcgctatctggtacatgtggctcggcgccagattcctggagtttgaagcccttggattcatgaatgaggatcactggttctctcgggaaaacagcctgtccggcgtcgagggggagggactccataagctgggctacattcttcgcgacatctctaaaattcctgggggaaatatgtatgctgatgacacagccggctgggataccagaatcacagaagacgatctgcaaaacgaggctaagatcaccgacattatggaacccgagcacgccctcctggcgacgagcatctttaaactgacctaccagaataaggtggttcgggtgcagcgccctgccaagaacgggacagtcatggatgtgatttccagacgggaccagcgcggctctggacaagtgggcacctatgggctcaatacattcaccaacatggaagctcagctgatcagacagatggagagcgagggaatcttttcccccagcgaacttgagatcccgaacctggccgaacgggttctcgattggctggagaaatacggcgtggaaagacttaagcgcatggctatctctggggacgactgtgtcgtgaaacctattgatgaccggttcgccacggcgctgacagccctcaatgatatgggaaaggttagaaaagacgtgccccagtgggagccttccaagggctggaacgattggcaacaggtccccttttgcagccatcacttccaccagctgatcatgaaggacgggcgcgagattgtggtcccttgtcggaatcaggatgaactggtgggcagagctcgcgtttctcaaggagccggctggtccctccgggagaccgcttgcctggggaaaagctatgcccagatgtggcagcttatgtactttcatagacgcgacctgcggctcgctgccaacgcgatctgttccgccgtgcccgtcgattgggtgccgacatctagaaccacgtggagcattcacgctcatcaccaatggatgaccacagaagacatgctgtccgtttggaatcgcgtgtggatcgaggaaaacccttggatggaggataagacccatgtcagctcttggggagacgtgccctatcttggcaaacgggaggaccagtggtgcgggtccctgattggactcacagccagagccacctgggctagcaatatccaggtggccatcaaccaggttcggagactgattggcaatgaaaactacctggattacatgacatctatgaagcgcttcaaaaatgagggggaccccgaaggcgcgctctggtga

SEQ ID NO: 19326 - RNA, 9879 nt, synthetic construct
  misc_feature 1..9879: note = derived and/or modified CDS sequence (opt5) from DENV-1__EU482527__SS-prME
  source 1..9879: mol_type = other RNA
agcgtgacaatgctgctgatgctgatgcccacagcccttgctttccacctgacgaccagaggcggggagcctcatatgatcgtctccaagcaggaacggggaaaatctctgctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgggaaaggagtgacccaaaacggccggctgatcacagctaatcccattgtcacggacaaggaaaaacctgtgaacatcgaggccgaaccgcccttcggggagtcttatattgtgatcggagccggcgagaaggctctgaaacttagctggtttaaaaaggggtcctctattggcaaaatgttcgaagccaccgctagaggagcccgccggatggcgatcctcggcgatacagcctgggactttgggagcatcggaggcgttttcacctccgtcgggaagctggtgcatcagatttttggaacagcttacggcgtgctgttcagcggggtctcttggaccatgaaaatcggcattggagtgctcctgacgtggcttggcctcaattccagaagcacctctctctccatgacatgtatcgccgttgggctggtgaccctgtaccttggagtcatggtgcaggctgatagcggctgcgttattaactggaaggggcgcgagctcaagtgtggatccggcatctttgtgacaaatgaagtccacacctggacagagcagtataaattccaagccgactctcctaagcggctgagcgcggccattgggaaggcttgggaagagggcgtgtgcggaatcagatccgccacccgcctggagaacatcatgtggaagcagatttctaacgaactcaatcatatcctgcttgagaacgacatgaaatttacggttgtggtcggcgatgtggctgggattctggcccagggaaagaaaatgatccggccgcagcccatggaatacaagtatagctggaagtcctggggcaaagccaagattatcggggctgacgtgcaaaatacaaccttcatcattgatggacctaacacccccgagtgtcctgacgatcagagagcgtggaatatctgggaagtcgaggactacggctttggcattttcacaaccaacatctggctcaaactgcgcgatagctatacgcaggtttgcgaccaccggctgatgtctgccgctattaaggattccaaagccgtgcacgccgacatggggtactggatcgagagcgaaaagaatgagacatggaaacttgctagagcctctttcatcgaagtgaaaacctgtatttggcccaagtcccatacactctggagcaacggagtcctggagtctgaaatgatcattccgaaaatctatggcgggcctattagccagcacaattaccgccccggatactttacccaaacagcgggcccttggcatctggggaagctcgagctggatttcgacctttgcgagggaaccacggtggttgtggatgaacactgcggcaaccggggcccctccctgagaaccacaaccgtcacagggaaaatcatccacgagtggtgttgccggagctgtaccctccctcccctgcgctttaagggagaagacggctgctggtatgggatggagattagaccggtgaaggagaaagaagagaatctggttaagtctatggtgtccgctggaagcggcgaagtcgactccttctctcttgggctcctgtgtatcagcattatgatcgaggaagtgatgcggtccagatggtctcgcaaaatgctgatgacgggaacactcgccgtctttttcctgcttattatgggccagctgacctggaacgatctcatccggctgtgcattatggtgggcgccaatgctagcgacagaatggggatgggaacaacctacctggcccttatggcgacctttaagatgcgccctatgttcgctgtcggcctgctctttagacggctgacatcccgcgaggtgctcctgcttacgatcgggctgtctctcgtggccttcgtcgagctgcccaacagcctggaggaacttggagatggcctggccatggggatcatgattctcaaactgctcaccgactttcagtcccatcaactgtgggctacacttctgagcctcaccttcatcaagacaaccttttctctgcactatgcctggaagacgatggctatggttctgtccattgtgagccttttccccctgtgtctctctacaacctcccagaaaaccacatggctgcctgtgctcctgggaagccttggctgcaagccgctgaccatgttcctgatcgccgaaaataaaatttggggcagaaagtcttggcccctcaacgaggggatcatggcggtcggaatcgtgtccattctgcttagctccctgctcaaaaacgatgttcctctggccggccccctcatcgctgggggaatgctgattgcctgttacgtgatcagcggctctagcgctgacctttccctggaaaaggccgccgaggtctcttgggaggaagaggctgaacatagcggggcgtcccacaatattctggtggaggttcaggatgacggaacaatgaaaatcaaggatgaggaacgggacgatacgctcaccatcctgcttaaggccacactgctcgctgtgtctggcgtctatcctctgagcattcccgccaccctctttgtgtggtacttctggcagaaaaagaaacaacgctccggcgtcctgtgggacacaccttctcccccggaggtggaaagagccgttcttgatgacgggatctatcggattatgcagcgcggactgctgggcagaagccaggtgggggtcggagtgtttcaggagaacgttttccataccatgtggcacgtgacgcggggcgctgtcctcatgtaccaagggaagcgcctggaaccttcctgggccagcgtgaaaaaggaccttatctcttacggaggcggctggagactgcaggggtcctggaataccggagaggaggtgcaggttattgcggtcgaacccggcaagaaccctaaaaatgtgcagacagctcccgggacctttaagacaagcgagggagaagtgggcgccatcgccctcgatttcaaaccggggacctctggatcccctattgtcaaccgggagggcaagatcgtgggcctgtatgggaatggagttgtgacaacgagcggcacctacgtctccgctatcgcccaagcgaaggcttctcaggaagggcccctccctgagattgaggacgaagtgtttagaaagcgcaacctgacaatcatggatcttcaccccggaagcggcaagacccggagatatctgcccgccattgttcgcgaggccatcaaacggaagctgagaaccctcattctggctcctacacgcgtggtcgcctccgaaatggctgaggcccttaaagggatgccgatccggtaccagacgaccgcggtgaagtccgaacatacaggcaaagagatcgttgacctgatgtgccacgccaccttcacaatgagactcctgtctcccgtgcgcgtccctaattataacatgattatcatggatgaggctcattttaccgacccctccagcattgccgctcggggatacatctctacgagagtgggcatgggggaagccgccgctattttcatgacagcgacccctcccggaagcgtggaggcctttcctcaatccaatgctgtcatccaggatgaggaacgggacatcccggaacgctcttggaacagcggctatgagtggattaccgatttccccgggaagacagtttggttcgtgccttccatcaagtctggaaatgacattgccaactgtctgcgcaagaatggcaagcgggtgatccagctcagccgcaaaacctttgatacagagtaccagaagaccaaaaacaacgactgggactacgtcgtgacgacagatatttccgaaatgggggccaatttcagagctgaccgggttatcgatcccagacgctgccttaagcctgtgattctgaaggacggccccgagcgggtcatcctggccggaccgatgcctgtgaccgttgcgagcgctgcccaaagacgcggccggatcgggagaaaccacaataaagaaggagatcagtatatttacatgggccagcccctcaacaatgacgaggatcatgcccactggacagaggctaagatgctgcttgacaacatcaatacccccgaagggattatccctgccctgtttgagcccgaacgcgagaaatctgcggccattgatggagaatatcggctcagaggcgaggctcgcaagacgttcgtggagctgatgagaagaggggacctgcctgtctggctctcctacaaagtggccagcgaaggctttcagtattccgatcgcagatggtgcttcgacggagagcggaacaatcaagtccttgaagagaacatggatgtggaaatctggaccaaggagggcgagcgcaaaaagctgagaccgcggtggctggacgctagaacatactctgaccccctcgccctgcgcgaatttaaggagttcgctgccgggcggagaagcgtttccggagatcttatcctggaaattggcaaactccctcagcacctgacccagcgcgcgcagaatgccctggacaacctcgtgatgcttcataattctgagcaagggggacgggcttatagacacgccatggaggaactgcccgatacaatcgagaccctgatgctcctggctcttattgccgtgctgacaggcggcgtcaccctctttttcctgagcgggcggggactgggcaagacgtccatcgggctcctttgtgttatggccagctctgtgctgctgtggatggcttccgtggaacctcattggattgcggccagcatcatcctcgagtttttcctgatggtccttctgattcccgaaccggaccgccagagaacacctcaggataaccagctcgcttacgtggttatcggactgctgtttatgattctcaccgtggccgccaatgagatgggccttctggagaccaccaaaaaggacctggggatcggacacgtcgctgtggaaaaccaccatcacgccgcgatgctcgatgtcgacctgcatcccgcctctgcttggaccctttacgccgtggctacaacgattatcacccctatgatgcggcacacaattgagaacaccacagccaatatctccctgaccgcgatcgccaaccaagctgccattctcatgggcctggataaaggctggcccatcagcaagatggacattggggttcctctgctcgctcttggatgctattctcaggtgaatcccctgacgctgaccgccgctgtcctcatgctggtggcccattacgcgatcattggcccggggcttcaggccaaggctacacgcgaagcccagaaacggaccgctgccggaatcatgaagaaccctacagttgatggcatcgtggccattgacctggatcccgtcgtgtatgacgcgaaattcgagaagcagctcgggcagatcatgctgctgattctctgtaccagccagatccttctgatgcggacgacatgggctctgtgcgaatccattaccctcgccacaggacccctgaccaccctttgggagggctctcctggcaaattctggaatacaacgatcgctgtgagcatggccaacatctttcgcgggtcctacctggccggagctggcctcgccttcagcctgatgaagtccctcgggggcgggagacgggggaccggagcgcaaggcgagacactcggcgaaaagtggaaacgccagcttaatcagctgtctaagagcgagtttaacacctataaaagatccgggattatggaagttgaccggtctgaggccaaggaaggactgaaaagaggcgagacaaccaagcacgctgtcagccgcgggacggccaagctccggtggttcgtggagagaaatctggtgaaaccggaaggaaaggtcatcgatcttggctgtgggcgcggaggctggtcctactattgcgctggcctgaaaaaggttacagaggtgaaagggtacaccaagggaggccccgggcacgaggaacctattcccatggccacctacggatggaacctcgtgaaactgcattctggcaaggacgtctttttcatccctcccgaaaagtgtgatacactgctctgcgacattggggagagctcccctaatccgaccatcgaggaaggacggacacttagagtgctgaaaatggttgagccctggctgcgcggcaaccagttttgtattaagatcctcaatccttatatgcccagcgtggtcgaaacgctggagcaaatgcagcggaaacacggcgggatgcttgtgagaaaccctctgtctcgcaattccacccatgagatgtactgggttagctgcggaacaggcaacatcgtgtctgcggtcaatatgacctcccggatgctcctgaacagattcacaatggcccaccgcaagcccacctatgaacgggatgtggacctgggggctggaacgagacacgtggccgtcgagccggaagttgctaacctcgatattatcggccagcgcattgagaatatcaaacatgaacacaagagcacctggcattacgacgaggataacccttataagacatgggcctaccacgggtcttatgaggtgaaaccctccggaagcgcttccagcatggtgaatggcgtcgtgaagctgcttaccaaaccctgggacgttattcctatggtgacacagatcgccatgaccgatacaaccccctttggccaacagagagtcttcaaggaaaaagtggacacgcggacacctaaggcgaagcgcgggaccgcccagatcatggaggttaccgctaaatggctgtggggatttctctctagaaacaagaaaccgcggatttgtacaagagaagagttcacgcggaaggtgcgcagcaatgccgctatcggcgccgtctttgtggacgaaaaccaatggaactccgccaaagaggcggttgaggatgaaagattctgggacctggtgcatcgggagcgcgaacttcacaagcaggggaagtgcgctacctgcgtctacaacatgatgggaaaaagagagaagaaactgggcgagttcgggaaggccaaaggctctcgggccatttggtacatgtggctcggagctcgctttctggagttcgaggccctgggctttatgaatgaagatcactggttcagcagagagaactccctctctggggtggaaggagagggcctgcataaacttgggtatatcctgcgggacattagcaaaatccccggaggcaatatgtacgctgatgacacagccgggtgggatacccgcatcacagaggacgatctccagaacgaagcgaagattaccgacatcatggagcctgaacacgccctgcttgctaagtccatttttaaactgacatatcagaataaggtcgtgagagttcaacggcccgccaaaaacggcaccgtgatggatgtcatctctcgcagagaccagcggggaagcggccaggtggggacgtacggactcaataccttcacaaacatggaggctcagctgattcgccaaatggaatccgagggcatctttagcccttctgagctggaaacccccaacctcgccgggagagtgctggattggcttgagaagcatggagttgaacggctgaaaagaatggcgatctccggcgacgactgtgtggtcaagccgattgatgaccgcttcgccacagctctcaccgccctgaatgatatggggaaggtgcggaaagacatccctcagtgggagcccagcaagggctggaacgattggcagcaggttcctttttgctctcaccacttccatcaacttattatgaaagacggaagagaaatcgtggtcccctgtcgcaatcaggatgagctggtgggccgggctagagtctcccagggggccggatggagcctccgcgagacggcttgcctgggcaagtcctatgcccagatgtggcaactgatgtactttcaccggagagacctccgcctggcggccaacgctatttgttctgccgtgcctgttgattgggtgcccacaagccggaccacatggtccatccatgcccaccatcagtggatgaccacggaagacatgcttagcgtctggaatagagtgtggattgaggaaaacccgtggatggaggataaaacccacatctcttcctggggagacgttccttatctgggaaagcgcgaagaccagtggtgcggcagcctcatcgggctgacagctcgggccacctgggcgacaaatattcaagtggctatcaaccaggtcagacggcttattggcaatgagaactacctggattacatgacctctatgaagagattcaaaaatgagagcgaccccgaaggagccctctggtga

SEQ ID NO: 19327 - RNA, 9879 nt, synthetic construct
  misc_feature 1..9879: note = derived and/or modified CDS sequence (opt5) from DENV-1__EU482528__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacggggaaagtctctcctgtttaagacaagcgccggcgttaatatgtgcacccttattgcgatggacctgggggagttctgtgaagatacaatgacctacaagtgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggctatggtccaggccgatagcggatgcgtgatcaactggaagggccgcgaactcaagtgtgggtccggaatttttgttaccaatgaggtgcacacatggaccgaacagtataaattccaagcggactctcctaagcggctgagcgccgctatcggcaaagcctgggaggagggggtctgcggcattagatccgctacgcgcctggaaaacatcatgtggaagcagatctctaacgagctcaatcatattctgcttgaaaacgacatgaaatttacagtggttgtgggagatgtcgccggcatcctggcccaggggaagaaaatgattcggccgcagcccatggagtacaagcacagctggaagtcctggggaaaagctaagatcattggcgcggacgtgcaaaataccaccttcatcatcgatgggcctaacacacccgaatgtcctgacgatcagagagcctggaatatttgggaggtggaggactatggatttggcatcttcaccacgaacatttggctcaaactgcgcgatagctacacacaggtctgcgaccaccggctgatgtctgctgccatcaaggattccaaagccgttcatgctgacatgggctattggattgaaagcgagaagaatgaaacctggaaacttgccagagcgtctttcatcgaggtgaaaacatgtatctggcccaagtcccacaccctctggagcaacggggtgctggaatctgagatgattatcccgaaaatttacggaggccctatcagccagcataattatcgccccgggtactttacacaaaccgctggaccttggcacctgggcaagctcgagctggatttcgacctttgcgaagggacgaccgtcgtggttgatgagcactgcggaaaccggggcccctccctgagaacaaccacagtgaccggcaaaattatccatgaatggtgttgccggagctgtacgctccctcccctgcgctttaagggggaggacggatgctggtacggcatggagatcagaccggtcaaggaaaaagaggaaaatctggtgaagtctatggtttccgccgggagcggagaggtggactccttctctcttggcctcctgtgtattagcatcatgattgaagaggtcatgcggtccagatggtctcgcaaaatgctgatgacagggaccctcgccgtgtttttcctgcttatcatgggacagctgacatggaacgatctcattcggctgtgcatcatggttggcgctaatgccagcgacagaatgggcatggggaccacctatctggcgcttatggctacatttaagatgcgccctatgttcgccgtgggactgctctttagacggctgacgtcccgcgaggtcctcctgcttaccattggcctgtctctcgtggccagcgtggaactgcccaactccctggaggaacttggggatggactggctatgggcatcatgatcctcaaactgctcacagacttccagagccaccaactgtgggccacccttctgtctctcacatttattaagaccacgttctccctgcattacgcttggaagacaatggccatggtcctgagcatcgtttctctttttcccctgtgtctctccaccaccagccagaaaacaacctggctgcctgtgctcctggggtctcttggatgcaagccgctgacaatgttcctgattgcggagaataaaatctggggcagaaagtcctggcccctcaacgaaggcattatggccgtggggatcgtcagcatcctgctttccagcctgctcaaaaacgatgtgcctctggctggacccctcattgccggcgggatgctgatcgcttgttatgttatttctggaagctccgccgacctttctctggagaaggccgctgaggtgagctgggaagaggaagcggagcactccggcgcctctcataatatcctggtcgaagtgcaggatgacgggacgatgaaaattaaggatgaggagcgggacgataccctcacaatcctgcttaaggctaccctgctcgccgttagcggagtgtaccctctgtccatccccgccacactcttcgtctggtatttttggcagaaaaagaaacaacgctctggcgtgctgtgggacaccccttcccctcccgaagtcgagagagctgtgcttgatgacggcatttaccggatcatgcagcgcgggctgctgggaagatcccaggttggcgtgggggtcttccaggaaaacgtgtttcacacgatgtggcacgttacccggggagccgtgctcatgtatcaaggcaagcgcctggagcccagctgggcgtctgtcaaaaaggaccttatttcctacgggggaggctggagactgcagggcagctggaatacaggggaggaagtccaggtgatcgctgttgagcccggaaagaaccctaaaaatgtccagaccgcccccggcacattcaagacctctgaaggggaggtgggagccattgctctcgattttaaaccgggcacatccgggagccctatcgtgaaccgggaaggaaagattgtcggcctgtacggcaatggggtggttacgacctccggaacatatgtgtctgccatcgcgcaagctaaagccagccaggagggccccctccctgagatcgaagacgaggtcttcagaaagcgcaacctgaccattatggatcttcatcccgggtccggaaagacccggagatacctgcccgccatcgtgcgcgaagctattaaacggaagctgagaacactcatcctggcccctacgcgcgttgtggctagcgagatggccgaagcgcttaaaggcatgccgattcggtatcagaccacagccgtcaagtctgagcacaccgggaaagagatcgtggacctgatgtgccatgctacatttaccatgagactcctgtcccccgttcgcgtgcctaattacaacatgatcattatggatgaagcccacttcacggaccccagctctatcgctgcccggggctatattagcacaagagtcggaatgggcgaggccgctgcgatctttatgaccgccacccctcccgggtccgtggaggctttccctcaatctaatgccgtgattcaggatgaagaacgggacatcccggagcgcagctggaactccggatacgagtggatcacagattttcccggcaagaccgtctggttcgttccttctattaagagcgggaatgacatcgccaactgtctgcgcaagaatggaaagcgggtgattcagctctcccgcaaaacattcgataccgaatatcagaagacgaaaaacaacgactgggactacgtggtcacaaccgatatcagcgagatgggcgctaattttagagccgaccgggtgattgatcccagacgctgccttaagcctgttatcctgaaggacgggcccgaacgggtgattctggcgggcccgatgcctgtcacagtggcttctgccgcccaaagacgcggacggatcggcagaaaccataataaagagggggatcagtacatctatatgggacagcccctcaacaatgacgaggatcacgctcactggaccgaagccaagatgctgcttgacaacattaatacgcccgagggcatcattcctgcgctgttcgaacccgagcgcgaaaaatccgccgctatcgatggggagtaccggctcagaggagaggcccgcaagacctttgttgaactgatgagacggggcgacctgcctgtgtggctcagctataaagtcgcttccgaggggttccagtactctgatcgcagatggtgctttgacggcgaacggaacaatcaagtgcttgaggaaaacatggatgtcgagatttggacaaaggagggagaacgcaaaaagctgagaccgcggtggctggacgccagaacctatagcgaccccctcgctctgcgcgagttcaaggaatttgccgcgggccggagatccgtgtctggggatcttatcctggagatcggaaaactccctcagcatctgacacagcgcgcccagaatgctctggacaacctcgttatgcttcacaatagcgaacaaggcgggcgggcctacagacatgctatggaggagctgcccgataccattgaaacactgatgctcctggcccttatcgccgtgctgaccggaggcgtgacgctgttctttctgtccggccgggggctgggaaagacaagcattggcctcctttgtgtcatggcttcttccgttctgctgtggatggcgagcgtggagcctcactggatcgccgcttctattatcctcgagttctttctgatggtgcttctgatccccgagccggaccgccagagaacccctcaggataaccagctcgcctatgtcgtgattgggctgctgttcatgatcctcaccgttgccgctaatgagatgggacttctggaaacaaccaaaaaggacctgggcattgggcacgtggccgtcgagaaccatcaccatgcggccatgctcgatgtggacctgcaccccgcttccgcctggacactttacgctgtcgccacgaccatcattacacctatgatgcggcataccatcgaaaacacaaccgcgaatattagcctgacggccatcgctaaccaagccgctatcctcatgggactggataaaggctggcccatttctaagatggacatcggcgtgcctctgctcgcccttgggtgctacagccaggttaatcccctgaccctgacagctgccgtgctcatgctggtcgcgcactatgccattatcggaccgggccttcaggctaaggccacccgcgaggctcagaagagaacagccgccgggattatgaagaaccctaccgtggatggaatcgttgcgatcgacctggatcccgtggtctacgacgctaaatttgaaaagcagctcggccagattatgctgctgatcctctgtacgtcccagattcttctgatgcggacaacctgggccctgtgcgagtctatcacactcgctaccgggcccctgaccacactttgggagggaagccctggcaaattctggaatacgaccattgccgtgtccatggccaacatcttccgcggcagctatctggctggggccggactcgcgttttccctgatgaagtctctgggcgggggaagacggggcacaggggcccaaggagaaaccctcggcgagaagtggaaacgccagcttaatcagctgagcaagtccgagttcaacacatacaaaagatctggcatcatggaggtggaccggagcgaagctaaggaggggctgaaaagaggagagaccacgaagcacgccgtttcccgcggcacagctaagctccggtggtttgtcgaaagaaatctggtgaaaccggaggggaaggtgattgatcttggatgtggccgcgggggatggtcttattactgcgccggcctgaaaaaggtcaccgaagttaaaggctataccaaaggcgggcccgggcatgaggaacctatccccatggcgacatacgggtggaacctcgtgaaactgcacagcggaaaggacgtgttctttattcctcccgagaagtgtgataccctgctctgcgacatcggcgagtccagccctaatccgacaattgaagaggggcggacgcttagagtcctgaaaatggtggaaccctggctgcgcggaaaccagttctgtatcaagattctcaatccttacatgccctctgttgtggagaccctggagcaaatgcagcggaaacatggcggcatgcttgtcagaaaccctctgtcccgcaatagcacacacgaaatgtattgggtgtcttgcgggaccggaaacatcgtttccgccgtgaatatgacaagccggatgctcctgaacagatttaccatggctcaccgcaagcccacgtacgagcgggatgtcgacctgggcgccgggaccagacatgtggctgtggaaccggaggtcgccaacctcgatatcattggacagcgcatcgaaaatattaaacacgagcataagtctacatggcactatgacgaggataacccttacaagacctgggcttatcatggctcctacgaagttaaacccagcgggtccgccagctctatggtgaatggagtggtcaagctgcttacaaaaccctgggacgtgatccctatggttacccagattgcgatgacagataccacgcccttcggccaacagagagtgtttaaggagaaagtcgacacacggacccctaaggccaagcgcggcaccgctcagatcatggaagtgacagccaaatggctgtgggggttcctcagcagaaacaagaaaccgcggatctgtacgagagaggaatttacccggaaggttcgctccaatgctgccattggagccgtgttcgtcgacgagaaccaatggaactctgcgaaagaggctgtggaagatgagagattttgggacctggttcaccgggaacgcgagcttcacaagcagggcaagtgcgccacatgcgtgtataacatgatggggaaaagagaaaagaaactgggagagttcggcaaggccaaagggagccgggctatctggtacatgtggctcggcgcccgcttcctggagtttgaagctctgggattcatgaatgaggatcattggttttccagagaaaactctctcagcggcgtcgagggggagggactgcacaaacttggctacattctgcgggacatctccaaaattcccgggggaaatatgtatgccgatgacaccgcgggctgggatacacgcatcaccgaagacgatctccagaacgaggccaagatcacagacattatggaacctgagcatgctctgcttgccaagtctatcttcaaactgacctaccagaataaggtggtcagagtgcaacggcccgctaaaaacgggacggttatggatgtgattagccgcagagaccagcggggctccggacaggtcggcacctatgggctcaatacatttaccaacatggaagcccagctgatccgccaaatggagagcgagggaattttctctccttccgaactggagacacccaacctcgcgggcagagtgctggattggcttgaaaagcacggggtggagcggctgaaaagaatggccatcagcggagacgactgtgttgtgaagccgatcgatgaccgctttgctaccgccctcacggctctgaatgatatgggcaaggtccggaaagacattcctcagtgggaaccctctaaggggtggaacgattggcaacaggtgcctttctgctcccaccattttcaccaacttatcatgaaagacggcagaggaattgttgtgccctgtcgcaatcaggatgagctggtcggccgggccagagtgagccagggggctggatggtccctccgcgagacagcctgcctgggcaagtcttacgcgcagatgtggcaactgatgtatttccatcggagagacctccgcctggccgctaacgccatctgtagcgccgtccctgtggattgggttcccacctcccggacaacctggagcattcacgctcatcaccagtggatgacgaccgaagacatgctttctgtgtggaatagagtctggatcgaggaaaacccgtggatggaggataaaacacacatttccagctggggagacgtgccttacctgggaaagcgcgaagaccagtggtgcggctctctcatcgggctgaccgcccgggcgacatgggctaccaatatccaagttgccattaaccaggtgagacggcttatcggcaatgagaactatctggattacatgacaagcatgaagagatttaaaaatgagtccgaccccgaaggagccctctggtga

SEQ ID NO: 19328 - RNA, 9879 nt, synthetic construct
  misc_feature 1..9879: note = derived and/or modified CDS sequence (opt5) from DENV-1__EU482529__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacactgcaagagacctggaatcgccaggacctcctggtgaccttcaaaacagctcacgcgaagaagcaggaagtcgtggttctgggatctcaagagggcgccatgcacacggctctcaccggggccacagaaattcagaccagcggaacaaccacgatctttgccggccatctgaaatgcagacttaagatggataaactgacactcaaggggatgtcctatgtgatgtgtaccggcagcttcaaactggagaaggaagtcgctgagacccagcacggaacagtgctggttcagattaagtacgagggcaccgacgccccgtgcaaaatccctttctctacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagccacacccaggtctgcgaccaccggctcatgtccgcggccatcaaagatagcaaggctgttcatgccgacatgggctattggatcgaatctgagaaaaatgaaacatggaagctggccagagcttccttcattgaggtgaagacctgtatctggcccaaaagccacacactgtggtctaacggggtgctcgaatccgagatgattatcccgaagatttacggaggccctatcagccaacataattatcgccccgggtacttcacccagacggccggaccttggcacctgggcaaacttgagctggattttgacctctgcgaagggaccacagtcgtggttgatgagcactgcggaaaccggggcccctctctgagaaccacaaccgtgacgggcaagatcattcatgaatggtgttgccggagctgtacactgcctccccttcgcttcagaggggaggacggatgctggtacggcatggagatccggccggtcaaagaaaaggaggaaaatctcgtgaagtccatggttagcgcggggtctggagaggtggactcctttagcctgggcctgctctgtatttccatcatgattgaagaggtcatgagatctcgctggagccggaaaatgctgatgaccgggacacttgctgtgttctttctgctcatcatgggacagctgacctggaacgatctgattagactttgcatcatggttggcgccaatgcctccgaccgcatgggcatggggaccacatatctggctctcatggccacgttcaagatgagacctatgtttgcggtgggactcctgttccggcgcctgacctctagagaggtccttctgctcacaatcggcctgagcctggtggcttccgtggaacttcccaactctctggaggaactcggggatggactggccatgggcattatgatcctcaaactgcttaccgactttcaaagccaccagctgtgggccacactcctgtccctgaccttcattaagacgacatttagccttcattacgcttggaaaaccatggccatggtcctgtctatcgtttccctcttccccctgtgtctcagcaccacatctcagaagaccacatggctgcctgtgcttctggggtccctgggatgcaagccgctcacgatgtttctgattgctgagaataaaatctggggccggcgcagctggccccttaacgaaggcatcatggccgtggggattgtctctatcctgctctccagcctgctcaagaacgatgtgcctctggcgggaccccttattgccggcgggatgctgatcgcttgttatgttatttccggaagctctgccgacctgagcctcgagaaagctgccgaggtgtcctgggaagaggaagccgagcactctggcgctagccataatatcctggtcgaagtgcaggatgacgggaccatgaagatcaaagatgaggagagagacgatacacttaccattctgctcaaggcgacactgctcgccgtttccggagtgtaccctctgtctatccccgctacccttttcgtctggtatttctggcagaagaagaagcagcggagcggcgtgctgtgggacacgcctagccctcccgaagtcgagcgcgccgtgctggatgacggcatttacagaatcatgcagcgggggctcctgggacgctctcaggttggcgtgggggtctttcaagaaaacgtgttccacaccatgtggcacgttacaagaggagccgtgcttatgtatcagggcaaacggctggagcccagctgggcttccgtcaagaaagacctcattagctacgggggaggctggagactgcagggctcttggaataccggggaggaagtccaggtgatcgccgttgagcccggaaagaaccctaaaaatgtccaaacagcgcccggcacctttaagacaccggaaggggaggtgggagctattgccctcgatttcaagcctggcacgtccgggagccccatcgtgaaccgcgaaggaaaaatcgtcggcctgtacggcaatggggtggttaccacatctggaacctatgtgtccgccattgctcaggccaaggcgagccaggagggccctcttcccgagatcgaagacgaggtctttcggaaaagaaacctgaccattatggatctgcatcccgggtccggaaagacacgccggtacctccctgctatcgtgagagaagccattaaacgcaagctgcggacgcttatcctggccccgaccagagttgtggcttctgagatggccgaagctctcaagggcatgcccatccgctatcaaacaaccgccgtcaaaagcgagcacacagggaaggagattgtggacctgatgtgccatgcgaccttcacgatgcggctgctctcccctgttagagtgcccaattacaacatgatcattatggatgaagcccactttacagaccctagctctatcgctgcccggggctatatttccacccgcgtcggaatgggcgaggctgccgccatcttcatgaccgctacaccccctgggagcgtggaagcgtttccgcagtctaatgccgtgatccaggatgaggaaagagacattcccgagcggagctggaactccggatacgagtggatcaccgatttccctggcaaaacagtctggtttgttccctctattaagagcgggaatgacatcgctaactgtcttcgcaaaaatggaaagagagtgattcagctgtcccggaagaccttcgatacggaatatcagaagaccaagaacaacgactgggactacgtggtcaccacagatatctctgagatgggcgccaatttcagagccgaccgcgtgattgatcctcggagatgcctgaaacccgttatcctcaaggacgggccggaacgcgtgatcctggctggccctatgcccgtcaccgtggccagcgcggctcagcggagaggacgcattggccggaaccataataaagagggggatcagtacatctatatgggacagccccttaacaatgacgaggatcacgcccactggacggaagccaagatgctgctcgacaacattaatacccctgagggcatcattcccgctctgtttgaacctgagagagaaaagtccgccgcgatcgatggggagtaccgcctgagaggagaggcccggaaaacattcgttgaactcatgcgcagaggcgaccttccggtgtggctgagctataaggtcgcttctgaggggtttcaatactccgatcggcgctggtgcttcgacggcgaaagaaacaatcaggtgctggaggaaaacatggatgtcgagatctggaccaaagagggagaacggaagaaactcagaccccgctggctggacgcccggacatatagcgaccctcttgctctgagagagtttaaggagttcgccgctggccgccggtccgtgtctggggatctcattctggagatcggaaaactgccccagcatctcacccagagagcccaaaatgcgcttgacaacctggttatgctgcacaatagcgaacagggcgggcgggcctaccgccatgctatggaggagctccctgatacaattgaaaccctgatgcttctggccctcatcgctgtgctgacgggaggcgtgacactgtttttcctctccggcagagggcttggaaagacctctattggcctgctgtgtgtcatggccagctccgttctcctgtggatggccagcgtggagccccactggatcgctgcgtctatcattcttgaatttttcctgatggtgctcctgatcccggagcctgaccggcagcgcacaccccaggataaccaactggcctatgtcgtgattgggctcctttttatgatcctgacagttgctgccaatgagatgggactgctcgaaaccacaaagaaagacctgggcattgggcacgtggccgtcgagaaccatcaccatgctgccatgcttgatgtggacctgcaccctgcgtccgcctggacgctctacgctgtcgccaccacaatcattacccccatgatgagacatacaatcgaaaacaccacggctaatatcagcctgaccgccattgcgaaccaggccgctatcctgatgggactcgataagggctggcctatttctaaaatggacatcggcgtgccccttctggccctggggtgctactcccaggttaatccgctcacactgaccgctgccgtgcttatgctggtcgctcactatgccattatcggacctggcctccaagcgaaggccacacgggaggctcagaaacgcaccgccgctgggatcatgaagaaccccacggtggatggaattgttgccatcgacctggatcccgtggtctacgacgccaagttcgaaaaacagctgggccagattatgctccttatcctgtgtacaagccaaattctgctcatgagaaccacatgggcgctgtgcgagtctatcacccttgctaccgggcctctgacaacgctctgggagggaagcccgggcaagttttggaataccacaatcgccgtgtccatggctaacattttccggggctcttatctggccggggccggactggctttcagcctcatgaaatcccttggcgggggacgcagaggcaccggggcccagggagaaacactgggcgagaagtggaaacggcagctgaatcagctcagcaagtccgaatttaacacctacaagagatctggcatcatggaggtggaccgcagcgaagcgaaagaggggctgaagcggggagagacgacaaaacacgccgtttccagaggcaccgctaaacttcgctggttcgtcgaacggaatctggtgaaacccgaggggaaggtgattgatctcggatgtggcagagggggatggtcttattactgcgccggcctgaagaaagtcaccgaagttaagggctatacaaaagggggacctggccatgaggaacccatccctatggctacctacgggtggaacctggtgaagctccacagcggaaaagacgtgtttttcattccccctgagaagtgtgatacacttctgtgcgacatcggcgagtcctctccgaatcccacgattgaagaggggcgcaccctgcgggtcctcaaaatggtggaaccttggctgagaggaaaccaattttgtatcaagatccttaatccctacatgcctagcgttgtggagacactggagcagatgcagcgcaagcatggcggcatgctcgtccggaaccccctgtccagaaatagcacccacgaaatgtattgggtgtcttgcgggacaggaaacattgtttccgccgtgaatatgaccagccgcatgctgctcaaccggttcacgatggcgcacagaaaaccgacctacgagcgcgatgtcgacctgggcgccgggacaagacatgtggctgtggaacctgaggtcgccaaccttgatatcattggacagcggatcgaaaatattaagcacgagcataaatctacctggcactatgacgaggataacccctacaagacatgggcttatcatggctcctacgaagttaaacccagcgggtctgcctccagcatggtgaatggagtggtcaagctgctcaccaagccttgggacgtgatccccatggttacacaaatcgctatgaccgatacgacaccttttggccagcagcgcgtgttcaaagagaaggtcgacaccagaaccccgaaagccaagcggggcacagcgcaaattatggaagtgacggccaaatggctgtgggggtttctttccagaaacaagaagccccggatctgtacccgcgaggagttcacaagaaaagttcggagcaatgctgccattggagctgtgtttgtcgacgagaaccagtggaactctgccaaggaggccgtggaagatgagcgcttctgggacctggttcacagagaacgggagctccacaaacagggcaagtgcgcgacctgcgtgtataacatgatggggaaacgcgaaaagaagctgggagagtttggcaaagctaaggggagcagagccatctggtacatgtggctgggcgcccggttcctcgagttcgaagctctgggatttatgaatgaggatcattggttctcccgcgaaaactctcttagcggcgtcgagggggagggactgcacaaactcggctacattctgagagacatctccaagatccctgggggaaatatgtatgccgatgacacagctggctgggatacccggattacagaagacgatcttcagaacgaggcccgcatcaccgacattatggaacccgagcatgcgctgctcgccaaatctatctttaagctgacgtaccaaaataaagtggtcagagtgcagcggcctgctaagaacgggaccgttatggatgtgattagccgcagagaccagcggggctccggacaggtcggcacatatgggctgaataccttcacaaacatggaagcccaactcatcagacagatggagtctgagggaatctttagcccctccgaactggagaccccgaaccttgctgaacgcgtgctggattggctcgagaagtacggcgtggaacggctgaaaagaatggccattagcggggacgactgtgttgtgaagcctatcgatgaccgcttcgcgacggcccttacagctctgaatgatatgggaaaagtccggaaggacattccccagtgggagccttctaaaggctggaacgattggcagcaagtgcccttttgctcccaccacttccatcagctcatcatgaaggacgggagagagattgttgtgccttgtcgcaatcaggatgaactggtcggccgggccagagtgagccagggagctggctggtctctgcgcgagaccgcctgcctcgggaagtcctatgctcaaatgtggcagctgatgtactttcaccggagagaccttcgcctggccgcgaacgccatctgtagcgctgtccccgtggattggattccgacatcccggaccacgtggtctatccatgcccaccatcagtggatgaccacagaagacatgctcagcgtttggaatagagtgtggatcgaggaaaacccttggatggaggataaaacccacatttccagctggggagacgtcccctatctgggcaagcgggaggaccaatggtgcgggtctcttatcggactgacagccagagctacctgggccacaaatattcaggtggcgatcaaccaggttcgccggctcattggcaatgaaaactacctggattacatgacctccatgaaaagattcaagaatgagggggaccccgaaggcgctctgtggtga

SEQ ID NO: 19329 - RNA, 9879 nt, synthetic construct
  misc_feature 1..9879: note = derived and/or modified CDS sequence (opt5) from DENV-1__EU482531__SS-prME
  source 1..9879: mol_type = other RNA
agcgtgaccatgctgctcatgctgatgcccaccgcccttgctttccacctgacgaccagaggcggggaacctcatatgatcgtcacaaagcaggaacggggaaaatccctcctgtttaagacctctgccggcgttaatatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgctacccgcctcgaaaacattatgtggaaacagatctccaacgagctgaatcatattcttctggaaaacgacatgaagttcacggttgtggtcggagatgtggtgggcatcctcgcccaggggaaaaagatgattcggccgcaacccatggagcacaaatactcttggaaaagctggggaaaggctaagatcatcggcgccgacgtccagaatacaacctttattatcgatgggcctaacacccccgaatgtcctaatgaccagagagcctggaacatttgggaggttgaggattatggattcggcatctttacaaccaatatttggctgaagctgcgcgactcctacacgcaggcttgcgatcaccggcttatgagcgcggccatcaaagactctaaggctgtgcatgccgatatgggctattggatcgaatccgagaaaaacgaaacatggaagctcgccagagctagcttcattgaggtgaagacctgtatctggcccaaatctcacacactgtggtccaatggggtcctggaaagcgagatggtgattccgaagatctacggaggccctatttctcaacataactatcgccccgggtacttcacccagacagccggaccttggcacctcggcaaactggagcttgactttgatctgtgcgaagggaccacggttgtggtcgacgagcactgcggaaatcggggccccagcctcagaaccacaaccgtgacaggcaagatcatccatgaatggtgttgccggtcctgtaccctgcctcccctgcgcttcaaaggggaggatggatgctggtacggcatggagattagaccggttaaggaaaaggaggaaaaccttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaatgacctgatccggctttgcattatggtcggcgccaacgcctctgatagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaatagcctggaggaactcggggacggactggccatgggcatcatgattctcaagctgcttaccgatttccaatcccaccagctgtgggccacactcctgagcctgacctttatcaaaacaaccctttctctgcattacgcttggaagacgatggccatggtgctctccattgtgagcctgttccccctctgtctgtctacaacctcccagaagaccacatggcttcctgtcctgctggggagcctcggatgcaaaccgctgaccatgtttcttatcgctgagaacaagatttggggcagaaaatcttggcccctgaacgaaggcatcatggccgtgggggttgtgtccatcctcctgagctccctcctgaagaatgacgtccctcttgcgggacccctgattgccggcgggatgctgatcgcttgttatgtgattagcggatctagcgccgatctctccctggagaaagctgccgaggtttcttgggaagaggaagccgagcacagcggcgcttcccataacatccttgtggaagtccaggacgatgggacaatgaagattaaagacgaggagcgggatgacacgctgaccatcctcctgaaggcgacactcctggccgtgtctggagtctaccctcttagcatccccgctaccctgttcgtgtggtatttttggcaaaagaaaaagcagcgctccggcgttctgtgggatacaccttctcccccggaagtggagagagccgtcctcgacgatggcatttaccggatcatgcagcgcgggctgcttggaagaagccaggtgggcgttggggtgttccaagaaaatgtcttccacaccatgtggcacgtgacgcggggagccgtgctgatgtatcagggcaaacgcctcgagccttcctgggctagcgttaagaaagacctgatttcttacgggggaggctggagactccagggctcctggaacaccggggaggaagtccaggtgatcgccgtggagcccggaaagaatcctaagaacgtccaaacagcgcccggcacctttaaaacaccggaaggggaggtgggagctattgccctggacttcaagcctggcaccagcgggtctcccatcgttaatcgggaaggaaaaattgtgggcctttacggcaacggggtcgtgacaacgtccggaacctatgttagcgccatcgctcaggccaaggcgtcccaggagggccctctgcccgagatcgaagatgaggtgtttagaaaacgcaatctgacaattatggacctccatcccgggtctggaaagacccggagatacctgcctgctatcgtccgcgaagccattaagcggaaacttagaaccctgatcctcgccccgacacgcgtggttgctagcgagatggccgaagctctgaagggcatgcccattcggtatcaaacgaccgccgtgaaatccgagcacacagggaaggagatcgtcgatctgatgtgccatgcgaccttcacaatgagactccttagccctgtgcgcgtgcccaactacaatatgatcattatggacgaagcccactttaccgatccttcttccatcgctgcccggggctatattagcacgagagtcggaatgggcgaggctgccgccatcttcatgacagctacaccccctgggtctgttgaagcgtttccgcagagcaacgccgtgattcaggacgaggaacgggatatccccgagcgctcctggaactctggatacgagtggatcaccgacttccctggcaaaacagtgtggtttgtccccagcattaagtccgggaacgatatcgctaattgtctgagaaagaacggaaaacgggtgattcagctgtctcgcaagaccttcgacacagaatatcagaagaccaagaacaatgattgggactacgttgtgacgacagacatcagcgagatgggcgccaactttagagccgatcgggtcattgaccctagacgctgcctcaaacccgtgatcctgaaggatgggccggaacgggttattcttgctggccctatgcccgtgaccgtcgcctccgcggctcagagacgcggacggatcggcagaaatcataacaaggagggggaccagtacatctatatgggacagcccctgaataacgatgaggaccacgcccactggacagaagccaaaatgctcctggataatattaacacccctgagggcatcattcccgctctgttcgaacctgagcgcgaaaagagcgccgcgatcgacggggagtaccggctcagaggagaggcccgcaaaacgttcgtggaacttatgagacggggcgatctgccggtctggctgtcttataaggtggcttccgaggggtttcaatacagcgaccgcagatggtgcttcgatggcgaacggaataaccaggttctcgaggaaaatatggacgtggagatttggaccaaagagggagaacgcaagaaactgagaccccggtggcttgatgccagaacatattccgaccctctggctctccgcgagtttaaggagttcgccgctggccggagatctgtgagcggggacctgatcctggagatcggaaagctcccccagcatcttacccagcgcgcccaaaacgcgctggataatctggtcatgctccacaactccgaacagggcgggcgggcctacagacatgctatggaggagctgcctgacacaattgaaacccttatgctgctcgccctgatcgctgttctgacaggaggcgtgaccctctttttcctttctggccgggggctgggaaaaacgagcattggcctgctctgtgtgatggcctccagcgtcctgctttggatggcctctgtggagccccactggatcgctgcgtccattatcctggaatttttcctcatggttctgctgatcccggagcctgatcgccagagaacaccccaggacaatcaactcgcctatgtggtcattgggcttctgtttatgatcctgaccgtggctgccaacgagatgggactcctggaaaccacaaagaaagatcttggcattgggcacgtcgccgtggagaaccatcaccatgctaccatgctggacgttgatctccaccctgccagcgcgtggacactgtacgccgtggctacgaccatcattacacccatgatgcggcataccatcgaaaatacaaccgccaacatttctctgacggctatcgccaatcaggcggccatcctcatgggacttgacaagggctggcctatttccaaaatggatatcggcgtccccctgctggctctcgggtgctacagccaggtgaacccgctgacccttacagccgctgttctgatgctcgtggcccactatgctattatcggacctggcctgcaagccaaggcgacccgcgaggcccagaagagaacagctgccgggattatgaaaaatcccaccgtcgacggaatcgtggctatcgatctggaccccgtggtttacgatgccaagttcgaaaaacagctcggccagattatgcttctgatcctgtgtacgtctcaaattctcctgatgcggacaacctgggccctttgcgagagcatcacactggcgaccgggcctctcaccacactgtgggagggatccccgggcaagttttggaacacgaccattgctgtctctatggccaatatcttccgcggcagctatctggctggggccggactcgccttttcccttatgaaaagcctgggcgggggaagacggggcacaggggctcagggagaaaccctgggcgagaagtggaagcgccagctcaaccagctgtccaaatctgagttcaatatctacaagagaagcggcattatggaggtggaccggtccgaagccaaagaggggcttaagagaggagagacaacccgccacgcggtgtctcggggcacggccaaactgagatggttcgtcgaacgcaacctcgttaagcccgaggggaaggtgatcgacctgggatgtggcagagggggatggagctattactgcgctggcctgaaaaaggtgacagaagtcaaaggctataccaaagggggacctggccatgaggaacccattcctatggccacctacgggtggaatctcgtgaaacttcactccggaaaggatgtctttttcacaccccctgagaaatgtgacaccctgctgtgcgatatcggcgagtctagcccgaaccccacaattgaagaggggagaacgctccgcgtgctgaagatggtcgaaccttggcttcggggaaatcaattttgtatcaagattctgaacccctacatgccttccgtggttgagaccctcgagcagatgcagagaaaacatggcggcatgctggtgcgcaatcccctgagccggaactctacacacgaaatgtattgggtctcctgcgggaccggaaatatcgtgagcgctgtgaacatgacatctagaatgctcctgaaccgcttcaccatggcccaccggaagccgacgtacgagagagacgtcgatcttggcgcggggacccgccatgttgccgtggaacctgaggtggctaatctggacatcattggacagagaatcgaaaacattaaacacgagcataagtccacatggcactatgatgaggacaatccctacaaaacctgggcctatcatggcagctacgaagtcaagccctctgggtccgctagctccatggtgaacggagttgtgaagctcctgacaaaaccttgggatgtcatccccatggtgacccaaattgccatgacagacaccacgccttttggccagcagcgggttttcaaggagaaagtggatacacgcaccccgaaggctaaaagaggcaccgcccaaatcatggaagtcacagcgcggtggctttgggggtttctgagcagaaataagaagccccggatctgtacgcgcgaggagttcaccagaaaagtgcggtctaacgccgctattggagccgtttttgtggacgagaatcagtggaacagcgctaaggaggccgtcgaagacgagcgcttctgggatctcgtgcagaaagaaagagagctgcacaagcagggcaaatgcgccacatgcgtctataatatgatggggaagcgggaaaagaaactgggagagtttggcaaggcgaaagggtcccgcgctatctggtacatgtggctcggcgccagattcctggagtttgaagcccttggattcatgaacgaggaccactggttctctcgggaaaatagcctgtccggcgtggagggggagggactccataagctgggctacattcttcgcgatatctctaaaattcctgggggaaacatgtatgctgacgataccgccggctgggacacaagaatcaccgaagatgacctgcaaaatgaggctaagatcacagatattatggaacccgagcacgccctcctggcgaccagcatctttaaactgacgtaccagaacaaggttgtgcgggtccagcgccctgccaagaatgggaccgtgatggacgtgatttccagacgggatcagcgcggctctggacaagttggcacatatgggctcaacaccttcacaaacatggaagctcagctgatcagacagatggagagcgagggaatttttcttccctccgaactggagaccccgaatctcgccgaacgggtgctggactggcttgagaaacatggcgtcgaaagactgaagcgcatggctatcagcggggatgactgtgtggttaaacctatcgacgatcggttcgccacggcgctcacagccctgaacgacatgggaaaggtgagaaaagatattccccagtgggagccttctaagggctggaatgactggcaacaggtccccttttgctcccaccacttccatcagctgatcatgaaggatgggcgcgagattgtggtcccttgtcggaaccaggacgaactcgtgggcagagctcgcgttagccaaggagccggctggtctctgcgggagaccgcttgccttgggaaatcctacgcccagatgtggcagctgatgtattttcacagacgcgatctccggctggctgccaatgcgatctgtagcgccgtgcccgtcgactgggtgccgacatccagaaccacgtggtctattcatgctcaccatcaatggatgaccacagaagatatgcttagcgtttggaaccgcgtgtggatcgaggaaaatccttggatggaggacaagacccacgtctccagctggggagatgtgccctacctgggcaaacgggaggaccagtggtgcgggtctctcattggactgacagccagagccacctgggcttccaacatccaggtggccatcaatcaggttcggagactgattggcaacgaaaattatctcgactacatgacaagcatgaagcgcttcaaaaacgagggggatcccgaaggcgcgctgtggtga

SEQ ID NO: 19330 - RNA, 9879 nt, synthetic construct
  misc_feature 1..9879: note = derived and/or modified CDS sequence (opt5) from DENV-1__EU482532__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaacatgtgcacccttatcgcgatggacctgggggagttctgtgaagatacaatgacctacaaatgcccgagaatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccaccacgcgcctggaaaacatcatgtggaagcagatttctaacgagctcaatcatatcctgcttgaaaacgacatgaaatttacagttgtggtcggagatgtggccggcattctggctcaggggaagaaaatgatccggccgcagcccatggagtacaagtatagctggaagtcctggggaaaagccaagattatcggcgccgacgtgcaaaataccaccttcatcattgatgggcctaacacacccgaatgtcctgacgatcagagagcttggaatatctgggaggtcgaggactacggatttggcattttcaccacgaacatctggctcaaactgcgcgatagccacacacaggtttgcgaccaccggctgatgtctgcggccattaaggattccaaagctgtgcatgccgacatgggctattggatcgaaagcgagaagaatgaaacctggaaacttgccagagcttctttcatcgaggtgaaaacatgtatttggcccaagtcccacaccctctggagcaacggggtcctggaatctgagatgatcattccgaaaatctacggaggccctattagccagcataattatcgctccgggtactttacacaaaccgccggaccctggcacctgggcaagctcgagctggatttcgacctttgcgaagggacgaccgtggttgtggatgagcactgcggaaaccggggccctagcctgagaacaaccacagtcaccggcaaaatcatccatgaatggtgttgccggtcttgtacgctgccccctctgcgctttaagggggaggacggatgctggtacggcatggagattagacccgtgaaggaaaaagaggaaaatctggttaagtccatggtgagcgcggggtccggagaggtcgactctttcagccttggcctcctgtgtatctccattatgatcgaagaggtgatgcggtctagatggagccgcaaaatgctgatgacagggaccctcgctgtctttttcctgcttattatgggacagctgacatggaacgatctcatccggctgtgcattatggtgggcgccaatgcctccgacagaatgggcatggggaccacctatctggctcttatggccacatttaagatgcgcccgatgttcgcggtcggactgctctttagacggctgacgtctcgcgaggtgctcctgcttaccatcggcctgagcctcgtggcttccgtcgaactgcctaacagcctggaggaacttggggatggactggccatgggcatcatgattctcaaactgctcacagacttccagtctcaccaactgtgggccacccttctgtccctcacatttatcaagaccacgttcagcctgcattacgcttggaagacaatggccatggttctgtctattgtgtccctttttcccctgtgtctcagcaccacctctcagaaaacaacctggctgcccgtgctcctggggtcccttggatgcaagcctctgacaatgttcctgatcgctgagaataaaatttggggcagaaagagctggccgctcaacgaaggcatcatggccgtcgggatcgtgtccattctgcttagctctctgctcaaaaacgatgttcccctggcgggacctctcatcgccggcgggatgctgattgcttgttatgtgatcagcggatcctctgccgaccttagcctggagaaggctgccgaggtctcctgggaagaggaagccgagcactctggcgctagccataatattctggtggaagttcaggatgacgggacgatgaaaatcaaggatgaggagcgggacgataccctcacaatcctgcttaaggcgaccctgctcgccgtgtccggagtctaccccctgtctattcctgctacactcttcgtgtggtatttttggcagaaaaagaaacaacgcagcggcgtcctgtgggacaccccctcccctcccgaagtggagagagccgttcttgatgacggcatctaccggattatgcagcgcgggctgctgggaagaagccaggtgggcgtcggggtgttccaggaaaacgtttttcacacgatgtggcacgtgacccggggagccgtcctcatgtatcaaggcaagcgcctggagccgtcttgggcttccgtgaaaaaggaccttatcagctacgggggaggctggagactgcagggctcttggaatacaggggaggaagtgcaggttattgccgtcgagcctggaaagaaccccaaaaatgtgcagaccgcgcctggcacattcaagacctccgaaggggaggtgggagctatcgccctcgattttaaacccggcacaagcgggtccccgattgtcaaccgggaaggaaagatcgtgggcctgtacggcaatggggttgtgacgacctctggaacatatgtcagcgccatcgctcaagccaaagcgtcccaggagggccctctccccgagattgaagacgaggtgttcagaaagcgcaacctgaccatcatggatcttcatcctgggagcggaaagacccggagatacctgcccgctattgttcgcgaagccatcaaacggaagctgagaacactcattctggcccccacgcgcgtggtcgcttctgagatggccgaagctcttaaaggcatgcctatccggtatcagaccacagccgtgaagtccgagcacaccgggaaagagatcgttgacctgatgtgccatgcgacatttaccatgagactcctgagcccggtgcgcgtccccaattacaacatgattatcatggatgaagcccacttcacggacccttctagcattgctgcccggggctatatctccacaagagtgggaatgggcgaggctgccgccatttttatgaccgctacaccccctgggtctgtggaagcgttcccccaaagcaatgccgtcatccaggatgaggaacgggacatccctgagcgctcctggaactctggatacgagtggattacagattttccgggcaagaccgtttggttcgtgcccagcatcaagtccgggaatgacattgctaactgtctgcgcaagaatggaaagcgggtgatccagctcagccgcaaaacattcgataccgaatatcagaagacgaaaaacaacgactgggactacgtcgtgacaaccgatatttctgagatgggcgccaattttagagccgaccgggttatcgatcctagacgctgccttaagcccgtgattctgaaggacgggcctgaacgggtcatcctggctggccccatgccggtgacagttgcctccgcggctcaaagacgcggacggatcggcagaaaccataataaagagggggatcagtacatttatatgggacagcctctcaacaatgacgaggatcacgcccactggaccgaagccaagatgctgcttgacaacatcaatacgcccgagggcattatccccgctctgttcgaacctgagcgcgagaagtccgccgcgattgatggggagtaccggctcagaggagaggcccgcaagacctttgtggaactgatgagacggggcgacctgcccgtctggctctcctataaagtggcttctgaggggttccagtacagcgatcgcagatggtgctttgacggcgaacggaacaatcaagtccttgaggaaaacatggatgtggagatctggacaaaggagggagaacgcaaaaagctgagacctcggtggctggacgccagaacctattccgacccgctcgctctgcgcgagttcaaggaatttgccgctggccggagatctgttagcggggatcttatcctggagattggaaaactcccccagcatctgacacagcgcgcccagaatgcgctggacaacctcgtgatgcttcacaattccgaacaaggcgggcgggcctacagacatgctatggaggagctgcctgataccatcgaaacactgatgctcctggcccttattgctgtgctgaccggaggcgtcacactcttctttctgagcggccgggggctgggaaagacatctatcggcctcctttgtgttatggcctccagcgtgctgctgtggatggcctctgtggagccccactggattgctgcgtccatcatcctcgagttctttctgatggtccttctgattcctgagcccgaccgccagagaaccccgcaggataaccagctcgcctatgtggttatcgggctgctgttcatgattctcaccgtggctgccaatgagatgggacttctggaaacaaccaaaaaggacctgggcatcgggcacgtcgccgctgagaaccatcaccatgccgcgatgctcgatgtggacctgcaccctgccagcgcttggacactttacgccgtcgctacgaccattatcacacccatgatgcggcataccattgaaaacacaaccgccaatatctctctgacggcgatcgccaaccaagctgccattctcatgggactggataaaggctggcctatcagcaagatggacattggcgtgcccctgctcgctcttgggtgctactcccaggttaatcctctgaccctgacagccgctgtgctcatgctggtcgcccactatgcgatcattggacccggccttcaggccaaggctacccgcgaggcccagaagagaacagctgccgggatcatgaagaacccgaccgtggatggaatcgttgccattgacctggatcctgtggtctacgacgcgaaatttgaaaagcagctcggccagatcatgctgctgattctctgtacgtctcagatccttctgatgcggacaacctgggctctgtgcgagagcattacactcgccaccgggcccctgaccacactttgggagggatcccccggcaaattctggaatacgaccatcgctgtgagcatggccaacatcttccgcggctcctatctggccggggctggactcgccttttctctgatgaaaagcctgggcgggggaagacggggcacaggggcgcaaggagaaaccctcggcgagaagtggaaacgccagcttaatcagctgtccaagtctgagttcaacacatacaaaagaagcggcattatggaggtggaccggtccgaagccaaggaggggctgaaaagaggagagaccacgaagcacgctgtttctcgcggcacagccaagctccggtggtttgtcgaaagaaatctggtgaaacctgaggggaaggtgatcgatcttggatgtggccgcgggggatggagctattactgcgctggcctgaaaaaggtcaccgaagttaaaggctataccaaagggggaccgggccatgaggaacccattcctatggccacatacgggtggaacctcgtgaaactgcactccggaaaggacgtgttctttattccccctgagaagtgtgataccctgctctgcgacattggcgagagctctcccaatcctacaatcgaagaggggcggacgcttagagtcctgaaaatggtggaaccgtggctgcgcggaaaccagttctgtattaagatcctcaatccctacatgccttccgttgtggagaccctggagcaaatgcagcggaaacatggcggcatgcttgtcagaaaccccctgagccgcaattctacacacgaaatgtattgggtgtcctgcgggaccggaaacatcgttagcgcggtgaatatgacatctcggatgctcctgaacagatttaccatggcccaccgcaagcctacgtacgagcgggatgtcgacctgggcgctgggaccagacatgtggccgtggaacccgaggtcgctaacctcgatattatcggacagcgcattgaaaatatcaaacacgagcataagtccacatggcactatgacgaggataacccgtacaagacctgggcctatcatggcagctacgaagttaaaccttccgggagcgcttctagcatggtgaatggagtggtcaagctgcttacaaaaccctgggacgtgattcccatggttacccagatcgccatgacagataccacgcctttcggccaacagagagtgtttaaggagaaagtcgacacacggacccccaaggcgaagcgcggcaccgcccagatcatggaagtgacagctaaatggctgtgggggttcctctccagaaacaagaaacctcggatttgtacgagagaggaatttacccggaaggttcgctctaatgccgctatcggagccgtgttcgtcgacgagaaccaatggaatagcgccaaagaggcggtggaagatgagagattttgggacctggttcaccgggaacgcgagcttcacaagcagggcaagtgcgctacatgcgtgtataacatgatggggaaaagagaaaagaaactgggagagttcggcaaggccaaagggtcccgggccatttggtacatgtggctcggcgctcgcttcctggagtttgaagccctgggattcatgaatgaggatcattggttttctagagaaaacagcctctccggcgtcgagggggagggactgcacaaacttggctacatcctgcgggacatttctaaaatccccgggggaaatatgtatgctgatgacaccgccggctgggatacacgcatcaccgaagacgatctccagaacgaggcgaagattacagacatcatggaacccgagcatgccctgcttgctaagagcattttcaaactgacctaccagaataaggtggtcagagtgcaacggcctgccaaaaacgggacggttatggatgtgatctcccgcagagaccagcggggcagcggacaggtcggcacctatgggctcaatacatttaccaacatggaagctcagctgattcgccaaatggagtctgagggaatcttctcccccagcgaactggagacacctaacctcgccggcagagtgctggattggcttgaaaagcacggggtggagcggctgaaaagaatggcgatctctggagacgactgtgttgtgaagcccattgatgaccgctttgccaccgctctcacggccctgaatgatatgggcaaggtccggaaagacatcccgcagtgggaaccttccaaggggtggaacgattggcaacaggtgcccttctgcagccaccattttcaccaacttattatgaaagacggcagagagatcgttgtgccttgtcgcaatcaggatgagctggtcggacgggctagagtgtcccagggcgccgggtggtctctccgcgaaacagcttgcctgggaaagagctacgcccagatgtggcaactgatgtatttccatcggagagacctccgcctggcggccaacgctatttgttccgccgtccccgtggattgggttcctaccagccggacaacctggtctatccacgcccatcaccagtggatgacgaccgaggacatgctttccgtgtggaatagagtctggattgaagagaacccctggatggaagataaaacacacatcagctcttggggcgacgtgccgtacctggggaagcgcgaggaccagtggtgcggaagcctcatcggcctgaccgctcgggccacatgggcgaccaatattcaagttgctatcaaccaggtgagacggcttattgggaatgagaactatctggattacatgacatccatgaagagatttaaaaatgaatctgaccctgagggcgccctctggtga

SEQ ID NO: 19331 - RNA, 9879 nt, synthetic construct
  misc_feature 1..9879: note = derived and/or modified CDS sequence (opt5) from DENV-1__EU482533__SS-prME
  source 1..9879: mol_type = other RNA
agcgtgaccatgctgctgatgctgatgcccacagcccttgctttccacctgacgaccagaggcggggaacctcatatgatcgtgtccaagcaggaacggggaaaatctctcctgtttaagacaagcgccggcgttaatatgtgcacccttattgccatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcatcgtgctcggatcccaggagggcgctatgcacacagccctgacgggggccaccgaaattcaaacaagcggaaccacaaccatcttcgctggccatctgaagtgcagactcaaaatggataagctgacgcttaaagggatgtcttatgttatgtgtacaggctccttcaagctggagaaggaagtggccgagacccagcacggaaccgtcctcgtgcagattaaatacgagggcacagacgcgccgtgcaagatcccttttagcacccaggatgaaaaaggggttacacaaaacggacggctgatcacggctaatcccattgtgaccgacaaggagaaacctgtcaacatcgaagccgagccgcccttcggcgagtcttatattgtgatcggggccggagaaaaggctctgaaacttagctggtttaaaaagggctcctctattgggaaaatgttcgaggccacagctagaggcgcccgccggatggcgatcctcggagataccgcctgggactttggcagcatcgggggagtgttcacatccgttggcaagctggtccatcagatttttgggaccgcttacggagtgctgttcagcggcgtgtcttggacgatgaaaatcgggattggcgtcctcctgacctggcttggactcaattccagaagcacatctctctccatgacctgtatcgccgtgggcctggttacactgtaccttggggtgatggtccaggctgatagcggatgcgtgattaactggaagggccgcgaactcaagtgtgggtccggaatctttgttaccaatgaggtgcacacatggaccgaacagtataaattccaagccgactctcctaagcggctgagcgcggccattggcaaggcttgggaggagggggtctgcggcatcagatccgccacgcgcctggaaaacatcatgtggaagcagatttctaacgagctcaatcatatcctgcttgaaaacgacatgaaatttacagtggttgtgggagatgtcgctggcattctggcccaggggaagaaaatgatccggccgcagcccatggagtacaagtatagctggaagtcctggggaaaagccaagattatcggcgctgacgtgcaaaatgcgaccttcatcattgatgggcctaacacccccgaatgtcctgacgatcagagagcctggaatatctgggaggtggaggactacggatttggcattttcacaaccaacatctggctcaaactgcgcgatagctatacgcaggtctgcgaccaccggctgatgtctgctgccattaaggattccaaagccgttcacgctgacatgggctactggatcgaaagcgagaagaatgaaacatggaaacttgccagagcgtctttcatcgaggtgaaaacctgtatttggcccaagtcccatacactctggagcaacggggtgctggaatctgagatgatcattccgaaaatctatggaggccctattagccagcacaattaccgccccgggtactttacccaaacagctggaccttggcatctgggcaagctcgagctggatttcgacctttgcgaagggaccacggtcgtggttgatgagcactgcggaaaccggggcccctccctgagaaccacaaccgtgacaggcaaaatcatccacgaatggtgttgccggagctgtaccctccctcccctgcgctttaagggggaggacggatgctggtatggcatggagattagaccggtcaaggaaaaagaggaaaatctggtgaagtctatggtttccgccgggagcggagaggtggactccttctctcttggcctcctgtgtatcagcattatgatcgaagaggtcatgcggtccagatggtctcgcaaaatgctgatgacggggacactcgccgtgtttttcctgcttattatgggacagctgacctggaacgatctcatccggctgtgcattatggttggcgctaatgccagcgacagaatgggcatggggacaacctacctggcgcttatggctacctttaagatgcgccctatgttcgccgtgggactgctctttagacggctgacatcccgcgaggtcctcctgcttacgatcggcctgtctctcgtggccagcgtggaactgcccaactccctggaggaacttggggatggactggctatgggcatcatgattctcaaactgctcaccgacttccagagccatcaactgtgggccacacttctgtctctcacctttatcaagacaaccttctccctgcactatgcttggaagacgatggccatggtcctgagcattgtttctctttttcccctgtgtctctccacaaccagccagaaaaccacatggctgcctgtgctcctggggtctcttggatgcaagccgctgaccatgttcctgatcgcggagaataaaatttggggcagaaagtcctggcccctcaacgaaggcatcatggccgtggggatcgtcagcattctgctttccagcctgctcaaaaacgatgtgcctctggctggacccctcatcgccggcgggatgctgattgcttgttacgttatctctggaagctccgccgacctttctctggagaaggccgctgaggtgagctgggaagaggaagcggagcattccggcgcctctcacaatattctggtcgaagtgcaggatgacgggacaatgaaaatcaaggatgaggagcgggacgatacgctcaccatcctgcttaaggctacactgctcgccgttagcggagtgtatcctctgtccattcccgccaccctcttcgtctggtacttttggcagaaaaagaaacaacgctctggcgtgctgtgggacacaccttcccctcccgaagtcgagagagctgtgcttgatgacggcatctatcggattatgcagcgcgggctgctgggaagatcccaggttggcgtgggggtcttccaggaaaacgtgtttcataccatgtggcacgttacgcggggagccgtgctcatgtaccaaggcaagcgcctggagcccagctgggcgtctgtcaaaaaggaccttatctcctacgggggaggctggagactgcagggcagctggaataccggggaggaagtccaggtgattgctgttgagcccggaaagaaccctaaaaatgtccagacagcccccggcaccttcaagacatctgaaggggaggtgggagccatcgctctcgattttaaaccgggcacctccgggagccctattgtgaaccgggaaggaaagatcgtcggcctgtatggcaatggggtggttacaacgtccggaacctacgtgtctgccatcgcgcaagctaaagccagccaggagggccccctccctgagattgaagacgaggtcttcagaaagcgcaacctgacaatcatggatcttcaccccgggtccggaaagacccggagatatctgcccgccattgtgcgcgaagctatcaaacggaagctgagaaccctcattctggcccctacacgcgttgtggctagcgagatggccgaagcgcttaaaggcatgccgatccggtaccagacgaccgccgtcaagtctgagcatacagggaaagagatcgtggacctgatgtgccacgctacctttacaatgagactcctgtcccccgttcgcgtgcctaattataacatgattatcatggatgaagcccatttcaccgaccccagctctattgctgcccggggctacatcagcacgagagtcggaatgggcgaggccgctgcgatttttatgacagccacccctcccgggtccgtggaggctttccctcaatctaatgccgtgatccaggatgaagaacgggacatcccggagcgcagctggaactccggatatgagtggattaccgattttcccggcaagacagtctggttcgttccttctatcaagagcgggaatgacattgccaactgtctgcgcaagaatggaaagcgggtgatccagctctcccgcaaaaccttcgatacagaataccagaagaccaaaaacaacgactgggactacgtggtcacgacagatattagcgagatgggcgctaattttagagccgaccgggtgatcgatcccagacgctgccttaagcctgttattctgaaggacgggcccgaacgggtgatcctggcgggcccgatgcctgtcaccgtggcttctgccgcccaaagacgcggacggatcggcagaaaccacaataaagagggggatcagtatatttacatgggacagcccctcaacaatgacgaggatcatgctcactggacagaagccaagatgctgcttgacaacatcaatacccccgagggcattatccctgcgctgttcgaacccgagcgcgaaaaatccgccgctattgatggggagtatcggctcagaggagaggcccgcaagacgtttgttgaactgatgagacggggcgacctgcctgtgtggctcagctacaaagtcgcttccgaggggttccagtattctgatcgcagatggtgctttgacggcgaacggaacaatcaagtgcttgaggaaaacatggatgtcgagatctggaccaaggagggagaacgcaaaaagctgagaccgcggtggctggacgccagaacatacagcgaccccctcgctctgcgcgagttcaaggaatttgccgcgggccggagatccgtgtctggggatcttatcctggagattggaaaactccctcagcacctgacccagcgcgcccagaatgctctggacaacctcgttatgcttcataatagcgaacaaggcgggcgggcctatagacacgctatggaggagctgcccgatacaatcgaaaccctgatgctcctggcccttattgccgtgctgacaggaggcgtgaccctcttctttctgtccggccgggggctgggaaagacgagcatcggcctcctttgtgtcatggcttcttccgttctgctgtggatggcgagcgtggagcctcattggattgccgcttctatcatcctcgagttctttctgatggtgcttctgattcccgagccggaccgccagagaacacctcaggataaccagctcgcctacgtcgtgatcgggctgctgttcatgattctcaccgttgccgctaatgagatgggacttctggaaaccaccaagaaggacctgggcatcgggcacgtggccgtcgagaaccaccatcacgcggccatgctcgatgtggacctgcatcccgcttccgcctggaccctttacgctgtcgccacaacgattatcacccctatgatgcggcacacaattgaaaacaccacagcgaatatcagcctgaccgccatcgctaaccaagccgctattctcatgggactggataaaggctggcccatctctaagatggacattggcgtgcctctgctcgcccttgggtgctatagccaggttaatcccctgacgctgaccgctgccgtgctcatgctggtcgcgcattacgccatcattggaccgggccttcaggctaaggccacacgcgaggctcagaagagaaccgccgccgggatcatgaagaaccctacagtggatggaatcgttgcgattgacctggatcccgtggtctatgacgctaaatttgaaaagcagctcggccagatcatgctgctgattctctgtacctcccagatccttctgatgcggacgacatgggccctgtgcgagtctattaccctcgctacagggcccctgaccaccctttgggagggaagccctggcaaattctggaatacaacgatcgccgtgtccatggccaacatcttccgcggcagctacctggctggggccggactcgcgttttccctgatgaagtctctgggcgggggaagacggggcaccggggcccaaggagaaacactcggcgagaagtggaaacgccagcttaatcagctgagcaagtccgagttcaacacctataaaagatctggcattatggaggtggaccggagcgaagctaaggaggggctgaaaagaggagagacaaccaagcacgccgtttcccgcggcacggctaagctccggtggtttgtcgaaagaaatctggtgaaaccggaggggaaggtgatcgatcttggatgtggccgcgggggatggtcttactattgcgccggcctgaaaaaggtcacagaagttaaaggctacaccaaagggggacccggccacgaggaacctattcccatggcgacctacgggtggaacctcgtgaaactgcatagcggaaaggacgtgttctttatccctcccgagaagtgtgatacactgctctgcgacattggcgagtccagccctaatccgaccatcgaagaggggcggacacttagagtcctgaaaatggtggaaccctggctgcgcggaaaccagttctgtattaagatcctcaatccttatatgccctctgttgtggagacgctggagcaaatgcagcggaaacacggcggcatgcttgtcagaaaccctctgtcccgcaatagcacccatgaaatgtactgggtgtcttgcgggacaggaaacatcgtttccgccgtgaatatgaccagccggatgctcctgaacagatttacaatggctcaccgcaagcccacctatgagcgggatgtcgacctgggcgccgggacgagacacgtggctgtggaaccggaggtcgccaacctcgatattatcggacagcgcattgaaaatatcaaacatgagcacaagtctacctggcattacgacgaggataacccttataagacatgggcttaccacggctcctatgaagttaaacccagcgggtccgccagctctatggtgaatggagtggtcaagctgcttaccaaaccctgggacgtgattcctatggttacacagatcgcgatgaccgatacaacccccttcggccaacagagagtgtttaaggagaaagtcgacacgcggacacctaaggccaagcgcggcaccgctcagatcatggaagtgaccgccaaatggctgtgggggttcctcagcagaaacaagaaaccgcggatttgtacaagagaggaatttacgcggaaggttcgctccaatgctgccatcggagccgtgttcgtcgacgagaaccaatggaactctgcgaaagaggctgtggaagatgagagattttgggacctggttcatcgggaacgcgagcttcacaagcagggcaagtgcgcgacctgcgtgtacaacatgatggggaaaagagaaaagaaactgggagagttcggcaaggccaaagggagccgggctatttggtacatgtggctcggcgcccgcttcctggagtttgaagctctgggattcatgaatgaggatcactggttttccagagaaaactctctcagcggcgtcgagggggagggactgcataaacttggctatatcctgcgggacatttccaaaatccccgggggaaatatgtacgccgatgacacagcgggctgggatacccgcatcacagaagacgatctccagaacgaggccaagattaccgacatcatggaacctgagcacgctctgcttgccaagtctattttcaaactgacatatcagaataaggtggtcagagtgcaacggcccgctaaaaacgggaccgttatggatgtgatcagccgcagagaccagcggggctccggacaggtcggcacgtacgggctcaatacctttacaaacatggaagcccagctgattcgccaaatggagagcgagggaatcttctctccttccgaactggagacccccaacctcgcgggcagagtgctggattggcttgaaaagcatggggtggagcggctgaaaagaatggccatcagcggagacgactgtgttgtgaagccgattgatgaccgctttgctacagccctcaccgctctgaatgatatgggcaaggtccggaaagacatccctcagtgggaaccctctaaggggtggaacgattggcaacaggtgcctttctgctcccaccactttcatcaacttattatgaaagacggcagagagatcgttgtgccctgtcgcaatcaggatgagctggtcggacgggccagagtgagccagggcgctgggtggtccctccgcgaaacggcctgcctgggaaagtcttatgcgcagatgtggcaactgatgtacttccaccggagagacctccgcctggccgctaacgccatttgtagcgccgtccctgtggattgggttcccacatcccggaccacatggagcatccatgctcaccatcagtggatgaccacggaggacatgctttctgtgtggaatagagtctggattgaagagaacccgtggatggaagataaaacccacatctccagctggggcgacgtgccttatctggggaagcgcgaggaccagtggtgcggatctctcatcggcctgacagcccgggcgacctgggctacaaatattcaagttgccatcaaccaggtgagacggcttattgggaatgagaactacctggattacatgaccagcatgaagagatttaaaaatgaatccgaccccgagggcgccctctggtga

SEQ ID NO: 19332 - RNA, 9879 nt, synthetic construct
  misc_feature 1..9879: note = derived and/or modified CDS sequence (opt5) from DENV-1__EU482534__SS-prME
  source 1..9879: mol_type = other RNA
agcgtgacaatgctgctgatgctgatgcccacagcccttgctttccacctgacgacccggggaggggagcctcatatgattgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaagccatcagctttgggctacactgctctctctgaccttcgttagaacaaccttttccctgcactatgcctggaaaacgatggctatggtgcttagcatcgtgtctctgttccccctctgtctgtccacaaccagccagaagaccacatggctccctgtcctgcttgggtctctgggatgcaagccgctgaccatgtttctcattgccgagaataaaatctggggccggaagtcctggcccctgaacgaaggcattatggcggtggggatcgttagcatccttctgtccagcctcctgaaaaacgatgtgcctctcgccggacccctgattgctggcgggatgcttatcgcctgttacgtcatttctggaagctccgctgacctgtctctggagaaggccgccgtggttagctgggaggaagaggctgaacattccggcgcgtctcacaatatcctcgtggaggtccaggatgacgggacaatgaaaattaaggatgaagaaagagacgatacgctgaccatccttctgaaagccacactcctggctgtgagcggagtctatcctctctccatccccgccaccctgttcgtgtggtacttctggcaaaagaagaaacagagatctggcgttctttgggacacaccttcccctcccgaggtggaacgggccgtcctggatgacggcatttatcgcatcatgcagagagggctgctcggacggtcccaggtgggcgttggggtgtttcaagagaacgtcttccataccatgtggcacgtgacgcgcggagctgtgctgatgtaccagggcaagagacttgaacccagctgggcctctgttaaaaaggacctgatttcctacgggggaggctggcggctccagggcagctggaataccggggaggaggtccaggtgatcgcggtggaacccggcaagaatcctaagaatgtccaaacagctcccggcacctttaagacatctgagggggaagtgggagccattgccctggatttcaaaccgggcacctccgggagccctatcgttaacagagagggaaagattgtgggcctctatggcaatggggtcgtgacaacgtccggaacctacgtttctgctatcgcccaggcgaaagctagccaggaaggccccctgcctgagatcgaggacgaagtgtttcgcaagcggaaccttacaattatggatctgcaccccgggtccggaaaaaccagacgctatctgcccgccatcgtccgggaggccattaagagaaagctccgcaccctgatccttgctcctacacgggtggttgccagcgaaatggctgaggccctgaaaggcatgccgattagataccaaacgaccgcggtgaagtctgaacatacagggaaagagatcgtcgacctcatgtgccacgccaccttcacaatgcgcctgctgtcccccgtgcgggtgcctaattataacatgatcattatggatgaggctcattttaccgaccccagctctatcgccgctagaggctacattagcacgcgggtcggaatgggcgaagccgccgctatcttcatgacagcgacccctcccgggtccgttgaggcctttcctcagtctaatgctgtgattcaggatgaggaacgcgacatcccggaaagaagctggaactccggatatgagtggatcaccgatttccccggcaagacagtgtggtttgtcccttctattaaaagcgggaatgacatcgccaactgtctccggaagaatggaaagcgcgtgattcagctttccagaaaaaccttcgatacagagtaccaaaagaccaaaaacaacgactgggactacgttgtgacgacagatatcagcgaaatgggcgccaatttccgggctgacagagtcattgatccccgccggtgcctgaagcctgtgatcctgaaagacgggcccgagagagttattctcgccggcccgatgcctgtgaccgtcgcgtctgctgcccagcgccggggaagaatcggccgcaaccacaataaggaaggggatcagtatatctacatgggacagcccctgaacaatgacgaggatcatgcccactggacagaggctaagatgcttctggacaacattaatacccccgaaggcatcattcctgccctctttgagcccgaacgggagaaatccgcggccatcgatggggaatatagactgcgcggagaggctagaaagacgttcgtggagctgatgcggcgcggcgacctccctgtctggcttagctacaaagtggcctccgaagggtttcaatattctgatagacggtggtgcttcgacggcgagcgcaacaatcaggttctggaagagaacatggatgtggaaatttggaccaaggagggagagcgcaagaagctgcggccgagatggctcgacgctcgcacatacagcgaccccctggcccttcgggaatttaaagagttcgctgccggcagacgctccgtgtctggggatctgatcctcgaaatcggaaagctgcctcagcacctgacccagcgggcgcaaaatgccctcgacaaccttgtcatgctgcataatagcgagcagggcgggagagcttatcggcacgccatggaggaactgcccgatacaattgagaccctcatgctgcttgctctgatcgccgttctcacaggaggcgtgaccctgtttttcctgtccggccgcgggctcggaaagacgagcattggccttctgtgtgtgatggcctcttccgtcctgctctggatggctagcgtggaacctcattggatcgcggcctctattatcctggagtttttccttatggttctgctcatccccgaaccggacagacagcggacacctcaggataaccaactggcttacgtggtcattgggctgctctttatgatccttaccgtggccgccaatgagatgggactgctggagaccaccaagaaggacctcggcattgggcacgtcgctgtggaaaaccaccatcacgccgcgatgctggatgttgaccttcatcccgcctccgcttggaccctgtacgccgtggctacaacgatcattacccctatgatgcgccacacaatcgagaacaccacagccaatattagcctcaccgcgatcgccaaccaggctgccatcctgatgggactggataaaggctggcccatttctaagatggacatcggcgtccctctccttgctctggggtgctatagccaggtgaatcccctgacgctcaccgccgctgttctgatgcttgtggcccattacgcgattatcggaccgggcctgcaagccaaagctacaagagaagcccagaagcggaccgctgccgggattatgaagaaccctacagtcgatggaatcgtggccatcgacctcgatcccgtggtttatgacgcgaaattcgagaagcagctgggccagattatgctgctcatcctttgtacctcccaaattctgctgatgcgcacgacatgggctctctgcgaatctatcaccctggccacagggccccttaccaccctgtgggagggaagccctggcaaattttggaatacaacgattgctgtctccatggccaacatcttcagaggcagctacctcgccggggctggactggccttctccctgatgaagtctctcggcgggggacggcgcggcaccggggcgcagggagagacacttggcgaaaaatggaagagacagctgaatcagctgagcaagtccgagtttaacacctataaacggtctggcatcatggaagtggacagaagcgaggccaaggaagggctcaaacgcggagagacaaccaagcacgctgtgtcccggggcacggccaaactgagatggttcgtcgagcgcaatcttgttaagccggaagggaaggtgattgatctgggatgtggcagagggggatggtcttactattgcgctggcctcaaaaaggtgacagaggtcaaaggctacaccaaagggggacccggccacgaggagcctatccccatggccacctacgggtggaacctggtgaaactgcatagcggaaaggacgtctttttcattcctcccgaaaaatgtgatacactcctttgcgacatcggcgagtccagccctaatccgaccattgaggaagggagaacactgcgcgtgctgaagatggtcgagccctggctccggggaaaccaattttgtatcaagattctgaatccttatatgccctctgtggttgaaacgcttgagcagatgcagagaaaacacggcggcatgctggtgcgcaaccctctctcccggaatagcacccatgagatgtactgggtctcttgcgggacaggaaacatcgtgtccgcggtgaatatgaccagcagaatgctgctgaaccgcttcacaatggcccaccggaagcccacctatgaaagagatgtcgacctcggcgctgggacgcgccacgttgccgtggagccggaagtggctaacctggatatcattggacagagaatcgagaatattaaacatgaacacaagtctacctggcattacgacgaggataacccttataaaacatgggcctaccacggctcctatgaggtcaagcccagcgggtccgctagctctatggtgaatggagttgtgaaacttctgaccaaaccctgggacgtcatccctatggtgacacaaattgccatgaccgatacaaccccctttggccagcagcgggttttcaaggaaaaagtggacacgcgcacacctaaggcgaaaagaggcaccgcccaaatcatggaggtcaccgctaagtggctctgggggtttctgagccggaacaagaaaccgagaatctgtacacgggaagagttcacgcgcaaggtgagatccaatgccgctattggagccgtttttgtggacgaaaaccagtggaactctgccaaagaggcggtcgaggatgaacggttctgggaccttgtgcatcgcgagagagaactgcacaagcagggcaaatgcgctacctgcgtctacaacatgatggggaagcgggagaagaaactcggagaatttggcaaggccaaagggagccgcgccatctggtacatgtggctgggcgctagattcctggagttcgaggccctcggatttatgaatgaagatcactggttctcccgggagaactctctgagcggcgtggaaggggagggacttcataagctgggctatattctccgcgacatctccaaaattcccgggggaaatatgtacgctgatgacacagccggctgggataccagaatcacagaggacgatctgcagaacgaagcgaagatcaccgacattatggagcctgaacacgcccttctggctaaatctatctttaagctcacatatcaaaataaggttgtgcgggtccagcgccccgccaaaaacgggaccgtgatggatgtgattagcagacgggaccagcgcggctccggacaggttggcacgtacgggctgaataccttcacaaacatggaggctcaactgatcagacagatggaaagcgagggaatcttttctccttccgagctcgaaacccccaacctggccggccgggtgcttgattggctggagaagcatggggtcgaaagactcaaacgcatggcgatcagcggagacgactgtgtggttaagccgatcgatgaccggttcgccacagctctgaccgcccttaatgatatgggcaaagtgagaaaggacattcctcagtgggagccctctaaggggtggaacgattggcagcaagtccctttttgctcccaccacttccatcagctgatcatgaaagacggccgcgaaattgtggtcccctgtcggaatcaggatgagctcgtgggcagagctcgcgttagccagggagccgggtggtccctgcgggagacggcttgcctgggaaagtcttatgcccaaatgtggcagctcatgtactttcacagacgcgacctgcggcttgcggccaacgctatctgtagcgccgtgcctgtcgattgggtgcccacatccagaaccacatggagcattcatgcccaccatcagtggatgaccacggaagacatgctgtctgtttggaatcgcgtgtggatcgaggaaaacccgtggatggaggataaaacccacatttccagctggggcgacgtcccttatctcgggaagcgggaagaccaatggtgcggatctctgatcggccttacagctagagccacctgggcgacaaatatccaggtggctattaaccaggtgcggagactgctcgggaatgagaactacctggattacatgaccagcatgaaacgcttcaagaatgagtccgaccccgaaggcgccctgtggtga

SEQ ID NO: 19333 - RNA, 9879 nt, synthetic construct
  misc_feature 1..9879: note = derived and/or modified CDS sequence (opt5) from DENV-1__EU482535__SS-prME
  source 1..9879: mol_type = other RNA
agcgtgaccatgctgctcatgctgatgcccaccgcccttgctttccacctgacgaccagaggcggggagcctcatatgatcgtcaccaagcaggaacgggggaaatccctcctgtttaagacctctgccggcgttaacatgtgcacccttattgccatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcattggcaaactggttcatcagatcttcgggaccgcttacggagtcctcttttccggcgtgagctggacgatgaagattgggatcggcgtgctgcttacctggctgggactcaattctagatccacaagcctgtctatgacctgtattgccgtcggcctggtgacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagtcgtggttggagatgtggtcggcatcctcgctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaagatgcgcgattcctacacacaggtctgcgaccaccggctgatgagcgcggccatcaaagattctaaggctgttcatgccgacatgggctattggatcgaatccgagaaaaatgaaacctggaaacttgccagagctagcttcattgaggtgaagacatgtatctggcccaaatctcacaccctctggtccaacggggtgctggaaagcgagatgattatcccgaagatttacggaggccctatctctcaacataattatcgccccgggtacttcacacagaccgccggaccttggcacctgggcaaactcgagctggattttgacctttgcgaagggacgaccgtcgtggttgatgagcactgcggaaaccggggccccagcctgagaacaaccacagtgaccggcaagatcattcatgaatggtgttgccggtcctgtacgctccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgacagggaccctcgctgtgttcctgcttctgatcatgggacagctcacatggaacgatctgattcggctgtgcatcatggttggcgccaatgcctctgacagaatgggcatggggaccacctatcttgctctgatggccacatttaaaatgcgccctatgttcgcggtgggactcctgtttagacggctcacgagccgcgaggtcctgcttctgaccatcggcctctccctggtggcttctgtggaactgcccaacagccttgaggaactgggggatggactcgccatgggcattatgatcctgaagctcctgacagacttccaatcccaccagctttgggccaccctgctcagcctgacatttattaaaaccacgctgtctcttcattacgcttggaagacaatggccatggtcctgtccatcgttagcctcattcccctgtgtctctctaccacctcccagaagacaacctggctgcctgtgcttctggggagcctgggatgcaaaccgctcacaatgttcctgatcgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgttatgtgattagcggatctagcgccgacctgtccctcgagaaagctgccgaggtctcttgggaagaggaagccgagcacagcggcgcttcccataatatcctggtggaagttcaggatgacgggacgatgaagatcaaagatgaggagcgggacgatacccttacaattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgtttcaagaaaacgttttccacacgatgtggcacgtgacccggggagccgtccttatgtatcagggcaaacgcctggagccttcctgggctagcgtgaagaaagacctcatttcttacgggggaggctggagactgcagggctcctggaatacaggggaggaagtgcaggttatcgccgtcgagccccggaagaaccctaagaatgtgcaaaccgcgcccggaacattcaaaaccccggaaggcgaggtgggggctattgccctcgattttaagcctggaacaagcggctctcccatcgtcaacagagaagggaaaatcgtgggactgtacggcaatggcgttgtgacgacctccgggacatatgtcagcgccattgctcaggccaaggcgtcccaggagggacctcttcccgagatcgaagacgaggtgttccgcaaacggaacctgaccattatggatctgcatcccggctctgggaagaccagacgctacctccctgctatcgttcgggaagccattaagagaaaactgcgcacacttatcctggccccgacgcgggtggtcgctagcgagatggccgaagctctcaagggaatgcccatcagatatcaaaccacagccgtgaaatccgagcacaccggcaaggagattgttgacctgatgtgccatgcgacatttaccatgcgcctgctcagccctgtgcgggtccccaattacaacatgatcattatggatgaagcccacttcacggacccttcttccatcgctgccagagggtatattagcacacgggtgggcatgggagaggctgccgccatctttatgaccgctacaccccctggctctgtggaagcgttcccgcagagcaatgccgtcatccaggatgaggaacgcgacattcccgagagatcctggaactctgggtacgagtggatcacagattttcctggaaaaaccgtttggttcgtgcccagcattaagtccggcaatgacatcgctaactgtcttcggaagaatgggaaacgcgtgattcagctgtctagaaagacatttgataccgaatatcagaagacgaagaacaacgactgggactacgtcgtgacaaccgatatcagcgagatgggagccaatttccgggccgacagagttattgatcctcgccggtgcctgaaacccgtgatcctcaaggacggcccggaaagagtcatcctggctgggcctatgcccgtgacagttgcctccgcggctcagcgccggggcagaattggacgcaaccataataaggagggcgatcagtacatctatatggggcagccccttaacaatgacgaggatcacgcccactggaccgaagccaaaatgctgctcgacaacattaatacgcctgagggaatcattcccgctctgtttgaacctgagcgggaaaagagcgccgcgatcgatggcgagtacagactgcgcggggaggccagaaaaaccttcgtggaactcatgcggcgcggagaccttccggtctggctgtcttataaggtggcttccgagggcttccaatacagcgatagacggtggtgctttgacggggaacgcaacaatcaggtcctggaggaaaacatcgatgtggagatttggacaaaagagggcgaaagaaagaaactccggcccagatggctggacgcccgcacctattccgaccctcttgctctgcgggagttcaaggaatttgccgctggaagacgctctgttagcggcgatctcatcctggagattgggaagctgccccagcatctcacacagcgggcccaaaatgcgcttgacaacctggtgatgctgcacaattccgaacagggaggcagagcctaccggcatgctatggaggagctccctgataccatcgaaacactgatgcttctggccctcattgctgtgctgaccgggggagtcacgctgttctttctctctggccgcggccttgggaaaacaagcatcggactgctgtgtgttatggcctccagcgtgctcctgtggatggcctctgtggagccccactggatcgctgcgtccattatccttgagttctttctgatggtcctcctgattccggagcctgacagacagcggacaccccaggataaccaactggcctatgtggttatcggcctccttttcatgattctgaccgtggctgccaatgagatggggctgctcgaaacaaccaagaaagacctgggaatcggccacgccgctgtcgagaaccatcaccatgccacaatgcttgatgtggacctgcaccctgcgagcgcctggacgctctacgctgtcgccaccacaattatcacccccatgatgcgccatacaatcgaaaacaccacggctaatatttctctgaccgccatcgcgaaccaggccgctattctgatggggctcgataagggatggcctatctccaaaatggacattggcgtgccccttctggccctgggctgctacagccaggttaatccgctcacactgaccgctgccgtgcttatgctggtcgctcactatgccatcatcgggcctggactccaagcgaaggccacaagagaggctcagaagcggaccgccgctggcattatgaaaaaccccacggtggatgggatcgttgccattgacctggatcccgtggtctacgacgccaagtttgaaaaacagctgggacagatcatgctccttattctgtgtacatctcaaatcctgctcatgcgcaccacatgggcgctgtgcgagagcatcacccttgctaccggccctctgacaacgctctgggaggggtccccgggaaagttctggaataccacaattgccgtgtctatggctaacatctttagaggcagctatctggccggcgccgggctggctttctccctcatgaaaagccttggaggcgggcggcgcggaaccggcgcccagggggaaacactgggagagaagtggaagagacagctgaatcagctctccaaatctgaatttaacatttacaagcggagcggcatcatggaggtggacagatccgaagcgaaagagggcctgaagcgcggggagaccacgcggcacgccgtttctagaggaacagctaaacttcgctggttcgtcgaacggaatctggtgaagcccgagggcaaggtgattgatctcgggtgtggaagaggcgggtggagctattactgcgccggactgaaaaaggtcaccgaagttaaaggctataccaagggcgggcctggacatgaggaacccatccctatggctacatacggctggaacctggtgaaactccactccgggaaggacgtgttctttacaccccctgagaaatgtgatacacttctgtgcgacattggagagtctagcccgaatcccacgatcgaagagggccgcaccctgcgggtcctcaagatggtggaaccttggctgagagggaaccaattctgtatcaagattcttaatccctacatgccttccgttgtggagacactggagcagatgcagcgcaaacatggaggcatgctcgtccggaaccccctgagcagaaattctacccacgaaatgtattgggtgtcctgcggcacagggaacatcgttagcgccgtgaatatgacctctcgcatgctgctcaaccggtttacgatggcgcacagaaagccgacctacgagaaagatgtcgacctgggagccggcacacgccatgtggctgtggaacctgaggtcgccaaccttgatattatcgggcagagaattgaaaatatcaagcacgagcataaatccacctggcactatgacgaggataacccctacaagacatgggcttatcatggaagctacgaagttaagccctctggctccgccagctccatggtgaatggggtggtcaaactgctcaccaagccttgggacgtgatccccatggttacacaaattgctatgaccgatacgacacctttcggacagcagcgggtgtttaaagagaaggtcgacacccgcaccccgaaagccaagagaggcacagtgcaaatcatggaagttacggcgcggtggctgtggggcttccttagcagaaacaagaaaccccggatttgtacccgcgaggaatttacaagaaaggtgcggtctaatgccgctatcggggccgtcttcgtggacgagaaccagtggaatagcgctaaagaggccgttgaagatgagcgcttttgggacctggtgaagaaagaaagagagctccacaagcagggaaagtgcgcgacctgcgtctataacatgatgggcaaacgggaaaagaaactgggggagttcggaaaggcgaaaggctcccgcgctatttggtacatgtggctgggggccagatttctcgagttcgaagccctgggctttatgaatgaggatcactggttctctcgggaaaacagcctttccggagtggagggcgaggggctgcataagctcggatacatcctgcgcgacatctctaaaattcctggcgggaatatgtatgctgatgacacagccggatgggataccagaatcacagaagacgatcttcagaacgaggctaagattaccgacatcatggaacccgagcacgccctgctcgcgacgagcattttcaagctgacctaccaaaataaagtcgtgcgggttcagcgccctgccaagaacggcacagtgatggatgtcatctccagacgggaccagcgcgggtctggccaggtgggaacctatggcctgaatacatttaccaacatggaagctcaactcatcagacagatggagagcgaggggattttcctgccctccgaacttgagacgccgaacctggccgaacgggtgctcgattggctggagaaatacggagttgaaagacttaagcgcatggctatcagcggcgacgactgtgtggtcaaacctattgatgaccggtttgccacagcgctgaccgccctcaatgatatggggaaggtgagaaaggacatcccccagtgggagccttctaaaggatggaacgattggcagcaagttcccttctgctcccatcactttcaccagctgattatgaaggacggccgcgagatcgtggtcccttgtcggaatcaggatgaactggtggggagagctcgcgtcagccagggcgccggatggtctctccgggagacagcttgcctgggcaaatcctatgcccaaatgtggcagcttatgtacttccatagacgcgacctgcggctcgctgccaacgcgatttgtagcgccgtgcccgttaattgggtgccgacctccagaacgacctggtctatccacgctcatcaccagtggatgacaaccgaagatatgctgagcgtctggaaccgcgtgtggatcgaggaaaatccttggatggaggacaagacacatgtttccagctggggagatgtgccctatcttggaaaacgggaggaccaatggtgcggctctctgattgggctcaccgccagagccacatgggcttccaacatccaggtcgccattaatcaggtgcggagactgatcggaaacgaaaattacctggactacatgaccagcatgaagcgctttaagaacgagggcgatcccgaaggggcgctctggtga

SEQ ID NO: 19334 - RNA, 9879 nt, synthetic construct
  misc_feature 1..9879: note = derived and/or modified CDS sequence (opt5) from DENV-1__EU482536__SS-prME
  source 1..9879: mol_type = other RNA
agcgtgaccatgctgctgatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaagccatcagctttgggctacactgctctctctgaccttcatcagaacaaccttttccctgcactatgcctggaaaacgatggctatggttcttagcattgtgtctctgttccccctctgtctgtccacaaccagccagaagaccacatggctccctgtgctgcttgggtctctgggatgcaagccgctgaccatgtttctcatcgccgagaataaaatttggggccggaagtcctggcccctgaacgaaggcatcatggcggtcgggatcgtgagcattcttctgtccagcctcctgaaaaacgatgttcctctcgccggacccctgatcgctggcgggatgcttattgcctgttacgtgatctctggaagctccgctgacctgtctctggagaaggccgccgaggtcagctgggaagaggaagctgagcattccggcgcgtctcacaatattctcgtggaagttcaggatgacgggacaatgaaaatcaaggatgaggagcgcgacgatatgctgacgatccttctgaaagccaccctcctggctgtgagcggagtctatcctctctccattcccgccacactgttcgtgtggtacttctggcaaaagaagaaacagagatctggcgtcctttgggacaccccttcccctcccgaagtggagcgggccgttctggatgacggcatctatcgcattatgcagagagggctgctcggacggtcccaggtgggcgtcggggtgtttcaagaaaacgttttccatacaatgtggcacgtgacccgcggagctgtcctgatgtaccagggcaagagacttgagcccagctgggcctctgtgaaaaaggacctgatctcctacgggggaggctggcggctccagggcagctggaatacgggggaggaagtgcaggttattgcggtcgagcccggcaagaatcctaagaatgtgcaaaccgctcccggcacatttaagacctctgaaggggaggtgggagccatcgccctggatttcaaaccgggcacatccgggagccctattgtcaacagagaaggaaagatcgtgggcctctatggcaatggggttgtgaccacatccggaacgtacgtctctgctatcgcccaggcgaaagctagccaggagggccccctgcctgagattgaagacgaggtgtttcgcaagcggaaccttaccatcatggatctgcaccccgggtccggaaaaacaagacgctatctgcccgccattgttcgggaagccatcaagagacgcctccggaccctgattcttgctcctaccagagtggtcgccagcgagatggctgaagccctgaagggcatgccgatccgctaccaaacaacggcggtgaaatctgagcataccgggaaggagatcgttgacctcatgtgccacgccacattcaccatgcggctgctgtcccccgtgagagtccctaattataacatgattatcatggatgaagctcattttacagaccccagctctattgccgctcggggctacatcagcacccgcgtgggaatgggcgaggccgccgctattttcatgacggcgacacctcccgggtccgtggaagcctttcctcagtctaatgctgtcatccaggatgaggaaagagacatcccggagcggagctggaactccggatatgagtggattaccgatttccccggcaaaaccgtttggtttgtgccttctatcaagagcgggaatgacattgccaactgtctccgcaaaaatggaaagagagtgatccagctttcccggaagacattcgataccgaataccagaagacaaagaacaacgactgggactacgtcgtgaccacggatattagcgagatgggcgccaatttcagagctgaccgcgttatcgatccccggagatgcctgaaacctgtgattctgaaggacgggcccgaacgcgtcatcctcgccggcccgatgcctgtgacagttgcgtctgctgcccagcggagaggacgcatcggccggaaccacaataaagagggggatcagtatatttacatgggacagcccctgaacaatgacgaggatcatgcccactggaccgaagctaagatgcttctggacaacatcaatacacccgagggcattatccctgccctctttgaacccgagagagaaaagtccgcggccattgatggggagtatcgcctgagaggagaggctcggaaaaccttcgtggaactgatgcgcagaggcgacctccctgtctggcttagctacaaggtggcctccgaggggtttcaatattctgatcggcgctggtgcttcgacggcgaaagaaacaatcaggtcctggaggaaaacatggatgtggagatctggacgaaagagggagaacggaagaaactgagaccgcgctggctcgacgctcggacctacagcgaccccctggcccttagagagtttaaggagttcgctgccggccgccggtccgtttctggggatctgatcctcgagattggaaaactgcctcagcacctgacacagagagcgcaaaatgccctcgacaaccttgtgatgctgcataatagcgaacagggcgggcgggcttatcgccacgccatggaggagctgcccgataccatcgaaacactcatgctgcttgctctgattgccgtgctcaccggaggcgtcacactgtttttcctgtccggcagagggctcggaaagaccagcatcggccttctgtgtgttatggcctcttccgtgctgctctggatggctagcgtggagcctcattggattgcggcctctatcatcctggaatttttccttatggtcctgctcattcccgagccggaccggcagcgcacgcctcaggataaccaactggcttacgtggttatcgggctgctctttatgattcttacagtggccgccaatgagatgggactgctggaaaccaccaagaaagacctcggcatcgggcacgtcgctgtggagaaccaccatcacgccgcgatgctggatgtcgaccttcatcccgcctccgcttggacactgtacgccgtggctaccacaattatcacgcctatgatgagacacaccattgaaaacacaaccgccaatatcagcctcacagcgatcgccaaccaggctgccattctgatgggactggataagggctggcccatctctaaaatggacattggcgttcctctccttgctctggggtgctatagccaggtgaatcccctgaccctcacggccgctgtcctgatgcttgtggcccattacgcgatcattggaccgggcctgcaagccaaggctacccgggaggcccagaaacgcacagctgccgggatcatgaagaaccctaccgttgatggaatcgtggccattgacctcgatcccgtcgtgtatgacgcgaagttcgaaaaacagctgggccagatcatgctgctcattctttgtacatcccaaatcctgctgatgagaaccacgtgggctctctgcgagtctattacactggccaccgggccccttacaaccctgtgggagggaagccctggcaagttttggaataccacaatcgctgtgtccatggccaacatcttccggggcagctacctcgccggggctggactggccttctccctgatgaaatctctcggcgggggacgcagaggcacgggggcgcagggagaaacccttggcgagaagtggaaacggcagctgaatcagctgagcaagtccgaatttaacacatataagagatctggcattatggaggttgaccgcagcgaagccaaagaggggctcaagcggggagagaccacaaaacacgctgtctccagaggcaccgccaagctgcgctggttcgtggaacggaatcttgtgaaaccggaggggaaggtcatcgatctgggatgtggcagagggggatggtcttactattgcgctggcctcaagaaagttacggaagtgaagggctacacaaaagggggacccggccacgaggaacctattcccatggccacctacgggtggaacctggtgaagctgcatagcggaaaagacgtctttttcatccctcccgagaagtgtgataccctcctttgcgacattggcgagtccagccctaatccgacaatcgaagaggggcgcaccctgcgggtgctgaaaatggttgaaccctggctcagaggaaaccaattttgtattaagatcctgaatccttatatgccctctgtggtcgagacacttgagcagatgcagcgcaagcacggcggcatgctggtgcggaaccctctctccagaaatagcacgcatgaaatgtactgggtttcttgcgggaccggaaacatcgtgtccgcggtcaatatgacaagccgcatgctgctgaaccggttcaccatggcccacagaaaacccacatatgagcgcgatgtggacctcggcgctgggaccagacacgtggccgtcgaaccggaggttgctaacctggatattatcggacagcggattgaaaatatcaagcatgagcacaaatctacgtggcattacgacgaggataacccttataagacctgggcctaccacggctcctatgaagtgaaacccagcgggtccgctagctctatggtgaatggagtcgtgaaacttctgacaaagccctgggacgttattcctatggtgacccaaatcgccatgacagataccacaccctttggccagcagcgcgtcttcaaagagaaggtggacaccagaacgcctaaagcgaagcggggcacagcccaaatcatggaagttaccgctaaatggctctgggggtttctgagcagaaacaagaagccgcggatttgtacccgcgaggagttcacaagaaaagtgcggtccaatgccgctatcggagccgtctttgtggacgagaaccagtggaactctgccaaggaggcggttgaagatgagcgcttctgggaccttgtgcatagagaacgggagctgcacaaacagggcaagtgcgctacgtgcgtctacaacatgatggggaaacgcgaaaagaagctcggagagtttggcaaagccaaggggagcagagccatttggtacatgtggctgggcgctcggttcctggagttcgaagccctcggatttatgaatgaggatcactggttctcccgcgaaaactctctgagcggcgtggagggggagggacttcataaactgggctatatcctcagagacatttccaagatccccgggggaaatatgtacgctgatgacaccgccggctgggatacacggatcaccgaagacgatctgcagaacgaggcgaaaattacagacatcatggaacctgagcacgcccttctggctaagtctatttttaaactcacctatcaaaataaggtcgtgcgcgttcagagacccgccaagaacgggacagtgatggatgtcatcagccggcgcgaccagagaggctccggacaggtgggcacctacgggctgaatacgttcaccaacatggaagctcaactgattcggcagatggagagcgagggaatcttttctccttccgaactcgagacacccaacctggccggcagagtgcttgattggctggaaaaacatggggttgagcgcctcaagcggatggcgatcagcggagacgactgtgtggtcaaaccgattgatgacagattcgccaccgctctgacagcccttaatgatatgggcaaggtgcgcaaagacatccctcagtgggaaccctctaaggggtggaacgattggcagcaagttcctttttgctcccaccacttccatcagctgattatgaaggacggccgggagatcgtggtcccctgtagaaatcaggatgagctcgtgggacgcgctcgggtcagccagggcgccgggtggtccctgagagaaaccgcttgcctgggaaaatcttatgcccaaatgtggcagctcatgtactttcaccgccgggacctgagacttgcggccaacgctatttgtagcgccgtgcctgttgattgggtgcccacgtcccgcacaacctggagcatccatgcccaccatcagtggatgacaaccgaggacatgctgtctgtctggaatcgggtgtggattgaagagaacccgtggatggaagataagacgcacgtttccagctggggcgacgtgccttatctcgggaaaagagaggaccaatggtgcggatctctgatcggccttaccgctcgggccacatgggcgaccaatatccaggtcgctattaaccaggtgagacgcctgctcgggaatgagaactacctggattacatgacaagcatgaagcggttcaaaaatgaatccgaccccgagggcgccctgtggtga

SEQ ID NO: 19335 - RNA, 9879 nt, synthetic construct
  misc_feature 1..9879: note = derived and/or modified CDS sequence (opt5) from DENV-1__EU482537__SS-prME
  source 1..9879: mol_type = other RNA
agcgtgaccatgctgctcatgctgatgcccaccgcccttgctttccacctgacgacccggggcggggaacctcatatgatcgtcacaaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgctacccgcctcgaaaacattatgtggaaacagatctccaacgagctgaatcatattcttctggaaaacgacatgaagttcacggttgtggtcggagatgtggtgggcatcctcgcccaggggaaaaagatgattcggccgcaacccatggagcacaaatactcttggaaaagctggggaaaggctaagatcatcggcgccgacgtccagaatacaacctttattatcgatgggcctaacacccccgaatgtcctgacgatcagagagcctggaatatttgggaggttgaggactatggattcggcatctttacaaccaacatttggctgaagctgcgcgattcctacacgcaggcttgcgaccaccggcttatgagcgcggccatcaaagattctaaggctgtgcatgccgacatgggctattggatcgaatccgagaaaaatgaaacatggaagctcgccagagctagcttcattgaggtgaagacctgtatctggcccaaatctcacacactgtggtccaacggggtcctggaaagcgagatggtgattccgaagatctacggaggccctatttctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggttaaggaaaaggaggaaaatcttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaacgatctgatccggctttgcattatggtcggcgccaatgcctctgacagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgtgagcctgttccccctctgtctgtctacaacctcccagaagaccacatggcttcctgtcctgctggggagcctcggatgcaaaccgctgaccatgtttcttatcgctgagaataagatttggggcagaaaatcttggcccctgaacgaaggcatcatggccgtgggggttgtgtccatcctcctgagctccctcctgaagaacgatgtccctcttgcgggacccctgattgccggcgggatgctgatcgcttgttatgtgattagcggatctagcgccgacctctccctggagaaagctgccgaggtttcttgggaagaggaagccgagcacagcggcgcttcccataatatccttgtggaagtccaggatgacgggacaatgaagattaaagatgaggagcgggacgatacgctgaccatcctcctgaaggcgacactcctggccgtgtctggagtctaccctcttagcatccccgctaccctgttcgtgtggtatttttggcaaaagaaaaagcagcgctccggcgttctgtgggacacaccttctcccccggaagtggagagagccgtcctcgatgacggcatttaccggatcatgcagcgcgggctgcttggaagaagccaggtgggcgttggggtgttccaagaaaacgtcttccacaccatgtggcacgtgacgcggggagccgtgctgatgtatcagggcaaacgcctcgagccttcctgggctagcgttaagaaagacctgatttcttacgggggaggctggagactccagggctcctggaataccggggaggaagtccaggtgatcgccgtggagcccggaaagaaccctaagaatgtccaaacagcgcccggcacctttaaaacaccggaaggggaggtgggagctattgccctggatttcaagcctggcaccagcgggtctcccatcgttaaccgggaaggaaaaattgtgggcctttacggcaatggggtcgtgacaacgtccggaacctatgttagcgccatcgctcaggccaaggcgtcccaggagggccctctgcccgagatcgaagacgaggtgtttagaaaacgcaacctgacaattatggatctccatcccgggtctggaaagacccggagatacctgcctgctatcgtccgcgaagccattaagcggaaacttagaaccctgatcctcgccccgacacgcgtggttgctagcgagatggccgaagctctgaagggcatgcccattcggtatcaaacgaccgccgtgaaatccgagcacacagggaaggagatcgtcgacctgatgtgccatgcgaccttcacaatgagactccttagccctgtgcgcgtgcccaattacaacatgatcattatggatgaagcccactttaccgacccttcttccatcgctgcccggggctatattagcacgagagtcggaatgggcgaggctgccgccatcttcatgacagctacaccccctgggtctgttgaagcgtttccgcagagcaatgccgtgattcaggatgaggaacgggacatccccgagcgctcctggaactctggatacgagtggatcaccgatttccctggcaaaacagtgtggtttgtccccagcattaagtccgggaatgacatcgctaactgtctgagaaagaatggaaaacgggtgattcagctgtctcgcaagaccttcgatacagaatatcagaagaccaagaacaacgactgggactacgttgtgacgacagatatcagcgagatgggcgccaattttagagccgaccgggtcattgatcctagacgctgcctcaaacccgtgatcctgaaggacgggccggaacgggttattcttgctggccctatgcccgtgaccgtcgcctccgcggctcagagacgcggacggatcggcagaaaccataataaggagggggatcagtacatctatatgggacagcccctgaacaatgacgaggatcacgcccactggacagaagccaaaatgctcctggacaacattaatacccctgagggcatcattcccgctctgttcgaacctgagcgcgaaaagagcgccgcgatcgatggggagtaccggctcagaggagaggcccgcaaaacgttcgtggaacttatgagacggggcgacctgccggtctggctgtcttataaggtggcttccgaggggtttcaatacagcgatcgcagatggtgcttcgacggcgaacggaacaatcaggttctcgaggaaaacatggatgtggagatttggaccaaagagggagaacgcaagaaactgagaccccggtggcttgacgccagaacatattccgaccctctggctctccgcgagtttaaggagttcgccgctggccggagatctgtgagcggggatctgatcctggagatcggaaagctcccccagcatcttacccagcgcgcccaaaatgcgctggacaacctggtcatgctccacaattccgaacagggcgggcgggcctacagacatgctatggaggagctgcctgatacaattgaaacccttatgctgctcgccctgatcgctgttctgacaggaggcgtgaccctctttttcctttctggccgggggctgggaaaaacgagcattggcctgctctgtgtgatggcctccagcgtcctgctttggatggcctctgtggagccccactggatcgctgcgtccattatcctggaatttttcctcatggttctgctgatcccggagcctgaccgccagagaacaccccaggataaccaactcgcctatgtggtcattgggcttctgtttatgatcctgaccgtggctgccaatgagatgggactcctggaaaccacaaagaaagaccttggcattgggcacgtcgccgtggagaaccatcaccatgctaccatgctggatgttgacctccaccctgccagcgcgtggacactgtacgccgtggctacgaccatcattacacccatgatgcggcataccatcgaaaacacaaccgccaatatttctctgacggctatcgccaaccaggcggccatcctcatgggacttgataagggctggcctatttccaaaatggacatcggcgtccccctgctggctctcgggtgctacagccaggtgaatccgctgacccttacagccgctgttctgatgctcgtggcccactatgctattatcggacctggcctgcaagccaaggcgacccgcgaggcccagaagagaacagctgccgggattatgaaaaaccccaccgtcgatggaatcgtggctatcgacctggatcccgtggtttacgacgccaagttcgaaaaacagctcggccagattatgcttctgatcctgtgtacgtctcaaattctcctgatgcggacaacctgggccctttgcgagagcatcacactggcgaccgggcctctcaccacactgtgggagggatccccgggcaagttttggaatacgaccattgctgtctctatggccaacatcttccgcggcagctatctggctggggccggactcgccttttcccttatgaaaagcctgggcgggggaagacggggcacaggggctcagggagaaaccctgggcgagaagtggaagcgccagctcaatcagctgtccaaatctgagttcaacatctacaagagaagcggcattatggaggtggaccggtccgaagccaaagaggggcttaagagaggagagacaacccgccacgcggtgtctcggggcacggccaaactgagatggttcgtcgaacgcaatctcgttaagcccgaggggaaggtgatcgatctgggatgtggcagagggggatggagctattactgcgctggcctgaaaaaggtgacagaagtcaaaggctataccaaagggggacctggccatgaggaacccattcctatggccacctacgggtggaacctcgtgaaacttcactccggaaaggacgtctttttcacaccccctgagaaatgtgataccctgctgtgcgacatcggcgagtctagcccgaatcccacaattgaagaggggagaacgctccgcgtgctgaagatggtcgaaccttggcttcggggaaaccaattttgtatcaagattctgaatccctacatgccttccgtggttgagaccctcgagcagatgcagagaaaacatggcggcatgctggtgcgcaaccccctgagcagaaattctacacacgaaatgtattgggtctcctgcgggaccggaaacatcgtgagcgctgtgaatatgacatctagaatgctcctgaaccgcttcaccatggcccaccggaagccgacgtacgagagagatgtcgaccttggcgcggggacccgccatgttgccgtggaacctgaggtggctaacctggatatcattggacagagaatcgaaaatattaaacacgagcataagtccacatggcactatgacgaggataacccctacaaaacctgggcctatcatggcagctacgaagtcaagccctctgggtccgctagctccatggtgaatggagttgtgaagctcctgacaaaaccttgggacgtcatccccatggtgacccaaattgccatgacagataccacgccttttggccagcagcgggttttcaaggagaaagtggacacacgcaccccgaaggctaaaagaggcaccgcccaaatcatggaagtcacagcgcggtggctttgggggtttctgagcagaaacaagaagccccggatctgtacgcgcgaggagttcaccagaaaagtgcggtctaatgccgctattggagccgtttttgtggacgagaaccagtggaatagcgctaaggaggccgtcgaagatgagcgcttctgggacctcgtgcagaaagaaagagagctgcacaagcagggcaaatgcgccacatgcgtctataacatgatggggaagcgggaaaagaaactgggagagtttggcaaggcgaaagggtcccgcgctatctggtacatgtggctcggcgccagattcctggagtttgaagcccttggattcatgaatgaggatcactggttctctcgggaaaacagcctgtccggcgtggagggggagggactccataagctgggctacattcttcgcgacatctctaaaattcctgggggaaatatgtatgctgatgacaccgccggctgggatacaagaatcaccgaagacgatctgcaaaacgaggctaagatcacagacattatggaacccgagcacgccctcctggcgaccagcatctttaaactgacgtaccagaataaggttgtgcgggtccagcgccctgccaagaacgggaccgtgatggatgtgatttccagacgggaccagcgcggctctggacaagttggcacatatgggctcaataccttcacaaacatggaagctcagctgatcagacagatggagagcgagggaatttttcttccctccgaactggagaccccgaacctcgccgaacgggtgctggattggcttgagaaacatggcgtcgaaagactgaagcgcatggctatcagcggggacgactgtgtggttaaacctatcgatgaccggttcgccacggcgctcacagccctgaatgatatgggaaaggtgagaaaagacattccccagtgggagccttctaagggctggaacgattggcaacaggtccccttttgctcccaccacttccatcagctgatcatgaaggacgggcgcgagattgtggtcccttgtcggaatcaggatgaactcgtgggcagagctcgcgttagccaaggagccggctggtctctgcgggagaccgcttgccttgggaaatcctacgcccagatgtggcagctgatgtattttcacagacgcgacctccggctggctgccaacgcgatctgtagcgccgtgcccgtcgattgggtgccgacatccagaaccacgtggtctattcatgctcaccatcaatggatgaccacagaagacatgcttagcgtttggaatcgcgtgtggatcgaggaaaacccttggatggaggataagacccacgtctccagctggggagacgtgccctacctgggcaaacgggaggaccagtggtgcgggtctctcattggactgacagccagagccacctgggcttccaatatccaggtggccatcaaccaggttcggagactgattggcaatgaaaactatctcgattacatgacaagcatgaagcgcttcaaaaatgagggggaccccgaaggcgcgctgtggtga

SEQ ID NO: 19336 - RNA, 9879 nt, synthetic construct
  misc_feature 1..9879: note = derived and/or modified CDS sequence (opt5) from DENV-1__EU482538__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacagagagaaacctgtgaacatcgaagccgagccccccttcggcgagtcttatattgtgatcggggccggagaaaaggctctgaaacttagctggtttaagaagggctcctctattgggaaaatgttcgaggccaccgctcgcggcgcccggagaatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactgaattcccgcagcacctctctctccatgacatgtatcgccgttggcctggtgaccctgtaccttggggtcatggtgcaggctgatagcggatgcgttattaactggaagggccgggaactcaaatgtgggtccggaatctttgtgacaaatgaggtccacacctggacagaacaatataagttccaggccgactctcctaagagactgagcgcggccattggcaaagcttgggaggagggggtgtgcggcatccgctccgccacccggctggaaaacatcatgtggaagcagatttctaacgagctcaatcatatcctgcttgaaaacgacatgaaactgacggttgtggtcggagatgtggctggcattctcgcccaggggaagaaaatgatcagaccgcaacccatggagtacaagtatagctggaaatcctggggaaaggccaagattatcggcgctgacgtgcagaatacaacctttatcattgatgggcctaacaccctggaatgtcccgacgatcagcgcgcgtggaatatctgggaggtcgaggactacggattcggcatttttacaaccaacatctggctgaaacttcgggatagctatacgcaggtttgcgaccacagactcatgtctgccgctattaaggattccaaagccgtgcacgccgacatgggctactggatcgaaagcgagaagaatgaaacatggaaactggctcgcgcctctttcatcgaggtgaagacctgtatttggcctaagtcccatacactgtggagcaacggggtcctcgaatctgagatgatcattcccaaaatctatggaggcccgattagccaacacaattaccggcctgggtacttcacccagacagcgggaccctggcatctgggcaagcttgagctggattttgacctctgcgaagggaccacggtggttgtggatgagcactgcggaaacagaggcccttccctgcggaccacaaccgtcacaggcaaaatcatccacgaatggtgttgccgcagctgtaccctgccccctcttagattcaagggggaggacggatgctggtatggcatggagattcggcccgtgaaagaaaaggaggaaaatctcgttaagtctatggtgtccgctgggagcggagaggtcgactccttttctctgggcctgctctgtatcagcattatgatcgaagaggtgatgagatcccgctggtctcggaaaatgctgatgacggggacacttgccgttttctttctgctcattatgggacagctgacctggaacgatctgatcagactttgcattatggtgggcgccaatgctagcgaccgcatgggcatggggacaacctacctggccctcatggcgaccttcaagatgagaccgatgtttgctgtcggactgctcttccggcgcctgacatccagagaggtgcttctgctcacgatcggcctgtctctggtggccagcgtcgaacttcctaactccctggaggaactcggggatggactggccatgggcatcatgattctcaaactgcttaccgactttcaaagccatcagctgtgggctacactcctgtctctgaccttcatccggacaaccttttcccttcactatgcctggaagacgatggctatggttctgagcattgtgtctctcttccccctgtgtctctccacaaccagccagaaaaccacatggctgcccgtgcttctggggtctctgggatgcaagcctctcaccatgtttctgatcgccgagaataagatttggggccgcaaatcctggccgcttaacgaaggcatcatggcggtcgggatcgtgagcattctgctctccagcctgctcaagaacgatgttcccctggccggacctcttatcgctggcgggatgctgattgcctgttacgtgatctctggaagctccgctgacctgtctctcgagaaagccgccgaggtcagctgggaagaggaagctgagcattccggcgcgtctcacaatattctggtggaagttcaggatgacgggacaatgaagatcaaagatgaggagagagacgatacgcttaccatcctgctcaaggccacactgctcgctgtgagcggagtctatcccctgtccattcctgccacccttttcgtgtggtacttctggcaaaaaaagaagcagcggtctggcgtcctgtgggacacacccagccctcccgaagtggagcgcgccgttctggatgacggcatctatagaattatgcagcgggggctcctgggacgctcccaggtgggcgtcggggtgtttcaagaaaacgttttccataccatgtggcacgtgacgagaggagctgtccttatgtaccagggcaaacggctggagccgagctgggcctctgtgaagaaagacctcatctcctacgggggaggctggagactgcagggcagctggaataccggggaggaagtgcaggttattgcggtcgagcctggaaagaaccccaaaaatgtgcaaacagctcctggcacctttaagacatctgaaggggaggtgggagccatcgccctcgatttcaagcccggcacctccgggagcccgattgtcaaccgcgaaggaaaaatcgtgggcctgtatggcaatggggttgtgacaacgtccggaacctacgtctctgctatcgcccagacaaaggcgagccaggagggccctcttcccgagattgaagacgaggtgtttcggaaaagaaacctgaccatcatggatctgcaccctgggtccggaaagacccgccggtatctccccgctattgttagagaagccatcaaacgccggctgagaacacttattctggcccccacgcgcgtggtcgctagcgagatggccgaagctctcaagggcatgcctatccggtaccaaaccacagccgtgaagtctgagcataccgggaaagagatcgttgacctgatgtgccacgcgacattcaccatgagactgctctccccggtgcgggtccccaattataacatgattatcatggatgaagcccattttacggaccctagctctattgctgcccgcggctacatcagcacaagagtgggaatgggcgaggctgccgccattttcatgaccgctaccccccctgggtccgtggaagcgtttccccagtctaatgccgtcatccaggatgaggaacgggacatccctgagcgcagctggaactccggatatgagtggattacagatttcccgggcaagaccgtttggtttgtgccctctatcaaaagcgggaatgacattgctaactgtcttagaaagaatggaaaacgggtgatccagctgtccagaaagacattcgataccgaataccaaaagacgaaaaacaacgactgggactacgtcgtgacaaccgatattagcgagatgggcgccaatttccgcgccgaccgggttatcgatcctagacgctgcctgaagcccgtgattctcaaagacgggcctgaacgggtcatcctggctggccccatgccggtgacagttgcctctgcggctcagagacgcggacggatcggcagaaaccacaataaggagggggatcagtatatttacatgggacagcctcttaacaatgacgaggatcatgcccactggaccgaagccaaaatgctgctcgacaacatcaatacgcccgagggcattatccccgctctgtttgaacctgagcgcgaaaagtccgccgcgattgatggggagtatagactgcggggagaggcccgcaagaccttcgtggaactcatgagacggggcgaccttcccgtctggctgagctacaaagtggcttccgaggggtttcaatattctgatcgcagatggtgcttcgacggcgaacggaacaatcaggtcctggaggaaaacatggatgtggagatctggacaaaggagggagaaagaaaaaagctccgccctcggtggctggacgccagaacctacagcgacccgcttgctctgcgcgagtttaaagaattcgccgctggccggagatccgtttctggggatctcatcctggagattggaaagctgccccagcacctcacacagcgggcccaaaatgcgcttgacaacctggtgatgctgcataatagcgaacagggcgggcgcgcctatagacacgctatggaggagctccctgataccatcgaaacactgatgcttctggccctcattgctgtgctgaccggaggcgtcacgctgtttttcctctccggccgggggcttggaaaaacaagcatcggcctgctgtgtgttatggcctcttccgtgctcctgtggatggccagcgtggagccccattggattgctgcgtctatcatccttgaatttttcctgatggtcctcctgattcctgagcccgaccgccagagaaccccgcaggataaccaactggcctacgtggttatcgggctcctttttatgattctgaccgtggctgccaatgagatgggactgctcgaaacaaccaagaaggacctgggcatcgggcacgtcgccgtggagaaccaccatcacgctgccatgcttgatgtcgacctgcatcctgcgtccgcctggacactctacgctgtggccacgaccattatcacacccatgatgcggcacaccattgaaaacacaaccgctaatatcagcctgacggccatcgcgaaccaggccgctattctgatgggactcgataaaggctggcctatctctaagatggacattggcgttccccttctggccctggggtgctatagccaggtgaatcctctcaccctgacagctgccgtccttatgctggtggctcattacgccatcattggacccggcctccaagcgaaagccacccgcgaggctcagaagagaacagccgctgggatcatgaaaaacccgaccgttgatggaatcgtggccattgacctggatcctgtcgtgtatgacgccaagttcgaaaagcagctgggccagatcatgctccttattctgtgtacgtcccaaatcctgctcatgcggacaacctgggcgctgtgcgagtctattacacttgctaccgggcccctgaccacactctgggagggaagccccggcaaattttggaatacgaccatcgccgtgtccatggctaacatcttccgcggcagctacctggccggggccggactggctttctccctcatgaagtctcttggcgggggaagacggggcacaggggcccagggagaaaccctgggcgagaaatggaagagacagctgaatcagctcagcaaatccgaatttaacacatataagcgctctggcattatggaggttgaccggagcgaagcgaaggaggggctgaaaagaggagagaccacgaagcacgccgtctcccgcggcacagctaaacttcggtggttcgtggatagaaatctggtgaagcctgaagggaaagtcatcgacctcggatgtggccgcgggggatggtcttactattgcgccggcctgaagaaggttaccgaggtgaaaggctacaccaaggggggaccgggccacgaagagcccattcctatggctacatacgggtggaacctggtgaaactccatagcggaaaggatgtctttttcatcccccctgaaaaatgtgacacccttctgtgcgatattggcgagtccagccccaatcctacaatcgaggaagggcggacgctgagagtgctcaagatggttgagccgtggctgcgcggaaaccaattttgtattaaaatccttaatccctatatgccttctgtggtcgaaaccctggagcagatgcagcggaagcacggcggcatgctcgtgagaaaccccctgtcccgcaatagcacacatgagatgtactgggtttcttgcgggaccggaaacatcgtgtccgccgtcaatatgacaagccggatgctgctcaacagattcaccatggcgcaccgcaagcctacgtatgaaagagacgtggatctgggcgccgggacccggcacgtggctgtcgagcccgaagttgccaaccttgacattatcggacagcgcattgagaatatcaaacatgaacacaagtctacatggcattacgatgaggacaacccgtataaaacctgggcttaccacggctcctatgaggtgaagcctagcgggtccgccagctctatggtgaatggagtcgtgaaactgctcacaaagccctgggatgttattcccatggtgacccaaatcgctatgacagacaccacgccttttggccagcagagagtcttcaaggaaaaagtggacacacggacccccaaggccaaaagaggcaccgcgcaaatcatggaggttacagccaagtggctgtgggggtttcttagccggaacaaaaagcctcgcatttgtacgagagaagagttcacccggaaggtgcgctccaatgctgccatcggagctgtctttgtggatgaaaaccagtggaattctgccaaagaggccgttgaggacgaaagattctgggatctggtgcatcgggagcgcgaactccacaagcagggcaaatgcgcgacatgcgtctacaacatgatggggaagagagagaaaaagctgggagaatttggcaaggctaaagggagccgggccatttggtacatgtggctgggcgcccgcttcctcgagttcgaggctctgggatttatgaatgaagaccactggttctccagagagaactctcttagcggcgtggaaggggagggactgcataagctcggctatatcctgcgggatatttccaaaatcccggggggaaatatgtacgccgacgataccgctggctgggacacacgcatcaccgaggatgaccttcagaacgaagccaagattacagatatcatggagcccgaacacgcgctgctcgccaaatctatttttaagctgacctatcaaaataaagtcgtgagagttcagcggcctgctaagaacgggacggtgatggacgtcatcagccgcagagatcagcggggctccggacaggtgggcacctacgggctgaatacattcaccaacatggaggcccaactcattagacagatggaaagcgagggaatcttttctccctccgagctggaaacacctaaccttgctggccgcgtgctggactggctcgagaagcatggggttgaacggctgaaaagaatggccatcagcggagacgattgtgtggtcaagcccattgacgatcgcttcgcgaccgcccttacggctctgaatgacatgggcaaagtgcggaaggatatcccgcagtgggagccttctaaagggtggaacgactggcagcaagttcccttttgctcccaccacttccatcagctcattatgaaggatggcagagaaatcgtggtcccttgtcgcaatcaggacgagctggtgggacgggccagagtcagccagggcgctgggtggtccctgcgcgagacagcctgcctcggaaagtcttatgctcaaatgtggcagctgatgtactttcaccggagagatcttcgcctggccgcgaacgccatttgtagcgctgtgcccgttgactgggtgcctacctcccggacaacctggagcatccatgcccaccatcagtggatgacgaccgaagatatgctctctgtctggaatagagtgtggattgaggaaaacccctggatggaggacaaaacacacgtttccagctgggaagacgtgccgtatctgggcaagcgggaggatcaatggtgcgggtctcttatcggactgaccgccagagctacatgggccaccaatatccaggtcgcgattaaccaggtgcgccggctcctgggcaatgagaactacctggactacatgacaagcatgaaaagattcaagaatgaatccgatcctgagggggctctctggtga

SEQ ID NO: 19337 - RNA, 9879 nt, synthetic construct
  misc_feature 1..9879: note = derived and/or modified CDS sequence (opt5) from DENV-1__EU482539__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgctatagccaggtgaatccgctgacactcaccgctgccgtcctgatgcttgtggctcattacgccatcattggccctgggctgcaagcgaaggccacacgggaagctcagaaacgcaccgccgctggaatcatgaagaaccccacggttgatggcatcgtggccattgacctcgatcccgtcgtgtatgacgccaagttcgagaaacagctggggcagatcatgctgctcattctttgtacactgcaaatcctgctcatgagaaccacatgggcgctgtgcgaatctattacccttgctaccggacctctgacaacgctctgggagggcagcccgggcaagttttggaataccacaatcgccgtgtccatggctaacatcttccgggggtcttacctggccggagccggcctggctttcagcctcatgaaatcccttgggggaggccgcagagggaccggagcccagggcgagacactgggcgaaaagtggaaacggcagctgaatcagctcagcaagtccgagtttaacacctataagagatctgggattatggaagttgaccgcagcgaggcgaaagaaggactgaagcggggcgagacgacaaaacacgccgtctccagagggaccgctaaacttcgctggttcgtggagcggaatctggtgaaacccgaaggaaaggtcatcgatctcggctgtgggagaggaggctggtcttactattgcgccggcctgaagaaagttaccgaggtgaaggggtacacaaaaggaggccctgggcacgaggagcccattcctatggctacctacggatggaacctggtgaagctccatagcggcaaagacgtctttttcattccccctgaaaagtgtgatacacttctgtgcgacattggggagtcctctccgaatcccacgatcgaggaaggacgcaccctgcgggtgctcaaaatggttgagccttggctgagaggcaaccaattttgtattaagatccttaatccctatatgcctagcgtggtcgaaacactggagcagatgcagcgcaagcacggcgggatgctcgtgcggaaccccctgtccagaaatagcacccatgagatgtactgggtttcttgcggaacaggcaacatcgtgtccgccgtcaatatgaccagccgcatgctgctcaaccggttcacgatggcgcacagaaaaccgacctatgaacgcgatgtggacctgggggccggaacaagacacgtggctgtcgagcctgaagttgccaaccttgatattatcggccagcggattgagaatatcaagcatgaacacaaatctacctggcattacgacgaggataacccctataagacatgggcttaccacgggtcctatgaggtgaaacccagcggatctgcctccagcatggtgaatggcgtcgtgaagctgctcaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctgtggggatttctttccagaaacaagaagccccggatttgtacccgcgaagagttcacaagaaaagtgcggagcaatgctgccatcggcgctgtctttgtggacgaaaaccagtggaactctgccaaggaggccgttgaggatgaacgcttctgggacctggtgcatagagagcgggaactccacaaacaggggaagtgcgcgacctgcgtctacaacatgatgggaaaacgcgagaagaagctgggcgaatttgggaaagctaagggcagcagagccatttggtacatgtggctgggagcccggttcctcgagttcgaggctctgggctttatgaatgaagatcactggttctcccgcgagaactctcttagcggggtggaaggagagggcctgcataaactcgggtatatcctgagagacatttccaatatccctggaggcaacatgtacgccgatgacacagctgggtgggatacccggatcacagaggacgatcttcagaatgaagcccgcattaccgacatcatggagcccgaacacgcgctgctcgccaagtctatttttaaactgacgtatcaaaacaaggtcgtgagagttcagcggcctgctaaaaatggcaccgtgatggatgtcatcagccgcagagaccagcggggatccggccaggtggggacatacggactgaacaccttcacaaacatggaggcccaactcattagacagatggaatctgagggcatctttagcccctccgagctggaaaccccgaatcttgctgagcgcgtgctggattggctcgaaaagtatggggttgagcggctgaagagaatggccatcagcggagacgactgtgtggtcaaacctattgatgaccgcttcgcgacggcccttacagctctgaacgatatgggcaaggtgcggaaagacatcccccagtgggaaccttctaaggggtggaatgattggcagcaagttcccttttgctcccatcacttccaccagctcattatgaaagacggcagagagatcgtggtcccttgtcgcaaccaggatgagctggtgggacgggccagagtcagccagggcgctgggtggtctctgcgcgaaaccgcctgcctcggaaagtcctacgctcaaatgtggcagctgatgtattttcatcggagagaccttcgcctggccgcgaatgccatttgtagcgctgtgcccgttgattggatcccgacatcccggaccacgtggtctattcacgcccatcaccagtggatgaccacagaggacatgctcagcgtgtggaacagagtctggatcgaagagaatccttggatggaagataagacccatatctccagctggggcgacgtgccctacctggggaaacgggaggaccaatggtgcggatctcttattggcctgacagccagagctacctgggccacaaacatccaggttgcgattaatcaggtgcgccggctcatcgggaacgagaattacctggattatatgacctccatgaagagattcaaaaacgaaagcgaccccgagggcgctctgtggtga

SEQ ID NO: 19338 - RNA, 9879 nt, synthetic construct
  misc_feature 1..9879: note = derived and/or modified CDS sequence (opt5) from DENV-1__KP188539__SS-prME
  source 1..9879: mol_type = other RNA
agcgtgaccatgctgctcatgctgcttcccacagctctggctttccaccttacgaccagaggcggggagcctcatatgattgtctccaagcaggaacggggaaagtctctgctttttaagacaagcgttggcgtgaacatgtgcaccctgattgccatggacctcggggagctgtgtgaagatacaatgacctacaaatgcccccgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagaacaagatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccattatcacgccccaagctcctacctccgagattcagctgaccgactacggcgccctcacactggactgtagccccagaaccggccttgatttcaacgaaatggtcctgctcacaatgaaagagaagtcttggctggtgcataaacagtggtttcttgacctgcctctcccctggacctccggggccagcacgtcccaagagacatggaatcggcaggatctgctggtcaccttcaagacagctcacgcgaagaaacaggaagtggttgtgctcggatctcaagagggcgccatgcacaccgctctgaccggggccacagaaatccagacgagcggaaccacaaccatttttgccggccatcttaagtgccgcctgaaaatggacaagctcacactgaaagggatgtcctatgtcatgtgtaccggcagcttcaagctggagaaggaagtggctgagacgcagcacggaacagttcttgtgcaggtcaaatacgagggcaccgatgccccgtgcaagatccctttcctcacccaagacgaaaaaggggtgacacagaacggaagactgatcaccgcgaatcccattgtgacagataaggagaaacctgttaacatcgaaacggagccgccctttggcgagtcttatattgtcgtgggggctggagaaaaggccctgaagctctcctggttcaaaaagggcagctctatcgggaaaatgtttgaggccaccgctcggggcgccagacgcatggctattctgggagacacagcctgggatttcggcagcatcgggggactttttacctccgtgggcaagctgatccatcaggtcttcgggacagcgtacggagtgctcttttctggcgttagctggaccatgaaaattgggatcggcattctgctgacgtggcttggactcaattcccggagcacctctctgtccatgacatgtatcgccgtgggcatggtcaccctgtacctcggggtgatggttcaggctgacagcggatgcgtgattaactggaagggcagagaactgaagtgtgggtctggaatcttcgtcacaaacgaggtgcacacctggacagaacaatataaatttcaggccgattcccctaagcgccttagcgctgccattggcaaagcgtgggaggagggggtttgcggcatccggtccgccaccagactggaaaatatcatgtggaagcagatttctaacgagctcaattacatcctgctggaaaacgacatgaaattcacggtggtcgtgggagacgtgaatggcattcttgctcaggggaagaaaatgatccgcccgcaacccatggagcataagtatagctggaagtcctggggaaaagccaagattatcggcgctgatatccagaacacaacctttattatcgacgggcctgatacccccgaatgtcctgacgatcagcgggcctggaatatttgggaggtcgaggactacggattcggcatctttacaaccaacatttggctcaaactgagagattctcacacgcagatgtgcgaccaccgcctgatgagcgccgctatcaaggattccaaagcggttcatgccgacatgggctattggatcgaaagcgagaagaatgaaacatggaagctcgctcgggcctctttcattgaggtgaaaacctgtatctggcccaagtcccacacactgtggagcaacggggtgcttgaatctgagatggtcattccgaaaatctacggaggccctatttcccaacataattatagacccgggtacttcacccagacagccggaccttggcacctgggcaagctcgagctggattttgacctgtgcgaagggaccacggtggttgtggatgagcactgcggataccgcggccccagccttcggaccacaaccgtcacaggcaaaatcatccatgaatggtgttgcagatcttgtaccctccctcccctgcggttccgcggggaggacggatgctggtatggcatggagattagaccggtgaaggaaaaggaggaaaacctggttcggagcatggtgtccgctgggagcggagagatggactctttttccctcggcatcctgtgtgtcagcattcttatcgaagaggtgatgagatcccgctggtctcggaaaatgctgatgacggggacactcgccgttttcctgctgcttattatgggacagctgacctggaatgatctcatcagactgtgcattatggtgggcgcgaacgctagcgaccgcatgggcatggggacaacctacctcgccctgatggccacctttaagatgagacctatgttcgctgtcggacttctgtttcggcgcctcacatccagagaggtgctgctgcttacggtgggcctgtctctcgtcgccagcgttgaactgcccaattccctcgaggaactgggggatggacttgcgatgggcatcatgatgctgaaactcctgaccgacttccaaccccaccagctgtggacaacccttctgtctctcacatttatccggaccagcctgtccctcgattatgcttggaagacgatggccatggccctgagcattgtgtctcttttccctctgtgtctgtccacaaccagccagaaaaccacatggctcccggtgctgcttgggtcttttggatgcaagcccctgaccatgttcctcatcacagagaacaagatttggggccgcaaatcctggcctatcaacgaaggcattatggctgtcgggatcgtgagcatcctgctctcttccctgcttaaggacgatgttcccctggccggacctctgattgctggcgggatgctcatcgcctgttacgtgattagcggatccagcgcggacctgtctcttgagaaagccgctgaggtcagctgggaagaggaagccgagcattccggcacgtctcacaatatcctggtggaagttcaggatgacgggaccatgaagattaaagatgaggagagagacgatacactcaccatcctgctcaaggctacactgcttgccgtgagcggagtctatcccatgtccatccctgccaccctgtttgtgtggtacttctggcagaagaagaagcagcggtctggcgtcctgtgggacacgcccagcccgcctgaagtggagcgcgctgttctcgacgatggcatttatagaatcctgcagcgggggcttctgggacgctcccaggtgggcgtcggggtgttccaagacggagtttttcataccatgtggcacgtgacaagaggcgcggtcctcatgtaccaggggaaacggctggaaccctcttgggccagcgtgaagaaagatctcatttcctacggaggcggctggagattccaggggagctggaacaccggagaggaggtgcaggttatcgctgtcgaacctggcaagaatcccaaaaacgtgcaaacaaccccggggacatttaagacgcctgagggagaagtgggcgccattgccctggacttcaagcccgggacctctggatcccctatcgtcaatcgcgagggcaaaattgtgggcctttatgggaacggagttgtgacaaccagcggcacctacgtctctgctatcgcccaggcgaaggctacacaggaagggcccctgcccgagatcgaggatgaagtgtttaaaaagcggaatctgacgattatggacctccaccctggatccggcaaaaccagacgctatctgccggccatcgttcgggaggccattaagagaaaacttcgcacactgatcctcgctcccacccgggtggtcgccagcgaaatggcggaggctctgaaagggatgcctattagataccaaacaaccgccgtgaagtccgaacatacgggccgcgagatcgttgatctgatgtgccacgccacattcaccatgcggctcctttctcccgtgagagtccctaactataatatgatcattatggacgaggctcattttaccgatcccgccagcatcgctgcccggggatacatttccacacgcgtgggcatgggggaagcggccgctatcttcatgaccgccacacctccgggaagcgtggaggcttttccccagtctaacgccgtcattcaggacgaagagagagatatccctgaacggtcctggaatagcggctatgactggatcaccgacttccccgggaaaacggtttggtttgtgccttctattaagagcggaaacgatatcgccaattgtctgcgcaaaaacggcaagagagtgattcagctgtcccggaagacattcgacaccgagtaccagaagacaaagaataacgattgggactacgtcgtgaccacggatatctctgagatgggggctaacttcagagcggaccgcgttattgatccccggagatgcctcaaaccggtgatcctgaaggaaggccctgagcgcgtcattcttgccggacccatgcccgtgaccgttgctagcgccgcccagcggagaggccgcatcgggcggaatcagaacaaagaaggagaccagtatatctacatgggccaacctctgaataacgatgaggaccacgctcattggacagaggccaagatgctcctggataatattaacacccccgaagggatcattcctgcgctgtttgagccggaaagagagaagtccgctgccatcgacggagaatatcgcctcagaggcgaggcccggaaaacattcgtggagcttatgcgcagaggggatctgcccgtctggctgtcttacaaggtggctagcgaaggctttcagtattccgaccggcgctggtgcttcgacggagagagaaataaccaggtcctcgaagagaatatggatgtggaaatttggaccaaagagggcgagcggaagaaactgagacctcgctggcttgacgcccggacatacagcgatcccctggcgctcagagaatttaaggagttcgccgctgggcgccggtctgtttccagcgacctgatcctggaaatcggaaaactccctcagcaccttaccctgagagcccaaaacgctctggataatctcgtgatgctgcacaactccgagcagggcgggaaggcctatcggcatgctatggaggaacttcccgacacgattgagacactgatgctcctggccctgatcgcggtgctcaccggaggcgtcaccctctttttcctgtctggcaaggggctgggaaaaacaagcattggcctcctgtgtgttatggcctcctctgcccttctgtggatggccagcgtggaaccgcactggatcgctgcctccattatcctcgagtttttcctgatggtgctgctcatccctgaacccgatcgccagagaacccctcaggacaatcaacttgcctacgtcgtgattgggctgctgtttatgatcctcacagttgctgcgaacgagatgggactgcttgagacgaccaagaaagatctgggcattgggcatgtggccgtcgaaaatcaccaccatgctacaatgctcgacgtggatctgcggcccgccagcgcctggaccctgtacgctgtcgccacaaccgtgatcacgcctatgatgcgccacaccattgagaacacaaccgcgaacatctctctcacagccattgctaatcaggccgctatccttatgggactggacaagggctggcccatctccaaaatggatattggcgttccgctgctcgccctggggtgctatagccaggtgaaccctcttaccctgacggcggccgtcctcatgctggtggctcattacgccatcattggacccggcctgcaagctaaggccacaagagaagctcagaagcggaccgccgcggggatcatgaaaaatcccacagttgacggaattgtgaccatcgacctcgatcctgtcgtgtatgacgccaagttcgagaaacagcttggccagatcatgctgctgattctctgtacctctcaaatcctgcttatgcgcacaacgtgggctctgtgcgaatccattaccctcgccacagggccgctgaccacactgtgggagggaagccccggcaagttttggaacaccacgatcgctgtgtctatggccaatattttcagaggcagctacctcgccggggcgggacttgctttctccctgatgaaatctctgggcgggggacggcgcggcacaggggcccagggagagaccctcggcgaaaagtggaagagacagctgaaccagcttagcaaatccgagtttaatacctataagaaaagcggcatcatggaagttgatcggtccgaggctaaggaagggctgaaaagaggagagacaaccaagcacgccgtctctcgcggcacagccaagctccggtggttcgtggagagaaacctggtgaaacctgaagggaaggtcatcgacctgggatgtggccgcgggggatggagctactattgcgctggcctcaaaaaggttacggaggtgaaaggctacaccaaagggggacccggccatgaggagcctattcccatggccacatacgggtggaatcttgtgaaactgcactccggaaaggatgtctttttcacccctccggaaaagtgtgacacactgctctgcgatatcggcgagtctagccccaaccctaccattgaggaagggcggacgctgagagtgcttaaaatggttgagccctggctgcgcggaaatcaattttgtatcaagattctcaacccttatatgccctccgtggtcgaaaccctggagcagatgcagcggaaacacggcggcatgctggtgagaaatccgctctctcgcaacagcacacatgagatgtactgggtttcctgcgggaccggaaatatcgtgagcgcggtcaacatgacatctcggatgctgcttaatagattcaccatggcccaccgcaagcctacatatgaacgggacgtggatctgggcgctgggaccagacatgtggccgtcgagcccgaagttgctaacctcgacattatcggacagcgcatcgagaacattaaaaatgaacacaagtccacgtggcactacgatgaggacaacccctataagacatgggcctaccatggcagctatgaggtgaaaccttctgggtccgcgagctctatggtgaatggagtcgtgagactgcttaccaagccctgggacgttatccctatggtgacccaaattgccatgacagatacgaccccgtttggccagcagcgggtcttcaaagaaaaggtggacacacgcacccccagagctaaacggggcacagcccaaatcatggaggttaccgctaagtggctgtgggggtttctctccagaacaaagaaacctcggatttgtacccgcgaagagttcacgagaaaggtgcggagcaacgccgctatcggagccgtctttgtggatgaaaatcagtggaactccgcgaaagaggccgttgaggacgaacgcttctgggatctggtgcacagagagcgggaactgcataagcagggcaaatgcgctacctgcgtctacaatatgatggggaagcgcgagaagaaactcggagaatttggcaaggccaaagggagcagagctatctggtacatgtggctgggcgcccggttccttgagttcgaggccctgggatttatgaacgaagaccactggttctctcgcgagaatagcctctccggcgtggaaggggagggactgcataaacttggctatattctgagagatatctctaaaattcccgggggaaacatgtacgcggacgatacagctggctgggacacccggatcacagaggatgacctccagaatgaagccaagattaccgatatcatggagcctgaacacgccctgctggctacgagcatctttaaactcacatatcaaaacaaggtcgtgcgcgttcagagacccgccaagtccgggaccgtgatggacgtcatttctcggcgcgaccagagaggcagcggacaggtgggcacatacgggctgaataccttcacgaacatggaggtgcaacttatccggcagatggaatccgagggaatcttttctccgagcgagctggaaacccctaatctcgctaaaaaggttctggattggcttgagaaacacggcgccgaaagactgaagcgcatggcgatctccggggacgattgtgtggtcaaacccattgacgatcggttcgccacagctctcaccgccctgaacgacatgggaaaggtgagaaaggatatccctcagtgggagcccagcaaaggctggaacgactggcagcaagttcctttttgctctcatcacttccatcagctgatcatgaaggatgggcgcgaaattgtggtcccctgtcggaatcaggacgagctcgtgggcagagctcgcgtctcccagggagccggctggagcctgcgggagacagcgtgccttgggaaatcttatgcccaaatgtggcagctgatgtactttcacagacgcgatctccggctggctgccaacgctatctgttccgccgtgccggttgactgggtgcctaccagcagaacaacctggtccattcacgctcatcaccagtggatgacgacagaagacatgctttctgtctggaatcgcgtgtggatcgaggaaaacccctggatggaggataagacccatgttagctcctgggaagaggtgccctatctgggaaaacgggaggaccaatggtgcggcagcctcattgggctgaccgccagagcgacatgggccaccaatatccaggtcgctattaaccaggtgcggagactgatcggaaatgaaaactacctcgattacatgacatctatgaagcgcttcaagaatgagtccgaccctgaaggcgccctgtggtga

SEQ ID NO: 19339 - RNA, 9879 nt, synthetic construct
  misc_feature 1..9879: note = derived and/or modified CDS sequence (opt5) from DENV-1__KP188540__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttttggcgggcctatcagccaacataattaccggcccggatatttcacccagacggccggcccttggcacctcgggaagctggaacttgattttgacctgtgcgagggaaccacagtggttgtggatgaacactgcggcaacagaggcccctctctccggaccacaaccgtcacggggaaaattatccatgagtggtgttgccgcagctgtacactgcctcccctgagattccggggagaggacggctgctggtacgggatggaaattagaccggtgaaggagaaagaagagaatcttgttcgctccatggtgagcgcgggatctggcgaagtcgattcctttagcctcgggatgctgtgtgtgtccatcatgatcgaggaggttatgcggtctagatggagccgcaagatgctgatgaccggaacactcgctgtgttcctgcttctgattatgggccagctcacctggaacgacctgatcagactgtgcattatggtcggcgccaatgcctccgaccggatggggatgggaaccacataccttgctctgatggccacgtttaagatgcgccctatgttcgcggtgggcctcctgtttagacggctcacctctcgcgaagtgctgcttctgacaatcgggctcagcctggtcgcttccgttgagctgcccaactctcttgaagagctgggagatggcctcgccatggggattatgatgctgaaactcctgaccgaattccaaccccaccagctttggacaaccctgctcagcctgacgtttgtgaagacaaccctgtcccttgactatgcctggaaaaccacagctatggtgctgagcatcgtctctctcttccctctgtgtctctccaccacaagccagaagacgacctggctgccggtgcttctgggatcttttggctgcaaacccctgacaatgttcctcattaccgagaacaagatctggggcagaaagtcctggcctctgaatgaggggatcatggccattggaatcgttagcattcttctgtcttccctcctgaaaaacgatgtgcccctcgctggccctctgatcgccgggggaatgcttattgcgtgttacgtcatcagcggctccagcgccgacctgtctctggaaaaggctgccgaggtgagctgggaacaggaggctgaacattccggggcctctcacaatatcctcgttgaggtgcaagatgacggaacaatgaaaattaaggatgaggaacgggacgataccctgacgatccttctgaaagccaccctcctggctgtcagcggcgtgtatcccatgtccattcctgcgacactcttcgtctggtacttttggcagaagaaaaagcagcgctctggcgtgctgtgggacacccccagcccgcctgaggttgaaagagccgtgcttgatgacgggatctatcggattctgcagcgcggactgctcggcagatcccaagtcggggtgggagttttccaggatggcgtgtttcatacaatgtggcacgtcacccggggggctgtgctgatgtaccagggaaagagacttgagccctcttgggccagcgtgaaaaaggacctgatctcctatggcggcgggtggcgcttccagggaagctggaacacaggcgaggaagttcaagtcatcgccgtggagcctgggaaaaatcccaagaacgtgcagacgaccccgggaacatttaaaacccctgaaggcgaggtcggggctattgccctcgacttcaagcccggaacctctggctcccctatcgtgaatcgggaaggcaagattgttgggctgtacggaaacggcgtggtcacaacgagcgggacctacgtgtctgcgatcgctcaggccaaagcctcccaagagggacccctccccgagattgaaaatgaggtttttaagaaaagaaacctgacaatcatggatcttcaccctggcagcgggaagacccgccggtatctgccggctattgtgagagaagccatcaaacgcaagctgcggacactcatcctggcgcccaccagagtcgtggcttccgagatggccgaagcccttaagggcatgcctattcgctaccagacgacagctgttaaatctgagcataccggacgggagatcgtggacctgatgtgccacgccaccttcacaatgagactcctgagccccgtccgggtgcctaattataacatgattatcatggatgaagctcattttaccgaccccgcctccattgcggcccgcggctacatcagcacaagagtggggatgggagaggctgccgctatcttcatgaccgccacgcctccgggctctgtcgaagcctttccccagtccaatgctgttattcaggatgaggaacgggacatccctgagcgcagctggaactctgggtatgattggattacagacttccccggaaagaccgtgtggttcgtgcctagcatcaaatccggcaatgatattgcgaactgtctgagaaagaacgggaaacgggtcatccaactctctagaaagacatttgacaccgagtaccagaagacgaaaaataacgattgggactatgtggttaccacagacatcagcgaaatgggcgccaatttccgcgctgatcgggtgattgaccccagacgctgccttaagccggtcatcctgaaagatggacctgagcgggtgattctggccggccccatgcccgttaccgtggcctccgctgcccagagacgcgggcggatcggaagaaaccagaataaggaaggcgaccaatacgtctacatggggcagcctctcaacaatgatgaggaccacgcgcattggacagaggctaaaatgctgcttgataacattaatacccccgaaggaatcattcctgccctgtttgagccggaacgcgagaagtctgccgctatcgacggcgaatatagactccggggggaggcccgcaagacattcgtggagctgatgagacggggcgatctgcccgtctggctcagctacaaagtggcgtccgaaggatttcagtatagcgaccgcagatggtgcttcgatggcgagcggaacaatcaggttcttgaagagaacatggacgtggaaatctggaccaaggagggggagagaaaaaagctgcgccctcggtggctggatgccagaacgtactctgaccccctcgctctgcgcgaatttaaagagttcgccgctggacggagatccgtgagcggcgaccttattctggaaatcgggaagctccctcaacacctgacactgcgggcccagaatgctctcgataaccttgtcatgctgcacaattccgagcagggaggcaaagcctatcgccatgcgatggaagagctgcccgacaccattgagaccctcatgctgcttgccctgatcgctgttctcacaggcggggccaccctgtttttcctgtctggaaagggcctcgggaagacaagcattggacttctgtgtgtgacggcttcctctgccctgctctggatggccagcgtggaaccgcactggatcgctgcgtccatcattctggagtttttccttatggtcctgctcatccctgaacccgatagacagcggacccctcaagacaaccagctggcctacgtggttattggcctgctctttatgatccttacagtggctgccaacgagatggggctgctggagaccacaaaaaaggatctcggaattggctatgtcgccgctgaaaatcatcagcacgccaccatgctggacgtggatcttcaccccgcgagcgcctggacgctgtacgctgtcgccaccacagtgatcacccctatgatgcgccatacaatcgagaacaccacggctaatatttctctcacagccatcgcgaaccaagccgctattctgatgggcctggacaaagggtggcccatctccaagatggatattggagttccgctccttgccctgggctgctacagccaggtgaatcctctgaccctcacagctgccgtcctgatgcttgtggctcactatgccatcattgggcccggactgcaggcgaaagccaccagagaagctcagaagcggaccgccgctggcatcatgaagaaccccacagttgacgggatcgtggccattgatctcgaccctgtcgtgtacgatgccaaattcgagaagcaactgggacagatcatgctgctcattctttgtacgtctcagatcctgctgatgcgcaccacatgggcgctctgcgaatccattaccctggctacaggcccgcttaccacgctgtgggagggcagccccgggaaattctggaatacaaccatcgccgtgtctatggctaacatctttagaggaagctatctcgccggcgccgggctggctttctccctgatgaagtctctcggaggcgggcggcgcggaaccggcgcccagggcgagacacttggggaaaaatggaagagacaactgaatcagctgagcaagtccgagtttaacacctacaaacggagcggaattatggaagttgacagatccgaggcgaaggaaggcctcaaacgcggggagacaacgaagcatgccgtctctcggggaaccgctaaactgagatggttcgtggagcgcaatcttgtgaagcctgaaggcaaggtcatcgacctggggtgtggacggggcggctggagctattactgcgccgggctcaaaaaggttacagaggtgaaaggatataccaagggcgggcccggacacgaagagcctattcccatggctacatacggctggaacctggtgaaactgcattccgggaaggatgtctttttcatgcctccggaaaaatgtgacaccctcctttgcgatatcggagagtctagccccaatcctacgattgaggaaggcagaaccctgcgcgtgctgaagatggttgagccctggctccggggcaaccagttttgtatcaagatcctgaatccttacatgccctccgtggtcgaaacacttgagcagatgcaaagaaaacacgggggaatgctggtgcgcaacccgctctctcggaatagcacccacgagatgtattgggtttcctgcggcacagggaacattgtgagcgccgtcaacatgacctctagaatgctgctgaatcgcttcacaatggcgcatcggaagcctacctacgaaagagacgtggatctcggagccggcacgcgccacgtggctgtcgagcccgaagttgccaacctggacatcattgggcagagaatcgagaatattaaaaacgaacataagtccacatggcactatgatgaggacaatccctacaaaacctgggcttatcacggaagctacgaggtgaagccttctggctccgccagctctatggtgaacggcgtcgtgcggcttctgaccaagccctgggatgttatccctatggtgacacagattgctatgacggacaccacaccgtttgggcaacagcgcgtcttcaaagaaaaggtggataccagaacaccccgggccaaaagaggaaccacacagatcatggaggttaccgcgaagtggctctggggctttctgtcccggaataaaaagcctcgcatctgtacgagagaagagttcacccggaaggtgcgcagcaacgccgctattggggccgtctttgtggacgaaaatcagtggaactccgctaaagaggccgttgaggacgaaagattctgggatcttgtgcatcgggagcgcgaactgcacaagcaaggaaaatgcgccacatgcgtctataatatgatgggcaagagagagaaaaagctcggggaattcggcaaggcgaaaggaagccgggctatctggtacatgtggctgggcgcccgctttctggagttcgaggccctcgggtttatgaacgaagaccattggttctctagagagaatagcctgtccggagtggaaggcgaggggcttcacaagctgggatacattctccgggatatctctaaaattcccggcgggaacatgtatgctgacgataccgccggctgggacacacgcatcaccgaggatgacctgcagaatgaagctaagatcacggatattatggagcctgaacatgcccttctggcgacaagcatctttaaactcacctaccagaacaaggtcgtgagagttcagcggcccgccaaaaacggaacagtgatggacgtcatttcccgcagagatcaacggggctctgggcaggtgggaacctatggcctgaatacgttcaccaacatggaggtgcagctgatcagacagatggaaagcgaggggatttttctcccgtccgagctggaaacacctaatcttgctgagcgcgccctggactggctcgaaaagcacggagctgagcggctgaagagaatggccatctctggcgatgactgtgttgtgaaacccatcgacgatcgcttcgcgaccgcccttacagctctgaacgacatggggaaggtccggaaagatattcctcaatgggaacccagcaagggctggaatgactggcagcaggtgcctttttgctcccaccatttccaccagctcatcatgaaagatggaagagagattgttgtgccctgtcgcaaccaagacgagctggtcggccgggccagagtgagccagggggctggatggtctctgcgcgaaaccgcctgcctcggcaagtcctacgctcagatgtggcaactgatgtattttcatcggagagatcttcgcctggccgcgaatgccatctgtagcgctgtcccggtggactgggttcctgcctctcggacaacctggtccattcacgcccaccatcagtggatgacgacagaggatatgctcagcgtgtggaacagagtctggatcgaagagaatccctggatggaagacaagacccacgtgtcctcttgggaggaggttccctacctggggaaacgggaagatcagtggtgcggaagccttatcggcctgaccgctagagccacatgggcgaccaacattcaggtggctatcaatcaagtccgccggctcattgggaacgagaattatctggactacatgacatccatgaagagattcaaaaacgaaagcgaccctgagggcgccctgtggtga

SEQ ID NO: 19340 - RNA, 9879 nt, synthetic construct
  misc_feature 1..9879: note = derived and/or modified CDS sequence (opt5) from DENV-1__KP188541__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttttggcgggcctatcagccaacataattaccggcccggatatttcacccagacggccggcccttggcacctcgggaagctggaacttgattttgacctgtgcgagggaaccacagtggttgtggatgaacactgcggcaacagaggcccctctctccggaccacaaccgtcacggggaaaattatccatgagtggtgttgccgcagctgtacactgcctcccctgagattccggggagaggacggctgctggtacgggatggaaattagaccggtgaaggagaaagaagagaatcttgttcgctccatggtgagcgcgggatctggcgaagtcgattcctttagcctcgggatcctgtgtgtgtccatcatgattgaggaggttatgcggtctagatggagccgcaagatgctgatgaccggaacactcgctgtgttcctgcttctgatcatgggccagctcacctggaacgacctgattagactgtgcatcatggtcggcgccaatgcctccgaccggatggggatgggaaccacataccttgctctgatggccacgtttaagatgcgccctatgttcgcggtgggcctcctgtttagacggctcacctctcgcgaagtgctgcttctgacaattgggctcagcctggtcgcttccgttgagctgcccaactctcttgaagagctgggagatggcctcgccatggggatcatgatgctgaaactcctgaccgaattccaaccccaccagctttggacaaccctgctcagcctgacgtttgtgaagacaaccctgtcccttgactatgcctggaaaaccacagctatggtgctgagcattgtctctctcttccctctgtgtctctccaccacaagccagaagacgacctggctgccggtgcttctgggatcttttggctgcaaacccctgacaatgttcttcatcaccgagaacaagatctggggcagaaagtcctggcctctcaatgaggggattatggccatcggaattgttagcatcctgctttcttccctgctcaaaaacgatgtgcccctggctggccctctcattgccgggggaatgctgatcgcgtgttacgtcatcagcggctccagcgccgacctttctctggaaaaggctgccgaggtgagctgggaacaggaggctgaacattccggggcctctcacaatattctggttgaggtgcaagatgacggaacaatgaaaatcaaggatgaggaacgggacgataccctcacgattctgcttaaagccaccctgctcgctgtcagcggcgtgtatcccatgtccatccctgcgacactgtttgtctggtacttctggcagaagaaaaagcagcgctctggcgtgctctgggacacccccagcccgcctgaggttgaaagagccgtgctggatgacgggatttatcggatccttcagcgcggactgctgggcagatcccaagtcggggtgggagtttttcaggatggcgtgttccatacaatgtggcacgtcacccggggggctgtgctcatgtaccagggaaagagactggagccctcttgggccagcgtgaaaaaggaccttatctcctatggcggcgggtggcgctttcagggaagctggaacacaggcgaggaagttcaagtcattgccgtggagcctgggaaaaatcccaagaacgtgcagacgaccccgggaacattcaaaacccctgaaggcgaggtcggggctatcgccctggactttaagcccggaacctctggctcccctattgtgaatcgggaaggcaagatcgttgggctctacggaaacggcgtggtcacaacgagcgggacctacgtgtctgcgattgctcaggccaaagcctcccaagagggacccctgcccgagatcgaaaatgaggttttcaagaaaagaaacctcacaattatggatctgcaccctggcagcgggaagacccgccggtatcttccggctatcgtgagagaagccatcaaacgcaagctgcggacactgattctcgcgcccaccagagtcgtggcttccgagatggccgaagccctgaagggcatgcctatccgctaccagacgacagctgttaaatctgagcataccggacgggagattgtggaccttatgtgccacgccacctttacaatgagactgctcagccccgtccgggtgcctaattataacatgatcattatggatgaagctcatttcaccgaccccgcctccatcgcggcccgcggctacatcagcacaagagtggggatgggagaggctgccgctatttttatgaccgccacgcctccgggctctgtcgaagccttcccccagtccaatgctgttatccaggatgaggaacgggacattcctgagcgcagctggaactctgggtatgattggatcacagacttccccggaaagaccgtgtggtttgtgcctagcattaaatccggcaatgatatcgcgaactgtctgagaaagaacgggaaacgggtcatccaactgtctagaaagacattcgacaccgagtaccagaagacgaaaaataacgattgggactatgtggttaccacagacattagcgaaatgggcgccaattttcgcgctgatcgggtgatcgaccccagacgctgcctcaagccggtcattcttaaagatggacctgagcgggtgatcctggccggccccatgcccgttaccgtggcctccgctgcccagagacgcgggcggattggaagaaaccagaataaggaaggcgaccaatacgtctacatggggcagcctctgaacaatgatgaggaccacgcgcattggacagaggctaaaatgctcctggataacatcaatacccccgaaggaattatccctgcccttttcgagccggaacgcgagaagtctgccgctatcgacggcgaatatagactgcggggggaggcccgcaagacatttgtggagctcatgagacggggcgatctgcccgtctggctgagctacaaagtggcgtccgaaggattccagtatagcgaccgcagatggtgctttgatggcgagcggaacaatcaggttctcgaagagaacatggacgtggaaatttggaccaaggagggggagagaaaaaagcttcgccctcggtggctggatgccagaacgtactctgaccccctggctctccgcgaattcaaagagtttgccgctggacggagatccgtgagcggcgacctgatccttgaaattgggaagctgcctcaacacctcacactgcgggcccagaatgctctggataacctcgtcatgcttcacaattccgagcagggaggcaaagcctatcgccatgcggttgaagagctgcccgacaccatcgagaccctgatgctcctggcccttattgctgtgctgacaggcggggtgaccctcttctttctgtctggaaagggcctggggaagacaagcatcggactcctttgtgtcacggcctcctctgctctgctgtggatggccagcgtggaaccgcactggatcgccgcttccattatcctcgagttctttctgatggttcttctgattcctgaacccgatagacagcggacccctcaagacaaccagctcgcgtacgtggtcatcggcctgctgttcatgattctcacagtggccgctaacgagatggggcttctggagaccacaaaaaaggatctgggaatcggctatgtcgccgccgaaaatcatcagcacgctaccatgctcgacgtggatctgcaccccgccagcgcgtggacgctttacgccgttgctaccacagtgatcacccctatgatgcgccatacaattgagaacaccacggccaatatctctctgacagctattgccaaccaagcggccatcctcatgggcctggacaaagggtggcccatttccaagatggatatcggagtcccgctgctcgctcttggctgctacagccaggtgaatcctctgaccctgacagccgctgttctcatgctggtggcccactatgctattatcgggcccggacttcaggccaaagcgaccagagaagcccagaagcggaccgctgccggcatcatgaagaaccccacagtcgacgggattgtggctatcgatctggaccctgtggtttacgatgccaaattcgagaagcaactcggacagattatgctgctgatcctctgtacgtctcagattcttctgatgcgcaccacatgggccctgtgcgaatccatcaccctcgcgacaggcccgctgaccacgctttgggagggcagccccgggaaattttggaatacaaccatcgctgtctctatggccaacattttcagaggaagctatctggctggcgccgggctcgccttttccctgatgaagtctctgggaggcgggcggcgcggaaccggcgctcagggcgagacactcggggaaaaatggaagagacaacttaatcagctgagcaagtccgagttcaacacctacaaacggagcggaatcatggaagtggacagatccgaggccaaggaaggcctgaaacgcggggagacaacgaagcatgcggtgtctcggggaaccgccaaactcagatggtttgtcgagcgcaatctggttaagcctgaaggcaaggtgattgaccttgggtgtggacggggcggctggagctattactgcgctgggctgaaaaaggtgacagaggtcaaaggatataccaagggcgggcccggacacgaagagcctatccccatggccacatacggctggaacctcgtgaaactgcattccgggaaggatgttttctttatgcctccggaaaaatgtgacaccctgctctgcgatattggagagtctagccccaatcctacgatcgaggaaggcagaacccttcgcgtgctgaagatggtcgagccctggctgcggggcaaccagttctgtatcaagattctcaatccttacatgccctccgtggttgaaacactggagcagatgcaaagaaaacacgggggaatgcttgtgcgcaacccgctgtctcggaatagcacccacgagatgtattgggtctcctgcggcacagggaacatcgtgagcgctgtgaacatgacctctagaatgctcctgaatcgctttacaatggcccatcggaagcctacctacgaaagagacgtcgatctgggagcgggcacgcgccacgttgccgtggagcccgaagtggctaacctcgacattatcgggcagagaattgagaatatcaaaaacgaacataagtccacatggcactatgatgaggacaatccctacaaaacctgggcctatcacggaagctacgaggtcaagccttctggctccgctagctctatggtgaacggcgttgtgcggctgcttaccaagccctgggatgtcattcctatggtgacacagatcgccatgacggacaccacaccgttcgggcaacagcgcgtttttaaagaaaaggtggataccagaacaccccgggctaaaagaggaaccacacagatcatggaggtcaccgccaagtggctgtggggcttcctctcccggaataaaaagcctcgcatttgtacgagagaagagtttacccggaaggtgcgcagcaacgcggccatcggggctgttttcgtggacgaaaatcagtggaactccgccaaagaggctgtcgaggacgaaagattctgggatctggtgcatcgggagcgcgaacttcacaagcaaggaaaatgcgccacatgcgtctataatatgatgggcaagagagagaaaaagctgggggaatttggcaaggccaaaggaagccgggcgatttggtacatgtggctcggcgctcgcttcctggagtttgaggccctggggttcatgaacgaagaccattggttttctagagagaatagcctctccggagtggaaggcgaggggctgcacaagcttggatacatcctgcgggatatttctaaaatccccggcgggaacatgtatgccgacgataccgctggctgggacacacgcatcaccgaggatgacctccagaatgaagccaagattacggatatcatggagcctgaacatgctctgcttgccacaagcattttcaaactgacctaccagaacaaggttgtgagagtccagcggcccgcgaaaaacggaacagtgatggacgtgatctcccgcagagatcaacggggctctgggcaggttggaacctatggcctcaatacgtttaccaacatggaggtgcagctgattagacagatggaaagcgaggggatcttcctgccgtccgagctcgaaacacctaatctggccgagcgcgctcttgactggctggaaaagcacggagccgagcggctcaagagaatggctatctctggcgatgactgtgtcgtgaaacccattgacgatcgctttgccaccgcgctgacagcccttaacgacatggggaaggttcggaaagatatccctcaatgggaacccagcaagggctggaatgactggcagcaggtgcctttctgctcccaccattttcaccagctgattatgaaagatggaagagagatcgtcgtgccctgtcgcaaccaagacgagctcgtcggccgggctagagtgagccagggggccggatggtctctgcgcgaaaccgcttgcctgggcaagtcctacgcccagatgtggcaactcatgtatttccatcggagagatctgcgccttgctgccaatgcgatttgtagcgccgttccggtggactgggtccctgcttctcggacaacctggtccatccacgcccaccatcagtggatgacgacagaggatatgctgagcgtgtggaacagagtttggatcgaagagaatccctggatggaagacaagacccacgtgtcctcttgggaggaggtcccctacctcgggaaacgggaagatcagtggtgcggaagcctgattggccttaccgccagagctacatgggccaccaacatccaggtggcgattaatcaagtgcgccggctgatcgggaacgagaattatctcgactacatgacatccatgaagagatttaaaaacgaaagcgaccctgagggcgctctgtggtga

SEQ ID NO: 19341 - RNA, 9879 nt, synthetic construct
  misc_feature 1..9879: note = derived and/or modified CDS sequence (opt5) from DENV-1__KP188543__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggtggaacccgacgatgtcgactgttggtgcaatgcgaccgatacgtgggtgacctatggaacatgttcccaaaccggcgagcacagacgggacaagcgctctgttgctctggcccctcatgtggggctcggactggagacaagaaccgaaacgtggatgagctccgagggcgcctggaaacagattcagaaggtcgaaacatgggctcttcggcaccccggcttcaccgtgatcgccctgtttctcgctcatgccattgggacatctatcacccagaagggaatcattttcatcctgcttatgctggttacccctagcatggcgatgcgctgcgtgggcattgggaacagagattttgtcgagggactctccggcgccacatgggtggacgtggtcctggagcacgggagctgtgttacgaccatggctaaaaataagcccacactggatatcgaactcctgaaaaccgaggtgacaaaccctgccgtgcttcggaagctgtgcattgaagctaaaatctctaataccacgacagactcccgctgtccgacccaaggagaggccaccctcgtcgaagagcaggatgcgaacttcgtgtgcagacggacatttgttgaccgcggctggggcaatgggtgtggactgttcggcaaggggagccttctgacctgcgccaagtttaaatgcgtgacaaagctcgagggaaaaattgtccagtacgaaaacctgaagtattctgtgatcgttacggtgcacaccggcgatcagcatcaagtcgggaatgagacaaccgaacacggaacaatcgctaccattacgccccaggcccctacctccgagatccagctgacagactacggcgctctcaccctggactgtagccccagaacaggccttgatttcaacgaaatggtgctgctcaccatgaaagagaagtcttggctggtccataaacagtggtttcttgacctgcctctcccctggacgtccggggccagcacatcccaagagacctggaatcggcaggatctgctggtgacattcaagaccgcccacgctaagaaacaggaagttgtggtcctcggatctcaagagggcgcgatgcacaccgccctgacaggggctacggaaattcagaccagcggaacaaccacaatctttgccggccatcttaagtgccgcctgaaaatggacaagctcaccctgaaagggatgtcctatgtgatgtgtacgggcagcttcaagctggagaaggaagttgccgagacacagcacggaaccgtgcttgtccaggtgaaatacgagggcaccgatgctccgtgcaagattcctttcctcacacaagacgaaaaaggggtgacccagaacggaagactgatcacagccaatcccatcgttacggataaggagaaacctgtcaacattgaaaccgagcccccctttggcgagtcttatatcgtggtgggggcgggagaaaaggctctgaagctctcctggttcaaaaagggcagctctattgggaaaatgtttgaggccacagcccggggcgctagacgcatggccatcctgggagacaccgcttgggatttcggcagcattgggggactttttacatccgtcggcaagctgatccatcaggtgttcgggaccgcctacggagttctcttttctggcgtgagctggacgatgaaaatcgggattggcatcctgctgacctggcttggactcaattcccggagcacatctctgtccatgacctgtattgcggtcggcatggtgacactgtacctcggggttatggtgcaggccgacagcggatgcgtcatcaactggaagggcagagaactgaagtgtgggtctggaattttcgtgaccaacgaggttcacacatggaccgaacaatataaatttcaggctgattcccctaagcgccttagcgccgctatcggcaaagcctgggaggagggggtgtgcggcattcggtccgcgacgagactggaaaatatcatgtggaagcagatctctaacgagctcaattacattctgctggaaaacgacatgaaattcacagtcgtggtgggagacgtcaatggcatccttgcccaggggaagaaaatgattcgcccgcaacccatggagcataagtatagctggaagtcctggggaaaagctaagatcattggcgccgatatccagaacaccacctttatcattgacgggcctgatacacccgaatgtcctgacgatcagcgggcttggaatatctgggaggttgaggactacggattcggcatttttaccacgaacatctggctcaaactgagagattctcacacacagatgtgcgaccaccgcctgatgagcgccgccattaaggattccaaagctgtgcatgcggacatgggctattggatcgaaagcgagaagaatgaaacctggaagctcgcccgggcttctttcatcgaggtgaaaacatgtatttggcccaagtcccacaccctgtggagcaacggggtccttgaatctgagatggtgatcccgaaaatttacggaggccctatctcccaacataattatagacccgggtacttcacacagaccgccggaccttggcacctgggcaagctcgagctggattttgacctgtgcgaagggacgaccgttgtggtcgatgagcactgcggataccgcggccccagccttcggacaaccacagtgaccggcaaaattatccatgaatggtgttgcagatcttgtacgctccctcccctgcggttccgcggggaggacggatgctggtatggcatggagatcagaccggttaaggaaaaggaggaaaacctggtgcggagcatggtctccgccgggagcggagagatggactctttttccctcggcattctgtgtgtgagcatccttattgaagaggttatgagatcccgctggtctcggaaaatgctgatgacagggaccctcgctgtgttcctgctgcttatcatgggacagctgacatggaatgatctcattagactgtgcatcatggtcggcgccaacgcgagcgaccgcatgggcatggggaccacctacctcgctctgatggccacatttaagatgagacctatgttcgccgtgggacttctgtttcggcgcctcacgtccagagaggtgctgctgcttaccgtcggcctgtctctcgttgctagcgtggaactgcccaattccctcgaggaactgggggatggacttgccatgggcattatgatgctgaaactcctgacagacttccaaccccaccagctgtggaccacacttctgtctctcacctttatccggacgagcctgtccctcgattatgcgtggaagacaatggctatggccctgagcatcgtgtctcttttccctctgtgtctgtccaccaccagccagaaaacaacctggctcccggtcctgcttgggtcttttggatgcaagcccctgacaatgttcctcattacggagaacaagatctggggccgcaaatcctggcctattaacgaaggcatcatggccgtggggattgttagcatcctgctctcttccctgcttaagaatgacgtgcccctggctggacctctgatcgccggcgggatgctcattgcttgttacgtcatcagcggatccagcgccgatctgtctcttgagaaagcggccgaggtgagctgggaagaggaagctgagcattccggcacctctcacaacattctggttgaagtgcaggacgatgggacaatgaagatcaaagacgaggagagagatgacaccctcacaattctgctcaaggccaccctgcttgctgtcagcggagtgtatcccatgtccatccctgccacgctgtttgtctggtacttctggcaaaaaaagaagcagcggtctggcgtgctgtgggatacccccagcccgcctgaagttgagcgcgccgtgctcgacgacggcatctatagaattctgcagcgggggcttctgggacgctcccaggtcggcgtgggggttttccaagatggagtgtttcatacaatgtggcacgtcaccagaggcgctgtgctcatgtaccaggggaaacggctggaaccctcttgggcgagcgtgaagaaagacctcatctcctacggaggcggctggagattccaggggagctggaatacaggagaggaggttcaggtcattgccgtggaacctggcaagaaccccaaaaatgtgcaaaccacaccggggacgtttaagacccctgagggagaagtcggcgctatcgccctggatttcaagcccgggacatctggatcccctattgtgaaccgcgagggcaaaatcgttggcctttatgggaatggagtggtcaccaccagcggcacatacgtgtctgccattgctcaggccaaggcgacgcaggaagggcccctgcccgagatcgaggacgaagtttttaaaaagcggaacctgaccatcatggatctccaccctggatccggcaaaacaagacgctatctgccggctattgtgcgggaggccatcaagagaaagcttcgcaccctgattctcgcccccacacgggtcgtggctagcgaaatggccgaggcgctgaaagggatgcctatcagataccaaaccacggctgttaagtccgaacatacaggccgcgagattgtggacctgatgtgccacgccaccttcaccatgcggctcctttctcccgtcagagtgcctaattataacatgatcatcatggatgaggcccattttacagaccccgctagcattgccgctcggggatacatctccacccgcgtgggcatgggggaagccgcggccattttcatgacagctacccctccgggaagcgtcgaggcctttccccagtctaatgctgttatccaggatgaagagagagacattcctgaacggtcctggaacagcggctatgattggatcacggacttccccgggaaaacagtgtggtttgtgccttctatcaagagcggaaatgacattgccaactgtctgcgcaaaaatggcaagagagtcatccagctgtcccggaagaccttcgatacagagtaccaaaaaaccaagaacaacgactgggattacgtggttacgaccgacatttctgagatgggggccaatttcagagctgatcgcgtgatcgacccccggagatgcctcaaaccggtcattctgaaggaaggccctgagcgcgtgatccttgcgggacccatgcccgttacagtggccagcgctgcccagcggagaggccgcattgggcggaaccagaataaagaaggagatcagtatatctacatgggccaacctctgaacaatgacgaggatcacgcccattggaccgaggctaagatgctcctggacaacatcaatacacccgaagggattatccctgccctgtttgagccggaaagagagaagtccgcggctattgatggagaatatcgcctcagaggcgaggcccggaaaaccttcgtcgagcttatgcgcagaggggacctgcccgtgtggctgtcttacaaggtcgccagcgaaggctttcagtattccgatcggcgctggtgcttcgacggagagagaaacaatcaggtgctcgaagagaacatggacgttgaaatctggacaaaagagggcgagcggaagaaactgagacctcgctggcttgatgctcggacctacagcgaccccctggccctcagagaatttaaggagttcgcggccgggcgccggtctgtgtccggagatctgattctggaaatcggcaaactccctcagcaccttacgctgagagctcaaaatgccctggacaacctcgtgatgctgcacaatagcgagcaggggggaaaggcttatcggcatgccatggaagagcttcccgatacaatcgagaccctgatgctcctggctctgattgccgtcctcaccggcggcgttacactttttttcctgtccgggaagggactgggcaaaacctctatcgggctcctgtgtgtgatggcgagctccgcccttctgtggatggcttctgtggaaccgcactggattgccgctagcatcattctcgagtttttcctgatggtcctgctcatccctgaacccgaccgccagagaacacctcaggataaccaacttgcctacgtggttatcggactgctgtttatgattctcacggtggccgctaatgagatgggcctgcttgagaccacaaagaaagacctggggatcggacatgtcgcggtggaaaaccaccaccatgccaccatgctcgatgtcgacctgcggcccgcttccgcctggacactgtacgccgtggctaccacggttattacccctatgatgcgccacacaatcgagaacaccacagccaatattagcctcaccgcgatcgccaaccaggctgccattcttatgggcctggataagggctggcccatctctaaaatggacatcggggtgccgctgctcgctctgggatgctattcccaggtcaatcctcttacgctgacagccgcggtgctcatgctggttgcccattacgctattatcggccccgggctgcaagccaaggctaccagagaagcccagaagcggacagctgccggaattatgaaaaaccccaccgtggatggcatcgtcaccattgacctcgaccctgtggtgtatgatgcgaagttcgagaaacagcttgggcagatcatgctgctgatcctctgtacaagccaaattctgcttatgcgcacgacctgggccctgtgcgaatctatcacactcgctaccggaccgctgacaaccctgtgggagggctcccccggcaagttttggaatacgacaattgccgttagcatggctaacatcttcagagggtcttacctcgccggagccggccttgcgttcagcctgatgaaatccctggggggaggccggcgcgggaccggagctcagggcgagaccctcggcgaaaagtggaagagacagctgaatcagctttctaaaagcgagtttaacacatataagaaatccgggattatggaagtcgaccggagcgaggccaaggaaggactgaaaagaggcgagaccacaaagcacgctgtgtcccgcgggacggccaagctccggtggttcgtggagagaaatctggtcaaacctgaaggaaaggttgtggatctgggctgtgggcgcggaggctggtcttactattgcgccggcctcaaaaaggtgaccgaggtcaaagggtacacaaagggaggccccgggcatgaagagcctatccccatggctacctacggatggaaccttgtgaaactgcacagcggcaaggacgtttttttcacacctccggaaaagtgtgataccctgctctgcgacatcggggagtcctctcccaatcctacgattgaggaaggacggaccctgagagtgcttaaaatggtcgagccctggctgcgcggcaaccaattttgtatcaagattctcaatccttatatgcccagcgtggttgaaacactggagcagatgcagcggaaacacggcgggatgctggtgagaaacccgctctcccgcaattctacccatgagatgtactgggtcagctgcggaacaggcaacatcgtgtccgccgtgaatatgaccagccggatgctgcttaacagattcacaatggcgcaccgcaagcctacctatgaacgggatgtcgacctgggggccggaacgagacatgttgctgtggagcccgaagtggccaacctcgatattatcggccagcgcattgagaatatcaaaaacgaacacaagtctacatggcactacgacgaggataatccctataagacctgggcttaccatgggtcctatgaggtcaaacctagcggatctgcctccagcatggtgaacggcgttgtgagactgcttaccaagccctgggacgtcatccctatggtgacacaaattgcgatgacggacaccacaccgtttggccagcagcgggttttcaaagaaaaggtggatacccgcacacccagagccaaacgggggaccgctcaaatcatggaggtcacagccaagtggctgtggggatttctctctagaaataagaaacctcggatttgtacccgcgaagagttcacgagaaaggtgcggtccaacgctgccatcggcgctgtttttgtggacgaaaatcagtggaacagcgccaaagaggcggtcgaggatgaacgcttctgggacctggtgcacagagagcgggaactgcataagcaggggaaatgcgccacctgcgtctacaatatgatgggaaagcgcgagaagaaactcggcgaatttgggaaggctaaaggctccagagccatttggtacatgtggctgggagctcggttccttgagttcgaggccctgggctttatgaacgaagatcactggttcagccgcgagaattctctcagcggggtggaaggagagggcctgcataagcttgggtatatcctgagagacatctccaaaattcccggaggcaacatgtacgccgatgacacagcggggtgggatacccggatcacagaggacgatctccagaatgaagctaagattaccgacatcatggagcctgaacacgccctgctggccacgtctatttttaaactcacatatcaaaacaaggttgtgcgcgtccagagacccgctaagagcggcaccgtgatggatgtgatctcccggcgcgaccagagaggatctggccaggttgggacatacggactgaataccttcacgaacatggaggtgcaacttatccggcagatggaaagcgagggcattttttccccgtctgagctggaaacccctaacctcgccaaaaaggtcctggactggcttgagaaacacggggctgaaagactgaagcgcatggccatcagcggagatgactgtgtggttaaacccattgatgaccggttcgcgacagccctcaccgctctgaatgatatgggcaaggtgagaaaggacatccctcagtgggagccctccaaagggtggaacgattggcagcaagtccctttttgcagccatcacttccatcagctgattatgaaggacggccgcgaaatcgtggtcccctgtcggaatcaggatgagctcgtgggaagagcccgcgtttctcagggcgctgggtggtccctgcgggagacagcctgccttggaaaaagctatgcgcaaatgtggcagctgatgtactttcacagacgcgacctccggctggccgctaacgccatctgttctgctgtgccggtcgattgggtgcctacctccagaacaacctggagcattcacgcccatcaccagtggatgacgacagaagacatgctttccgtttggaatcgcgtgtggatcgaggaaaacccctggatggagaataagacccatgtctctagctgggaagaggtgccctatctgggcaaacgggaggaccaatggtgcgggtccctcattggactgaccgctagagccacatgggcgaccaacatccaggtggccattaatcaggttcggagactgatcggcaacgaaaattacctcgattacatgacaagcatgaagcgcttcaagaacgagtctgaccctgaaggggctctgtggtga

SEQ ID NO: 19342 - RNA, 9879 nt, synthetic construct
  misc_feature 1..9879: note = derived and/or modified CDS sequence (opt5) from DENV-1__KP188544__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgtgaatggcatccttgctcaggggaagaaaatgattcgcccgcaacccatggagcataagtatagctggaagtcctggggaaaagccaagatcattggcgctgatatccagaacaccacctttatcattgacgggcctgatacacccgaatgtcctgacgatcagcgggcctggaatatctgggaggtcgaggactacggattcggcatttttaccacgaacatctggctcaaactgagagattctcacacacagatgtgcgaccaccgcctgatgagcgccgctattaaggattccaaagcggttcatgccgacatgggctattggatcgaaagcgagaagaatgaaacctggaagctcgctcgggcctctttcatcgaggtgaaaacatgtatttggcccaagtcccacaccctgtggagcaacggggtgcttgaatctgagatggtcatcccgaaaatttacggaggccctatctcccaacataattatagacccgggtacttcacacagaccgccggaccttggcacctgggcaagctcgagctggattttgacctgtgcgaagggacgaccgtggttgtggatgagcactgcggataccgcggccccagccttcggacaaccacagtcaccggcaaaattatccatgaatggtgttgcagatcttgtacgctccctcccctgcggttccgcggggaggacggatgctggtatggcatggagatcagaccggtgaaggaaaaggaggaaaacctggttcggagcatggtgtccgctgggagcggagaggtcgactctttttccctcggcattctgtgtgtgagcatccttattgaagaggttatgagatcccgctggtctcggaaaatgctgatgacagggaccctcgccgtgttcctgctgcttatcatgggacagctgacatggaatgatctcattagactgtgcatcatggtcggcgcgaacgctagcgaccgcatgggcatggggaccacctacctcgccctgatggccacatttaagatgagacctatgttcgctgtgggacttctgtttcggcgcctcacgtgtagagaggtgctgctgcttaccgtcggcctgtccctcgttgcctctgtggaactgcccaatagcctcgaggaactgggggatggacttgcgatgggcattatgatgctgaaactcctgacagacttccaaccccaccagctgtggaccacacttctgtccctcacctttatccggacgtctctgagcctcgattatgcttggaagacaatggccatggccctgtccatcgtgagccttttccctctgtgcctgtctaccacctcccagaaaacaacctggctcccggtcctgcttgggagctttggatgtaagcccctgacaatgttcctcattacggagaacaagatctggggccgcaaatcttggcctattaacgaaggcatcatggctgtggggattgtttccatcctgctcagctctctgcttaagaatgacgtgcccctggccggacctctgatcgctggcgggatgctcattgcctgctacgtcatctccggaagctccgcggatctgagccttgagaaagccgctgaggtgtcttgggaagaggaagccgagcatagcggcacctcccacaacattctggttgaagtgcaggacgatgggacaatgaagatcaaagacgaggagagagatgacaccctcacaattctgctcaaggctaccctgcttgccgtctctggagtgtatcccatgagcatccctgccacgctgtttgtctggtacttctggcaaaaaaagaagcagcggtccggcgtgctgtgggataccccctctccgcctgaagttgagcgcgctgtgctcgacgacggcatctatagaattctgcagcgggggcttctgggacgcagccaggtcggcgtgggggttttccaagatggagtgtttcatacaatgtggcacgtcaccagaggcgcggtgctcatgcaccaggggaaacggctggaaccctcctgggcctctgtgaagaaagacctcatcagctacggaggcggctggagattccaggggtcctggaatacaggagaggaggttcaggtcattgctgtggaacctggcaagaaccccaaaaatgtgcaaaccacaccggggacgtttaagacccctgagggagaagtcggcgccatcgccctggatttcaagcccgggacaagcggatctcctattgtgaaccgcgagggcaaaatcgttggcctttacgggaatggagtggtcaccacctccggcacatatgtgagcgctattgcccaggcgaaggctacgcaggaagggcccctgcccgagatcgaggacgaagtttttaaaaagcggaacctgaccatcatggatctccatcctggatctggcaaaacaagacgctacctgccggccattgtgcgggaggccatcaagagaaagcttcgcaccctgattctcgctcccacacgggtcgtggcctccgaaatggcggaggctctgaaagggatgcctatcagatatcaaaccacggccgttaagagcgaacacacaggccgcgagattgtggacctgatgtgtcatgccaccttcaccatgcggctcctttcccccgtcagagtgcctaattacaacatgatcatcatggatgaggctcactttacagaccccgcctctattgctgcccggggatatatcagcacccgcgtgggcatgggggaagcggccgctattttcatgacagccacccctccgggatccgtcgaggcttttccccagagcaatgccgttatccaggatgaagagagagacattcctgaacggtcttggaactccggctacgattggatcacggacttccccgggaaaacagtgtggtttgtgcctagcatcaagtctggaaatgacattgccaactgcctgcgcaaaaatggcaagagagtcatccagctgagccggaagaccttcgatacagagtatcaaaaaaccaagaacaacgactgggattacgtggttacgaccgacatttccgagatgggggctaatttcagagcggatcgcgtgatcgacccccggagatgcctcaaaccggtcattctgaaggaaggccctgagcgcgtgatccttgccggacccatgcccgttacagtggcttctgccgcccagcggagaggccgcattgggcggaaccagaataaagaaggagatcagtacatctatatgggccaacctctgaacaatgacgaggatcatgctcactggaccgaggccaagatgctcctggacaacatcaatacacccgaagggattatccctgcgctgtttgagccggaaagagagaagagcgctgccattgatggagaataccgcctcagaggcgaggcccggaaaaccttcgtcgagcttatgcgcagaggggacctgcccgtgtggctgtcctataaggtcgcttctgaaggctttcagtacagcgatcggcgctggtgtttcgacggagagagaaacaatcaggtgctcgaagagaacatggacgttgaaatctggacaaaagagggcgagcggaagaaactgagacctcgctggcttgatgcccggacctattccgaccccctggcgctcagagaatttaaggagttcgccgctgggcgccggagcgtgtctggagatctgattctggaaatcggcaaactccctcagcaccttacgctgagagcccaaaatgctctggacaacctcgtgatgctgcataattccgagcaggggggaaaggcctaccggcacgctatggaagagcttcccgatacaatcgagaccctgatgctcctggccctgattgcggtcctcaccggcggcgttacactttttttcctgagcgggaagggactgggcaaaacctccatcgggctcctgtgcgtgatggcctctagcgctcttctgtggatggcctccgtggaaccgcattggattgctgcctctatcattctcgagtttttcctgatggtcctgctcatccctgaacccgaccgccagagaacacctcaggataaccaacttgcctatgtggttatcggactgctgtttatgattctcacggtggctgcgaatgagatgggcctgcttgagaccacaaagaaagacctggggatcggacacgtcgccgtggaaaaccaccatcacgctaccatgctcgatgtcgacctgcggcccgccagcgcctggacactgtacgctgtggccaccacggttattacccctatgatgcgccatacaatcgagaacaccacagcgaatatttccctcaccgccatcgctaaccaggccgctattcttatgggcctggataagggctggcccatcagcaaaatggacatcggggtgccgctgctcgccctgggatgttactctcaggtcaatcctcttacgctgacagcggccgtgctcatgctggttgctcactatgccattatcggccccgggctgcaagctaaggccaccagagaagctcagaagcggacagccgcgggaattatgaaaaaccccaccgtggatggcatcgtcaccattgacctcgaccctgtggtgtacgatgccaagttcgagaaacagcttgggcagatcatgctgctgatcctctgcacatcccaaattctgcttatgcgcacgacctgggctctgtgtgaaagcatcacactcgccaccggaccgctgacaaccctgtgggagggctctcccggcaagttttggaatacgacaattgctgtttccatggccaacatcttcagagggagctatctcgccggagcgggccttgctttctctctgatgaaaagcctggggggaggccggcgcgggaccggagcccagggcgagaccctcggcgaaaagtggaagagacagctgaatcagctttccaaatctgagtttaacacatacaagaaaagcgggattatggaagtcgaccggtccgaggctaaggaaggactgaaaagaggcgagaccacaaagcatgccgtgagccgcgggacggccaagctccggtggttcgtggagagaaatctggtcaaacctgaaggaaaggttatcgatctgggctgcgggcgcggaggctggtcctattactgtgctggcctcaaaaaggtgaccgaggtgaaagggtatacaaagggaggccccgggcacgaagagcctatccccatggccacctacggatggaaccttgtcaaactgcactctggcaaggacgtgtttttcacacctccggaaaagtgcgataccctgctctgtgacattggggagagctcccccaatcctacgatcgaggaaggacggaccctgagagttcttaaaatggtggagccctggctgcgcggcaaccaattttgcattaagatcctcaatccttacatgccctctgtcgtggaaacactggagcagatgcagcggaaacatggcgggatgctggttagaaacccgctcagccgcaattccacccacgagatgtattgggtgtcttgtggaacaggcaacattgtcagcgcggtgaatatgacctcccggatgctgcttaacagattcacaatggcccatcgcaagcctacctacgaacgggatgtggacctgggggctggaacgagacacgtcgccgttgagcccgaagtggctaacctcgatatcattggccagcgcatcgagaatatcaaaaacgaacacaagagcacatggcatcacgacgaggataatccctataagacctgggcctaccatgggtcttatgaggtgaaaccttccggaagcgcgtcttccatggtcaacggcgtggttagactgcttaccaagccctgggacgtgattcctatggtcacacaaatcgccatgacggacaccacaccgtttggccagcagcgggtgttcaaagaaaaggttgatacccgcacacccagagctaaacgggggaccgcccaaattatggaggtgacagctaagtggctgtggggatttctcagcagaaataagaaacctcggatctgcacccgcgaagagttcacgagaaaggtccggtctaacgccgctattggcgccgtgtttgttgacgaaaatcagtggaactccgcgaaagaggccgtggaggatgaacgcttctgggacctggtccacagagagcgggaactgcataagcaggggaaatgcgctacctgtgtgtacaatatgatgggaaagcgcgagaagaaactcggcgaatttgggaaggccaaaggcagcagagctatctggtatatgtggctgggagcccggttccttgagttcgaggccctgggctttatgaacgaagatcactggttctcccgcgagaatagcctctctggggtcgaaggagagggcctgcacaagcttgggtacatcctgagagacattagcaaaatccccggaggcaacatgtacgcggatgacacagctgggtgggatacccggattacagaggacgatctccagaatgaagccaagatcaccgacattatggagcctgaacatgccctgctggctacgtccatctttaaactcacatatcaaaacaaggtggttcgcgtgcagagacccgccaagtctggcaccgtcatggatgtgatcagccggcgcgaccagagaggatccggccaggtggggacatacggactgaataccttcacgaacatggaggttcaacttattcggcagatggaatctgagggcatctttagcccgtccgagctggaaacccctaacctcgctaaaaaggtgctggactggcttgagaaacacggggccgaaagactgaagcgcatggcgatttctggagatgactgcgtcgtgaaacccatcgatgaccggttcgccacagctctcaccgccctgaatgatatgggcaaggttagaaaggacattcctcagtgggagcccagcaaagggtggaacgattggcagcaagtgcctttttgttcccatcacttccaccagctgatcatgaaggacggccgcgaaatcgtcgtgccctgccggaatcaggatgagctcgtcggaagagctcgcgtgagccagggcgccgggtggtctctgcgggagacagcgtgtcttggaaaatcctatgcccaaatgtggcagctgatgtactttcatagacgcgacctccggctggctgccaacgctatttgcagcgccgttccggtggattgggtccctacctctagaacaacctggtccatccacgctcatcaccagtggatgacgacagaagacatgcttagcgtgtggaatcgcgtttggattgaggaaaacccctggatggaggacaagacccatgtgtcctcttgggaagaggtcccctatctgggcaaacgggaggatcaatggtgtgggagcctcatcggactgaccgccagagcgacatgggccaccaatattcaggtggctatcaaccaggtgcggagactgattggcaatgaaaactacctcgactatatgacatccatgaagcgcttcaagaatgagagcgatcctgaaggggccctgtggtga

SEQ ID NO: 19343 - RNA, 9879 nt, synthetic construct
  misc_feature 1..9879: note = derived and/or modified CDS sequence (opt5) from DENV-1__KP188547__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctattcttcggaagctgtgcatcgaagccaaaatttctaataccacgacagactcccgctgtccgacccaaggagaggcgaccctcgtggaagagcaggatgccaacttcgtgtgcagacggacatttgtcgaccgcggctggggcaatgggtgtggactgttcggcaaggggagccttctgacctgcgctaagtttaaatgcgtgacaaagctcgagggaaaaatcgttcagtacgaaaacctgaagtattctgtgatcgtcacggtgcacaccggcgatcagcatcaagttgggaatgagacaaccgaacacggaacaattgccaccatcacgccccaggctcctacctccgagattcagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggccagcacatcccaagagacctggaatcggcaggatctgctggtgacattcaagaccgctcacgcgaagaaacaggaagtcgtggttctcggatctcaagagggcgccatgcacaccgctctgacaggggccacggaaatccagaccagcggaacaaccacaatttttgccggccatcttaagtgccgcctgaaaatggacaagctcaccctgaaagggatgtcctatgtgatgtgtacgggcagcttcaagctggagaaggaagtcgctgagacacagcacggaaccgtgcttgttcaggtgaaatacgagggcaccgatgccccgtgcaagatccctttcctcacacaagacgaaaaaggggtcacccagaacggaagactgatcacagcgaatcccattgtgacggataaggagaaacctgtgaacatcgaaaccgagcccccctttggcgagtcttatattgttgtcggggctggagaaaaggccctgaagctctcctggttcaaaaagggcagctctatcgggaaaatgtttgaggccacagctcggggcgccagacgcatggctattctgggagacaccgcctgggatttcggcagcatcgggggactttttacatccgtgggcaagctgatccatcaggtgttcgggaccgcgtacggagtcctcttttctggcgtgagctggacgatgaaaattgggatcggcattctgctgacctggcttggactcaattcccggagcacatctctgtccatgacctgtatcgccgttggcatggtgacactgtacctcggggtcatggtgcaggctgacagcggatgcgttattaactggaagggcagagaactgaagtgtgggtctggaatcttcgtgaccaacgaggtccacacatggaccgaacaatataaatttcaggccgattcccctaagcgccttagcgctgccattggcaaagcgtgggaggagggggtgtgcggcatccggtccgccacgagactggaaaatatcatgtggaagcagatttctaacgagctcaattacatcctgctggaaaacgacatgaaattcacagttgtggtcggagacgtgaatggcattcttgctcaggggaagaaaatgatcaagccgcaacccatggagcataagtatagctggaaatcctggggaaaggccaaaattatcggcgctgatatccagaacaccacctttattatcgacgggcctgatacacccgaatgtcctgacgatcagcgcgcctggaatatttgggaggtggaggactacggattcggcatctttaccacgaacatttggctcaagctgcgggattctcacacacagatgtgcgaccacagactgatgagcgccgctatcaaagattccaaggcggtccatgccgacatgggctattggatcgaaagcgagaagaatgaaacctggaaactcgctcgcgcctctttcattgaggttaagacatgtatctggcccaaatcccacaccctgtggagcaacggggtgcttgaatctgagatggtgattccgaagatctacggaggccctatttcccaacataattatcggcccgggtacttcacacagaccgccggaccttggcacctgggcaaactcgagctggattttgacctgtgcgaagggacgaccgtcgtggttgatgagcactgcggatacagaggccccagccttcgcacaaccacagtgaccggcaagatcatccatgaatggtgttgccggtcttgtacgctccctcccctgagattccggggggaggacggatgctggtatggcatggagattcgcccggtcaaggaaaaagaggaaaacctggtgagaagcatggtttccgctgggagcggagaggtggactctttttccctcggcatcctgtgtgtcagcattcttatcgaagaggtgatgcggtccagatggtctcgcaagatgctgatgacagggaccctcgccgttttcctgctgcttattatgggacagctgacatggaatgatctcatccggctgtgcattatggtgggcgcgaacgctctcgacagaatgggcatggggaccacctacctggcccttatggccacatttaaaatgcgccctatgttcgctgtcggactgctctttagacggctgacgagccgcgaggtgctgcttctgaccgtgggcctctccctggtcgcctctgttgaactccccagctccctggaggaacttggggatggactggcgatgggcatcatgatgctcaagctgctgacagacttccaaccccaccagctttggaccacactgctctctctgacctttatcagaacgagcctctccctggattatgcttggaaaacaatggccatggcccttagcattgtgtctctgttccctctgtgtctctccaccaccagccagaagacaacctggctgccggtgcttctggggtcttttggatgcaagcccctcacaatgttcctgatcacggagaataaaatttggggccggaagtcctggcctatcaacgaaggcattatggctgtcgggatcgtgagcatcctcctgtcttcccttctgaaaaacgacgttcccctggccggacctctcattgctggcgggatgctgatcgcctgttacgtgattagcggatccagcgcggatctttctctggagaaggccgctgaggtcagctgggaagaggaagccgagcattccggcacctctcacaatatcctcgtggaagttcaggacgatgggacaatgaaaattaaggacgaggagcgcgatgacaccctgacaatcctcctgaaagctacccttctggccgtgagcggagtctatcccatgtccatccctgccacgctgtttgtgtggtacttctggcaaaagaagaaacagagatctggcgtcctctgggatacccccagcccgcctgaagtggagcgggctgttctggacgacggcatttatcgcatccttcagagagggctgctcggacggtcccaggtgggcgtcggggtgttccaagatggagtttttcatacaatgtggcacgtgacccgcggcgcggtcctgatgtaccaggggaagagactcgaaccctcttgggccagcgtgaaaaaggacctgatttcctacggaggcggctggcggttccaggggagctggaacacaggagaggaggtgcaggttatcgctgtcgaacctggcaaaaatcccaagaacgtgcaaaccacaccggggacgtttaagacccctgagggagaagtgggcgccattgcccttgatttcaaacccgggacatctggatcccctatcgtcaatagagagggcaagattgtgggcctgtatgggaacggagttgtgaccaccagcggcacatacgtctctgctatcgcccaggcgaaagctacgcaggaagggaccctgcccgagatcgaggacgaagtgtttaagaaacgcaatctcacaattatggatctgcaccccggatccggcaagacccggagatatcttcctgccatcgttcgcgaggccattaagcggaaactgagaacactcatcctggctccgacccgcgtggtcgccagcgaaatggcggaggctctgaaggggatgcccattcggtaccaaacgacagccgtgaaatccgaacataccggcagagagatcgttgacctcatgtgccacgccaccttcacaatgcgccttctgtctcctgtgcgggtccccaactataatatgatcattatggatgaggctcattttaccgaccctgccagcatcgctgccagaggatacatttccacacgggtgggcatgggggaagcggccgctatcttcatgaccgccacgccccctggaagcgtggaggcttttccgcagtctaacgccgtcattcaggatgaagagcgcgacatccccgaaagatcctggaatagcggctatgattggatcacagacttccctgggaagaccgtttggtttgtgccctctattaaaagcggaaacgacatcgccaattgtctgcggaagaacggcaagcgcgtgattcagctctccagaaaaacattcgataccgagtaccaaaagacgaaaaataacgactgggattacgtcgtgaccacagacatctctgagatgggggctaacttccgggcggatagagttattgaccctcgccggtgcctgaagcccgtgatccttaaagaaggcccggagagagtcattctggccggacctatgcccgtgaccgttgctagcgccgcccagcgccggggcagaatcgggcgcaatcagaacaaggaaggagatcagtatatctacatgggccaacccctcaataacgacgaggatcacgctcattggacagaggccaagatgctgctggacaatattaacacccctgaagggatcattcccgcgctctttgagcctgaacgggagaaatccgctgccatcgatggagaatatagacttcgcggcgaggccagaaagacattcgtggagctgatgcggcgcggggacctgccggtctggctctcttacaaagtggctagcgaaggctttcagtattccgatagacggtggtgcttcgacggagagcgcaataaccaggtcctggaagagaatatggacgtggaaatttggaccaaggagggcgagagaaaaaagcttcggcccagatggctggatgcccgcacgtacagcgaccctctcgcgctgcgggaatttaaagagttcgccgctgggagacgctctgtttccggagatctgatcctcgaaatcggcaagcttccccagcacctgacactgcgggcccaaaacgctctcgacaatctggtgatgcttcacaacagcgagcaggggggaaaggcctatagacatgctatggaagagctgcctgataccattgagaccctcatgctgctggccctcatcgcggtgcttacaggcggcgtcaccctgtttttcctgtccgggaaaggactcggcaagacatctattgggctgctttgtgttatggccagctccgctctgctctggatggcctctgtggaaccccactggatcgctgccagcattatcctggagtttttcctgatggtgctccttatcccggaacctgaccggcagcgcacgccccaggataatcaactggcctacgtcgtgattggactgctctttatgatcctgaccgttgctgcgaacgagatgggccttctggagacaaccaaaaaggacctcgggattggacatgtggccgtcgaaaatcaccaccatgctacaatgctggatgtggacctgagacctgcctccgcctggaccctctacgctgtcgccacgaccgtgatcacacccatgatgcggcacaccattgagaacacaaccgcgaacatcagccttacggccattgctaatcaggccgctatcctgatgggcctggataaaggctggcctatctctaagatggacattggggttcccctcctggcccttggatgctattcccaggtgaacccgctgacactcaccgcggccgtcctgatgctggtggctcattacgccatcattggccctgggctccaagctaaggccacacgcgaagctcagaaaagaaccgccgcgggaatcatgaagaatcccaccgttgatggcattgtgacaatcgaccttgaccccgtcgtgtatgatgccaaattcgagaagcagctggggcagatcatgctgctcattctgtgtacgagccaaatccttctgatgcggaccacatgggctctctgcgaatctattaccctggccacaggacctctgaccacgctctgggagggctccccgggcaaattttggaacacaaccatcgctgtgagcatggccaatattttccgcgggtcttaccttgccggagcgggcctggctttcagcctgatgaagtccctcgggggaggcagacgggggaccggagcccagggcgagacactgggcgaaaagtggaaacgccagcttaaccagctgtctaagagcgagtttaatacctataaaaagtccgggatcatggaagttgacagaagcgaggctaaagaaggactcaagcggggcgagacaacgaagcacgccgtctccagagggaccgccaaactgcgctggttcgtggagcggaacctggtgaagcccgaaggaaaagtcatcgatctcggctgtgggagaggaggctggtcttactattgcgctggccttaagaaagttacagaggtgaaggggtacaccaaaggaggccctgggcatgaagagcccattcctatggccacatacggatggaatctggtgaagctgcacagcggcaaggacgtctttttcaccccccctgaaaaatgtgatacgctcctgtgcgacatcggggagtcctctccgaaccccaccattgaggaaggacgcacacttcgggtgctgaagatggttgagccttggctcagaggcaatcaattttgtatcaaaattctgaacccctatatgcctagcgtggtcgaaaccctggagcagatgcagcgcaagcacggcgggatgctcgtgcggaatcccctgtccagaaactctacacatgagatgtactgggttagctgcggaaccggcaatatcgtgtccgcggtcaacatgacaagccgcatgcttctgaatcggttcaccatggcccacagaaaaccgacgtatgaacgcgatgtggacctcggggctggaacacggcatgtggccgtcgagcctgaagttgctaacctggatattatcggccagagaatcgagaacattaagaatgaacacaagtctacctggcactacgacgaggataacccctataaaacctgggcctaccatgggtcctatgaggtgaagcccagcggatctgcgtccagcatggtgaatggcgtcgtgcgccttctgacaaaaccttgggacgttatccccatggtgacgcaaattgccatgaccgacacaaccccttttggccagcagagagtcttcaaggaaaaagtggatacacggaccccgcgcgctaagagagggacagcccaaatcatggaggttaccgctaagtggctctggggatttctgtctcggaacaaaaagcccagaatttgtacgcgggaagagttcacccgcaaagtgagatccaatgccgctatcggcgccgtctttgtggacgaaaaccagtggaatagcgcgaaggaggccgttgaggatgaacggttctgggacctggtgcaccgcgagagagaactccataaacaggggaagtgcgctacatgcgtctacaacatgatgggaaagcgggagaaaaagctgggcgaatttgggaaagccaagggctcccgcgctatctggtacatgtggcttggagccagattcctggagttcgaggccctcggctttatgaatgaagatcactggttcagccgggagaactctctgagcggggtggaaggagagggccttcataaactggggtatattctccgcgacatctccaagattcctggaggcaatatgtacgcggatgacaccgctgggtgggatacaagaatcaccgaggacgatctgcagaacgaagccaaaattacggacatcatggagcccgaacacgccctgctcgctacatctatctttaagctgacctatcaaaataaggtcgtgcgggttcagcgccctgccaaaagcggcacagtgatggatgtcatttccagacgggaccagcgcggatctggccaggtggggacctacggacttaacacgttcaccaatatggaggtgcaactgatcagacagatggaaagcgagggcattttttccccctctgagctcgaaacaccgaacctggctaagaaagttcttgactggctggagaagcacggggccgaacggctcaaaagaatggcgatcagcggagatgactgtgtggtcaagcctattgatgaccgcttcgccaccgctctgacagccctgaacgatatgggcaaggtgcggaaagacatcccccagtgggagccttccaaggggtggaatgattggcagcaagttcccttttgcagccatcacttccatcagctcatcatgaaagacggcagagaaattgtggtcccttgtcgcaaccaggatgagctggtgggacgggctagagtctctcagggcgccgggtggtcccttcgcgagaccgcgtgcctgggaaagagctatgcccaaatgtggcagctcatgtactttcaccggagagacctgcgccttgctgccaatgctatctgttctgccgtgcccgttgattgggtgccgacatcccggaccacgtggagcattcacgctcatcaccagtggatgacaaccgaagacatgctgtccgtctggaacagagtgtggatcgaggaaaatccttggatggaggacaaaacccatgtttctagctgggaagaggtgccctatctcggcaagcgcgaggatcaatggtgcgggtccctgattggactgacagcccgggcgacctgggccacaaacatccaggtcgctattaatcaggtgagacggctcatcggcaacgaaaattacctggactacatgacgagcatgaagagattcaaaaacgagtctgatcccgaaggggccctttggtga

SEQ ID NO: 19344 - RNA, 9879 nt, synthetic construct
  misc_feature 1..9879: note = derived and/or modified CDS sequence (opt5) from DENV-1__KP723473__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaaacgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccaaggaaggcgagcgcaagaagtgtgattcccgctggctggacgcgcggacgtatagcgatcccctcgccctgagagagtttaaagagttcgctgccgggcgccggtccgtgtctggagaccttatcctggagattggcaagctccctcagcacctgacactgagagctcaaaatgccctcgataaccttgtgatgctgcacaatagcgaacaagggggaaaggcttaccggcatgccatggaggaactgcccgacaccatcgagaccctcatgctgcttgcgctgatcgccgtcctcacaggcggcgttaccctgtttttcctgtccgggaagggactcggcaagacatctattgggcttctgtgcgtgatggctagctccgtgctgctctggatggccagcgtcgagcctcactggatcgctgcctctattatcctggaatttttccttatggtgctgctcattcccgagccggatcgccagagaacgcctcaggacaaccaactggcctatgttgtgatcggactgctctttatgatccttaccgtcgctgcgaacgaaatgggcctgctggagacaaccaaaaaggatctcgggattggacatgtggtcgccgagaatcaccaccatgctacaatgctggacatcgatcttcaccccgcctccgcctggaccctgtacgctgtggccacgaccattatcacacctatgatgcggcataccattgaaaacacaaccgcgaatatcagcctcacggccattgctaaccaggccgctatcctgatgggcctggacaaaggctggcccatctctaagatggatattggggttcctctccttgccctgggatgttactcccaggtgaatcccctgacactcaccgcggccgtcctgatgcttgtggctcactatgccatcattggcccggggctgcaagctaaagccacacgcgaggctcagaagagaaccgccgcgggaatcatgaagaaccctaccgttgacggcattgtggccatcgacctcgatcccgtcgtgtacgacgctaaattcgaaaagcagctggggcagatcatgctgctcattctttgcacaagccaaatcctgctgatgcggacgacctgggccctctgtgagtctattacactggctaccggaccccttacaaccctgtgggaaggcagccctggcaaattttggaatacgacaatcgccgtgtccatggccaacattttccgcgggtcttatctcgcgggagctggcctggccttcagcctgatgaagtccctcgggggaggcagacgggggaccggagctcagggcgagacccttggcgagaaatggaagcgccagctgaatcagctgagcaagtccgaatttaacacatacaaaagatctgggatcatggaggttgatcggagcgaagccaaggagggactcaaaagaggcgaaaccacaaagcatgccgtctcccgcgggacggctaaactgcggtggttcgtggagagaaatcttgtgaagccggagggaaaggtcatcgacctgggctgcgggcgcggaggctggtcttattactgtgccggcctcaaaaaggttaccgaagtgaaagggtatacaaagggaggccccgggcacgaggaacctattcccatggcgacctacggatggaacatcgtgaaactgcacagcggccgggatgtctttttcacacctcccgagaagtgcgacaccctgctctgtgatattggggaatcctctcctaatccgacgatcgaggagggaagaacccttcgcgtgctgaaaatggttgaaccctggctgcggggcattcaattttgcatcaagattctcaacccttacatgcccagcgtggtcgagacactggaacagatgcagagaaagcatggcgggatgcttgtgcgcaatcctctgtcccggaacagcacccacgagatgtattgggtttcttgtggaacaggcaatatcgtgtccgccgtcaacatgaccagcagaatgctcctgaaccgcttcacaatggctcatcggaaacccacctacgagagagacgtggatctgggggccggaacgcgccacgtggctgtcgaaccggagatcgccaatctcgacattatcggccagagaattgaaaacatcaagaatgagcacaaatctacatggcattatgatgaagacaacccttacaagacctgggcgtatcacgggtcctacgaggttaaacccagcggaaccgcctcttccatggtgaatggcgtggtccggctgcttacaaagccctgggacgtgattcctatggttacgcaaatcgctatgaccgatacaaccccctttggccagcagcgcgtgttcaaggagaaagtcgacacaagaacccctcggccgaagagagggacagcccaaatcatggaagtgaccgctaaatggctgtggggatttctcagccggaacaagaaaccccgcatttgcacgagagaggagttcacccggaaggttcgctccaatgccgctatcggcgccgtgtttgtcgatgagaaccagtggaatagcgcgaaggaagccgtggaggacgagagattctgggatctggttcatcgggaacgcgagcttcacaaacaggggaagtgcgctacatgtgtgtataacatgatgggaaaaagagaaaagaaactgggcgagtttgggaaggccaagggctctcgggctatttggtacatgtggctcggagcccgcttcctggagttcgaggccctgggctttatgaatgaggaccattggttcagcagagaaaactccctctctggggtcgagggagaaggcctgcacaaacttgggtacatcctgcgggatattagcaagatccctggaggcaatatgtatgcggacgataccgctgggtgggacacacgcatcaccgaggatgacctccagaacgaggccaaaattacggatatcatggaacccgagcacgccctgcttgctacatccatttttaagctgacctaccaaaataaagtggtcagagtgcagcggcctgccaagtctggcacagttatggacgtgatcagccgcagagaccagcggggatccggccaggtcgggacctatggactcaacacgttcaccaacatggaagtgcaactgattagacagatggagtctgaaggcatctttagcccctccgagctggagaatagcaacctcgctgaacgcgtgctggattggcttgagaaacatggggttgaacggctgaagagaatggccatctctggagacgattgcgtggtcaagccgacagacgatcgcttcgcgaccgccctcacagctctgaatgacatgggcaaagtgcggaaggatattcctcagtgggagccctccaaagggtggaacgactggcagcaagttcctttttgtagccaccatttccaccagcttatcatgaaggatggcagagaaattgtggtcccctgccgcaatcaggacgagctggtgggacgggccagagtctctcagggcgctgggtggtccctccgcgagaccgcctgtctgggaaaaagctacgcgcaaatgtggcagctgatgtattttcaccggagagatctccgcctggccgctaacgccatctgctccgctgtgcctgttaattgggtgcccacatctcggaccacgtggagcattcatgcccaccatcagtggatgacaaccgaagacatgctttccgtctggaacagagtgtggatcgaggaaaatccgtggatggaggacaagacccacgttagctcttgggaagatgtgccttacctgggcaagcgggaggaccaatggtgtgggtccctcattggactgacagctagagccacctgggcgacaaacatccaggtcgccatcaatcaggtgcgccggcttattggcaacgagaattatctggattacatgacgagcatgaaaagattcaagaacgaatctgaccccgagggggctctctggtga

SEQ ID NO: 19345 - RNA, 9879 nt, synthetic construct
  misc_feature 1..9879: note = derived and/or modified CDS sequence (opt5) from DENV-1__KT187564__SS-prME
  source 1..9879: mol_type = other RNA
agcgtgaccatgctgctcatgctgatgcccacagctcttgctttccacctgacgaccagaggaggggagcctcatatgatggtgtccaagcaggaacggggaaaatctctcctgtttaagaccagcgccggcgttaacatgtgcacccttatcgcgatggacctgggggagctctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagatccagcgggttgaaacatgggctctgcgccaccccggcttcaccgtgattgccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccgttctgcgcaaactttgcatcgaagcgaagatttccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgatcacatgcgccaagtttaagtgcgtgacaaaacttgagggaaagattgttcagtacgaaaacctgaaatattccgtgatcgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggggaaatcctggctggtccataagcagtggtttctcgatctgcctcttccctggacaagcggagcttccacctctcaagagacatggaatcgccaggacctgctcgtgaccttcaaaaccgcgcacgccaagaagcaggaggtcgtggttctgggcagccaagaaggggctatgcacacagccctgacgggagccaccgagatccagacatccggcaccacaaccatttttgctgggcatctcaaatgcagactgaagatggataaacttacgctgaagggcatgagctatgtgatgtgtacaggatctttcaaactcgaaaaggaggtcgccgaaacccagcacggcaccgtgctggttcagatcaagtacgaggggacagacgcgccgtgcaaaattcctttctccacccaagatgagaagggagtgacacagaacggccggctgatcacggctaatcccatcgtcaccgacaaagaaaagcctgtgaacattgaggccgaaccgccctttggggagagctatatcgtgattggagccggcgagaaagctcttaagctctcttggttcaagaaagggagctccatcggcaagatgtttgaagccacagctagaggagcccgccggatggcgattctgggcgataccgcctgggacttcgggtctatcggaggcgtttttacaagcgtcgggaaactggtgcatcagatcttcggaaccgcttacggcgtgctcttttccggggtcagctggacgatgaagattggcatcggagtgctgcttacctggctgggcctcaattctagatccacaagcctgtctatgacctgtattgccgttgggctggtgacactttacctcggagtcatggtgcaggctgattccggctgcgttatcaactggaaagggcgcgagctgaagtgtggaagcggcattttcgtgaccaatgaagtccacacatggaccgagcaatataagtttcaggccgactcccctaaacggctgtctgcggccatcgggaaggcttgggaagagggcgtgtgcggaattagaagcgccacgcgcctcgagaacatcatgtggaaacagatctccaacgaactgaatcatattcttctggagaacgacatgaagttcacagttgtggtcggcgatgtggctgggatcctcgcccagggcaagaagatgattcggccgcaacccatggaatacaaatattcttggaaaagctggggcaaggccaaaatcattggggctgacgtgcagaataccacctttatcatcgatggacctaacacacccgagtgtcctgacgatcagagagcgtggaatatttgggaagtcgaggactacggcttcggcatctttaccacgaacatttggctgaagctgcgcgattcctatacacaggtttgcgaccaccggcttatgagcgccgctatcaaagattctaaggccgtgcacgccgacatggggtactggattgagtccgaaaagaatgagacctggaagctcgctagagccagcttcatcgaagtgaagacatgtatctggcccaaatctcataccctgtggtccaacggagtcctggagagcgaaatgattatcccgaagatttatggcgggcctatctctcaacacaattaccgccccggatacttcacacagaccgcgggcccttggcatctcgggaaactggagcttgattttgacctgtgcgagggaacgaccgtggttgtggatgaacactgcggcaaccggggccccagcctcagaacaaccacagtcaccgggaagattatccacgagtggtgttgccggtcctgtacgctgcctcccctgcgcttcagaggagaagacggctgctggtatgggatggagatccggccggtgaaagagaaggaagagaatcttgttaagagcatggtgtctgctggatccggcgaagtcgacagcttttccctcgggctgctgtgtatttctatcatgattgaggaagtgatgagaagccgctggtcccggaaaatgctcatgatcggaacactggccgttttctttcttctgattatgggccagctcacctggaacgatctgatcagactgtgcattatggtgggcgccaatgcttctgaccgcatggggatgggaacaacctaccttgccctgatggcgaccttcaagatgagacctatgtttgctgtcggcctcctgttccggcgcctcacaagcagagaggtgctgcttctgacgatcgggctctccctggtggcctctgccgagctgcccaacagccttgaagaactgggagatggcctcgctatggggatcatgattctgaaactcctgaccgactttcaatcccatcagctttgggccacactgctcagcctgaccttcatcaagacaaccttttctctgcactatgcttggaaaacgatggccatggtcctttccattgttagcctgttccccctctgtctgtctacaacctcccagaagaccacatggctccctgtgctgcttggaagcctgggctgcaagccgctgaccatgtttctcatcgcggaaaataaaatttggggccggaagtcttggcccctgaacgaggggatcatggccgtgggaatcgtctccattcttctgagctccctcctgaaaaacgatgtgcctctcgctggccccctgatcgccgggggaatgcttattgcttgttacgttatcagcggctctagcgccgacctgtccctggaaaaggccgctgaggtgtcttgggaggaagaggcggaacatagcggggcctcccacaatattctcgtcgaggtgcaggatgacggaacaatgaaaatcaaggatgaagaaagagacgatacgctgaccatccttctgaaagctacactcctggccgtttctggcgtgttccctctcagcattcccgccaccctgttcgtctggtatttttggcaaaagaagaaacagagatccggcgtgctttgggacacaccttctcccccggaggtcgaacgggctgtgctggatgacgggatctaccgcattatgcagagaggactgctcggccggagccaggttggggtgggagtcttccaagagaacgtgtttcataccatgtggcacgttacgcgcggcgccgtgctgatgtatcaggggaagagacttgaaccttcctgggcgagcgtcaaaaaggacctgatctcttacggaggcggctggcggctccaggggtcctggaataccggagaggaggtccaggtgattgctgttgaacccggcaaaaaccctaagaatgtccaaacagcccccgggaccttcaagacaccggagggagaagtgggcgccatcgctctggattttaaacctgggaccagcggatctcccattgtgaacagagagggcaagatcgtcggcctctacgggaatggagtggttacaacgtccggcacctatgtgagcgccatcgcgcaggctaaagcctcccaggaagggcctctgcccgagattgaggacgaagtcttccgcaagcggaaccttacaatcatggatctgcaccccggatctggcaaaaccagacgctacctgcctgccattgtgcgggaggctatcaagagaaagctccgcaccctgattcttgccccgacacgggttgtggctagcgaaatggccgaggcgctgaaagggatgcccatcagatatcaaacgaccgccgtcaagtccgaacatacaggcaaagagatcgtggacctcatgtgccacgctacctttacaatgcgcctgctgagccctgttcgggtgcccaattacaacatgattatcatggatgaggcccatttcaccgacccttcttccattgctgccagaggatatatcagcacgcgggtcggcatgggggaagccgctgcgatttttatgacagccacaccccctggatctgtggaggctttcccgcagagcaatgccgtgatccaggatgaggaacgcgacatccccgaaagatcctggaactctggctacgagtggattaccgattttcctgggaagacagtctggttcgttcccagcatcaaatccggaaatgacattgccaactgtctccggaagaatggcaagcgcgtgatccagctttctagaaaaaccttcgatacagagtatcaaaagaccaaaaacaacgactgggactacgtggtcacgacagatattagcgaaatgggggctaattttcgggccgacagagtgatcgatcctcgccggtgcctgaagcccgttattctgaaagacggcccggagagagtgatcctcgcgggacctatgcccgtcaccgtggcttccgccgcccagcgccggggcagaatcgggcgcaaccacaataaggaaggagatcagtacatttatatgggccagcccctgaacaatgacgaggatcatgctcactggacagaggccaagatgcttctggacaacatcaatacccctgaagggattatccccgccctgttcgagcctgaacgggagaaaagcgccgctattgatggagaatacagactgcgcggcgaggccagaaagacgtttgttgagctgatgcggcgcggggacctcccggtgtggctttcttataaagtcgcttccgaaggcttccaatacagcgatagacggtggtgctttgacggagagcgcaacaatcaggtgctggaagagaacatggatgtcgaaatctggaccaaggagggcgagcgcaagaagctgcggcccagatggctcgacgcccgcacatattccgaccctctggcccttcgggagttcaaagagtttgccgcggggagacgctctgtgagcggagatctgatcctcgaaattggcaagctgccccagcacctgacccagcgggcccaaaatgctctcgacaaccttgttatgctgcataattccgagcaagggggcagagcgtaccggcacgctatggaggaactgcctgatacaatcgagaccctcatgctgcttgccctgattgccgtgctcacaggaggcgtgaccctgttctttctgtctgggcgcggactcggcaagacgagcatcgggcttctgtgtgtcatggcttccagcgttctgctctggatggcgtctgtggaaccccattggattgccgcttccatcatcctggagttctttcttatggtgctgctcattccggaacctgacagacagcggacaccccaggataaccaactggcctatgtcgtgatcggactcctcttcatgattcttaccgttgccgctaatgagatgggcctgctggagaccaccaaaaaggacctcgggatcggacacgtggccgtcgaaaaccaccatcacgcggccatgctggatgtggaccttcatcctgctagcgcctggaccctgtacgctgtcgccacaacgattatcacccccatgatgcgccacacaattgagaacaccacagcgaatatctctctcaccgccatcgctaaccaggccgctattctgatgggcctggataaaggctggcctatctccaagatggacattggggtgcccctccttgccctgggatgctacagccaggttaatccgctgacgctcaccgctgccgtgctgatgcttgtcgcgcattatgccatcattggccctgggctgcaagctaaagccacaagagaagctcagaagcggaccgccgccggaatcatgaagaaccccacagtggatggcatcgttgcgattgacctcgatcccgtggtctacgacgctaaatttgagaagcagctggggcagatcatgctgctcattctttgtacctctcaaatcctgctgatgcgcacgacatgggccctctgcgaaagcattaccctggctacaggacctcttaccaccctgtgggagggctccccgggcaaattctggaatacaacgatcgccgtgtctatggccaacatcttcagagggagctatctcgctggagccggcctggcgttttccctgatgaaaagcctcgggggaggccggcgcgggaccggagcccagggcgagacacttggcgaaaaatggaagagacggctgaatcagctgtccaagtctgagttcaacacctacaaaagaagcgggattatggaagtggaccgctccgaggctaaggaaggactcaaacggggcgagacaaccaagcacgccgtttctagagggacggctaaactgcgctggtttgtcgagcggaatcttgtgaagcccgaaggaaaggtgatcgatctgggctgtgggagaggaggctggagctattactgcgccggcctcaaaaaggtcacagaggttaaagggtataccaagggaggccctgggcacgaggagcccattcctatggcgacctacggatggaacctggtgaaactgcattccggcaaggacgtgttctttattccccctgaaaaatgtgatacactcctttgcgacattggggagtctagcccgaatcccaccatcgaggaaggacgcacactgcgggtcctgaagatggtggagccttggctcagaggcaaccagttctgtattaagatcctgaatccctacatgccttccgttgtggaaacgcttgagcaaatgcagcgcaaacacggcgggatgctggtccggaaccccctcagcagaaattctacccatgagatgtattgggtgtcctgcggaacaggcaacatcgttagcgccgtgaatatgacctctcgcatgctgctgaaccggtttacaatggctcacagaaagccgacctacgaacgcgatgtcgacctcggggccggaacgagacacgtggctgtggagcctgaagtcgccaacctggatattatcggccagcggattgagaatatcaaacatgaacacaagtccacctggcattatgacgaggataacccctacaaaacatgggcttatcacgggagctacgaggttaagccctctggatccgccagctccatggtgaatggcgtggtcaaacttctgaccaaaccttgggacgtgattcccatggttacacagatcgcgatgaccgatacaacccctttcggccaacagcgcgtgtttaaggaaaaagtcgacacgagaacaccgaaggccaaacgggggaccgctcagatcatggaggtgaccgccagatggctctggggattcctgagccggaacaagaagccccgcatttgtacaagagaagagtttacgcggaaagttcgctctaatgctgccatcggcgccgtgttcattgacgaaaaccaatggaatagcgcgaaggaggctgtcgaggatgaaagattttgggaccttgtgcatcgggagcgcgaactgcacaaacaggggaagtgcgctacctgcgtttataacatgatgggaaaaagagagaagaagctcggcgagttcgggaaagccaagggctcccgggctatctggtacatgtggctgggagcccgcttcctggagtttgaggctctcggcttcatgaatgaagatcactggttttctagagagaacagcctgtccggggtggaaggagagggccttcataaactggggtacattctccgggacatctctaagatccctggaggcaatatgtatgccgatgacacagcggggtgggatacccgcattacagaggacgatctgcagaacgaagccaaaatcaccgacattatggagcccgaacacgcccttctggccaaggctatcttcaaactcacataccagaataaggtcgtgagagtccaacggcctgccaagaacggcaccgtgatggatgttattagccgcagagaccagcggggatccggccaggtggggacgtatggactgaatacctttacaaacatggaggcgcagctgatcagacaaatggaatctgagggcatcttcagcccctccgagctcgaaaccccgaacctggccgagcgcgtccttgattggctggggaaatacggagtggaacggctcaagagaatggctattagcggcgacgactgtgtggttaaacctatcgatgaccgctttgccacagctctgaccgcccttaatgatatggggaaggtgcggaaagacattccccagtgggagccttctaagggctggaacgattggcagcaggtccccttctgctcccatcactttcaccaactgatcatgaaggacggaagagaaattgtggttccttgtcgcaatcaggatgagctcgtgggccgggctagagtcagccagggggccggatggtctctgcgcgagacggcgtgcctgggcaaatcctatgcccagatgtggcaactcatgtacttccatcggagagacctgcgccttgctgccaacgccatctgtagcgctgtgcccgtcgattgggtgccgacatcccggaccacatggtctattcacgcccatcaccagtggatgaccacggaagacatgctgagcgtttggaatagagtgtggatcgaggaaaacccttggatggaggataagacccatatctccaattgggaagacgtcccctatctcgggaaacgggaggaccagtggtgcggaagcctgattggccttacagcgagagctacctgggccacaaacatccaagtggccattaatcaggttcgccggctgatcgggaacgagaattacctcgattacatgacctctatgaagagatttaaaaacgaatccgaccccgagggcgctctgtggtga

SEQ ID NO: 19346 - RNA, 9879 nt, synthetic construct
  misc_feature 1..9879: note = derived and/or modified CDS sequence (opt5) from DENV-1__KT187560__SS-prME
  source 1..9879: mol_type = other RNA
agcgtgaccatgctgctgatgctgcttcccacagccctggctttccacctcacgacccggggcggggagcctcatatgatcgtctccaagcaggaacggggaaagtctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtccctcggatgcaaaccgctgacaatgtttcttattaccgagaataagatctggggcagaaagagctggcccctgaacgaaggcattatggccgttgggatcgtgtctattctcctgtccagcctcctgaaaaatgatgtccctcttgctggacccctgatcgccggcgggatgctgatcgcttgttatgtgatttccggaagctctgccgacctcagcctggagcgggcggccgaggtttcctgggaagaggaagctgagcattctggcgccagccacaacatccttgtggaagtccaggatgacgggacaatgaagattaaagatgaggagcgcgacgataccctgacgatcctcctgaaggctaccctcctggccgtgtccggagtctaccctatgtctattcccgccacacttttcgtgtggtatttttggcagaagaagaaacagagaagcggcgttctgtgggacacccctagccctcccgaagtggagcgggctgtcctggatgacggcatctaccgcatcctccagagagggctgcttggacggtctcaggtgggcgttggggtgttccaagacggagtcttccatacaatgtggcacgtgaccagaggcgcggtgctgatgtatcaggggaaacgcctcgaacccagctgggcctccgttaagaaagatctgattagctacggaggcggctggcggtttcaggggtcttggaatacaggagaggaggtccaggtgatcgctgtggaacccggcaagaaccctaaaaatgtccaaacgacccccgggacattcaagaccccggagggagaagtgggcgccattgccctcgactttaaacctgggacctccggaagccccatcgttaacagagagggcaagattgtgggcctgtacgggaatggagtcgtgacaacgtctggcacctatgtttccgctatcgcccaggcgaaggctagccaggaagggcctcttcccgagattgaggatgaagtgttcaaaaagcgcaacctgacaatcatggacctgcaccccggatccggcaaaacccggagatacctccctgccatcgtccgcgaggccattaagcggaaactgagaacacttatcctggctccgacccgcgtggttgcctctgaaatggcggaggctctcaaggggatgcccattcggtatcaaacgacagccgtgaagtccgaacataccggcaaagagatcgtcgatctgatgtgccacgccacctttacaatgagactgctctcccctgtgcgggtgcccaattacaacatgattatcatggacgaggctcatttcaccgatcctgccagcatcgctgcccgcggatatatttctacaagagtcggcatgggggaagcggccgctatctttatgaccgccacgccccctggatccgttgaggctttcccgcagagcaatgccgtgattcaggacgaagaacgggatatccccgaacgctcttggaacagcggctacgactggattacagattttcctgggaagaccgtgtggttcgtcccctccatcaaatctggaaatgacatcgccaactgtcttagaaagaacggcaaacgggtgattcagctgagcagaaagacatttgacaccgagtatcaaaagacgaaaaataacgattgggactacgttgtgaccacagatatctccgagatgggggctaatttccgcgcggaccgggtcattgatcctagacgctgcctgaagcccgtgatcctcaaagacggcccggaacgggttattctggccggacctatgcccgtgaccgctgcctctgccgctcagagacgcggccggatcgggagaaaccagaataaggagggagatcagtacatttatatgggccaaccccttaacaatgacgaagatcacgcccattggacagaggcgaaaatgctgctcgacaacatcaatacccctgaggggatcattcccgctctgttcgaacctgagcgcgaaaagagcgccgccatcgatggagagtacagactgcggggcgaagctcgcaagacatttgtcgagctcatgagaagaggggaccttccggtgtggctgtcctataaagtcgccagcgagggcttccagtactctgatcgcagatggtgctttgacggagaacggaacaatcaggtgctggaggaaaacatggacgttgagatttggaccaaggaaggcgagcgcaagaagctccgcccccggtggctggatgcgagaacgtattccgaccctcttgccctgcgcgagttcaaagaatttgctgccgggcggagaagcgtgtccggagatctcatcctggagattggcaagctgccccagcacctcacacttcgggctcaaaatgccctggacaacctggtgatgctccacaattctgaacaagggggaaaggcttaccgccatgccatggaggaactgcctgataccatcgagacccttatgctgctcgcgctgatcgccgtcctgacaggcggcgttaccctcttctttcttagcgggaagggactgggcaagacatccattgggctgctctgtgtgatggcttctagcgtgctgctttggatggcctccgtcgagccccactggatcgctgccagcattatcctggagttctttctcatggtgctgctgattccggagcctgacagacagcggacgccccaggataaccaactcgcctatgttgtgatcggacttctgttcatgatcctgaccgtcgctgcgaacgaaatgggcctcctggagacaaccaaaaaggaccttgggattggacatgtggtcgccgagaatcaccaccatgctacaatgctggatatcgacctccaccctgcctctgcctggaccctgtacgctgtggccacgaccattatcacacccatgatgcgccataccattgaaaacacaaccgcgaatatctccctgacggccattgctaaccaggccgctatcctcatgggccttgataaaggctggcctatcagcaagatggacattggggttcccctgctggccctcggatgctactctcaggtgaatccgctgacacttaccgcggccgtcctgatgctcgtggctcactatgccatcattggccctgggctgcaagctaaagccacaagagaggctcagaagcggaccgccgcgggaatcatgaagaaccccaccgttgatggcattgtggccatcgacctggaccccgtcgtgtacgatgctaaatttgaaaagcagctcgggcagatcatgcttctgattctgtgtacatcccaaatcctcctgatgcgcacgacctgggccctttgcgagagcattacactggctaccggacctctcacaaccctgtgggaaggctctccgggcaaattctggaatacgacaatcgccgtgagcatggccaacatttttagagggtcctatctggcgggagctggcctcgccttctctcttatgaaaagcctcgggggaggccggcgcgggaccggagctcagggcgagaccctgggcgagaaatggaagagacagctcaatcagctgtccaagagcgagttcaacacatacaaacggtccgggatcatggaggttgacagatctgaagccaaggagggacttaaacgcggcgaaaccacaaagcatgccgtcagccgggggacggctaaactgagatggtttgtggagcgcaatctcgtgaagcccgagggaaaggtcatcgatctgggctgtgggcggggaggctggtcctattactgcgccggcctgaaaaaggttaccgaagtgaaagggtatacaaagggaggccctgggcacgaggaacccattcctatggcgacctacggatggaacatcgtgaaactccactctggcagagacgtcttctttacaccccctgagaagtgtgatacccttctgtgcgacattggggaaagctccccgaatcccacgatcgaggagggacgcaccctgcgggtgctcaaaatggttgaaccttggctgagaggcaaccaattctgtattaagatccttaatccctacatgccttctgtggtcgagacactggaacagatgcagcgcaagcatggcgggatgctcgtgcggaaccccctgagcagaaattccacccacgagatgtattgggttagctgcggaacaggcaacattgtgtctgccgtcaacatgacctcccgcatgctgctcaatcggtttacaatggctcatagaaaaccgacctacgagcgcgatgtggacctgggggccggaacgagacacgtggctgtcgaacctgagatcgccaaccttgatatcattggccagcggatcgaaaatattaagaacgagcacaaaagcacatggcattatgacgaagataatccctacaagacctgggcgtatcacgggtcttacgaggttaaaccctccggaagcgcctcttccatggtgaacggcgtggtccgcctgctcaccaagccttgggacgtgatccccatggttacacaaattgctatgacggacaccacacctttcggccagcagagagtgtttaaggagaaagtcgatacccggacaccgagacccaagcgggggaccgcccaaatcatggaagtgacagctaaatggctgtggggattccttagccgcaataagaaacctagaatctgtacccgggaggaatttacgcgcaaggttagatccaacgccgctattggcgccgtgttcgtcgacgagaatcagtggaacagcgcgaaggaagccgtggaggatgagcggttttgggacctggttcatcgcgaaagagagctccacaaacaggggaagtgcgctacctgcgtgtataatatgatgggaaaacgggaaaagaaactgggcgagttcgggaaggccaagggctctcgcgctatctggtacatgtggctgggagccagatttctcgagttcgaggccctgggcttcatgaacgaggatcattggtttagccgggaaaattccctttctggggtcgagggagaaggcctgcacaaactcgggtacattctgcgcgacatcagcaagattcccggaggcaacatgtatgcggatgacacagctgggtgggataccagaatcacagaggacgatcttcagaatgaggccaaaatcaccgacattatggaacctgagcacgccctgctcgctacgtccatcttcaagctgacataccaaaacaaagtggtccgggtgcagcgccccgccaagtctggcaccgttatggatgtgattagcagacgggaccagagaggatccggccaggtcgggacatatggactgaacacctttacgaatatggaagtgcaactcatccgccagatggagtctgaaggcattttcagcccgtccgagctggagaacagcaatcttgctgaacgggtgctggactggctcgagaaacatggggttgaaagactgaagcgcatggccatctctggagatgactgtgtggtcaagcctaccgatgaccggtttgcgacagcccttaccgctctgaacgatatgggcaaagtgagaaaggacatcccccagtgggagccttccaaagggtggaatgattggcagcaagttcccttctgcagccaccattttcaccagctcattatgaaggacggccgcgaaatcgtggtcccttgtcggaaccaggatgagctggtgggacgggcccgcgtctctcagggcgctgggtggtccctgcgggagacagcctgcctcggaaaaagctacgcgcaaatgtggcagctgatgtatttccacagacgcgaccttcggctggccgctaatgccatttgttccgctgtgcccgttaactgggtgccgacctctagaacaacctggagcatccatgcccaccatcagtggatgacgacagaagatatgctctccgtctggaatcgggtgtggattgaggaaaacccttggatggaggacaagacccacgttagctcttgggaagacgtgccctacctgggcaagagagaggatcaatggtgcgggtcccttatcggactgaccgctcgcgccacatgggcgaccaatattcaggtcgccatcaaccaggtgcggagactcatcggcaatgagaactatctggactacatgacaagcatgaaacgctttaagaatgaatctgatcccgagggggctctgtggtga

SEQ ID NO: 19347 - RNA, 9879 nt, synthetic construct
  misc_feature 1..9879: note = derived and/or modified CDS sequence (opt5) from DENV-1__KT187561__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagaacaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaagggggtgtcctatgtcatgtgtacgggcagcttcaaactggagaaggaagtggccgagacacagcacggaaccgttctggtgcaggtcaagtacgagggcaccgatgcgccgtgcaaaattcctatctctacacaagacgaaaagggggtgacccagaacggacggcttatcacagctaatcccattgtgacggataaagagaagcctgttaacatcgaaaccgagccgccctttggcgagtcctatattgtcatcggggccggagaaaaagccctcaagctgagctggttcaagaaaggctctagcattgggaagatgtttgaggctacagccagaggcgctcgccggatggccatcctgggagacaccgcgtgggatttcggctccatcgggggagtgtttacatctgtgggcaaactcgtccatcaggtgttcgggaccgcctacggagttctgtttagcggcgtgtcctggacgatgaagattgggatcggcattcttctgacctggctcggactgaatagcagatctacatccctgagcatgacctgtatcgctgtcggcatggtgacactttacctcggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctgtccgccgcgattggcaaggcctgggaggagggggtgtgcggcatcagatctgctacgcgcctcgaaaatatcatgtggaaacagattagcaacgagctgaatcatatccttctggaaaacgacatgaagttcacagtcgtggtgggagacgccaatggcattctcacccaggggaaaaagatgatccggccgcaacccatggagcacaaatactcctggaagtcttggggaaaggctaaaattatcggcgccgatacccagaacacaacctttatcattgacgggcctgatacgcccgaatgtcctgacgatcagagagcctggaatatctgggaggtcgaggactatggattcggcgtttttacaaccaacatttggctgaagctgcgcgatagctacacacagatgtgcgaccaccggcttatgtccgctgcgatcaaagatagcaaggccgtgcatgctgacatgggctattggattgaatctgagaaaaatgaaacctggaagctcgccagagcctccttcatcgaggtgaagacatgtatctggccccgcagccacaccctgtggtctaacggggtcctggaatccgagatgattatcccgaaaatttacggaggccctatcagccaacataattatcggcccgggtacttcacgcagaccgctggaccttggcacctcggcaagctggagcttgattttaacctgtgcgaagggacaaccgtggttgtggacgagcactgcggaaatagaggcccctctctccggacaaccacggtcacaggcaaaattatccatgaatggtgttgccgcagctgtaccctgcctcccctgagattcagaggggaagatggatgctggtacggcatggagatcagaccggtgaaggaaaaagaggaaaaccttgttcgctccatggtgagcgccgggtctggagaggtcgactcctttagcctcggcctgctgtgtgtgtccattatgatcgaagaggttatgcggtctagatggagccgcaagatgctcatgacagggaccctggcggtgttctttcttctgattatgggacagctcacctggaatgacctgatcagactgtgcattatggtcggcgctaacgtgtccgatcggatgggcatggggacaacgtatcttgccctgatggccaccttcaagatgcgccctatgtttgctgtgggactcctgttcagacggctcacatctcgcgaggtcctgcttctgaccatcggcctcagcctggttgcctccgtggaactgcccaactctcttgaggaactgggggacggactcgcgatgggcattatgatgctgaaactcctgacagattttcaaagccaccagctttggaccacgctgctctccctgacattcatcaagaccaccctgagccttgactacgcttggaaaacaatggccatggtgctgtctatcgtctccctctttcccctgtgtctcagcaccacatctcagaagacgacctggctgcctgtgcttctggggtccttcggatgcaaaccgctgacaatgtttctcattaccgagaataagatctggggcagaaagagctggcccctgaacgaaggcattatggccgttgggatcgtgtctattcttctgtccagcctcctgaaaaatgatgtccctctcgctggacccctgatcgccggcgggatgcttatcgcttgttatgtgatttccggaagctctgccgacctgagcctggagcgggcggccgaggtttcctgggaagaggaagctgagcattctggcgccagccacaacatcctcgtggaagtccaggatgacgggacaatgaagattaaagatgaggagcgcgacgataccctgacgatccttctgaaggctaccctcctggccgtgtccggagtctaccctatgtctattcccgccacactcttcgtgtggtatttctggcagaagaagaaacagagaagcggcgttctgtgggacacccctagccctcccgaagtggagcgggctgtccttgatgacggcatctaccgcatcctgcagagagggctgctcggacggtctcaggtgggcgttggggtgtttcaagacggagtcttccatacaatgtggcacgtgaccagaggcgcggtgctgatgtatcaggggaaacgccttgaacccagctgggcctccgttaagaaagatctgattagctacggaggcggctggcggtttcaggggtcttggaatacaggagaggaggtccaggtgatcgctgtggaacccggcaagaaccctaaaaatgtccaaacgacccccgggacattcaagaccccggagggagaagtgggcgccattgccctcgactttaaacctgggacctccggaagccccatcgttaacagagagggcaagattgtgggcctgtacgggaatggagtcgtgacaacgtctggcacctatgtttccgctatcgcccaggcgaaggctagccaggaagggcctctccccgagattgaggatgaagtgttcaaaaagcgcaacctgacaatcatggaccttcaccccggatccggcaaaacccggagatacctgcctgccatcgtccgcgaggccattaagcggaaactgagaacactcatcctggctccgacccgcgtggttgcctctgaaatggcggaggctcttaaggggatgcccattcggtatcaaacgacagccgtgaagtccgaacataccggcaaagagatcgtcgatctgatgtgccacgccacctttacaatgagactcctgtcccctgtgcgggtgcccaattacaacatgattatcatggacgaggctcatttcaccgatcctgccagcatcgctgcccgcggatatatttctacaagagtcggcatgggggaagcggccgctatctttatgaccgccacgccccctggatccgttgaggctttcccgcagagcaatgccgtgattcaggacgaggaacgggatatccccgaacgctcttggaacagcggctacgactggattacagattttcctgggaagaccgtgtggttcgtcccctccatcaaatctggaaatgacatcgccaactgtctgagaaagaacggcaaacgggtgattcagctcagcagaaagacattcgacaccgagtatcaaaagacgaaaaataacgattgggactacgttgtgaccacagatatctccgagatgggggctaattttcgcgcggaccgggtcattgatcctagacgctgccttaagcccgtgatcctgaaagacggcccggaacgggttattctggccggacctatgcccgtgaccgctgcctctgccgctcagagacgcggccggatcgggagaaaccagaataaggagggagatcagtacatttatatgggccaacccctcaacaatgacgaagatcacgcccattggacagaggcgaaaatgctgcttgacaacatcaatacccctgaggggatcattcccgctctgttcgaacctgagcgcgaaaagagcgccgccatcgatggagagtacagactccggggcgaagctcgcaagacatttgtcgagctgatgagaagaggggacctgccggtgtggctctcctataaagtcgccagcgagggcttccagtactctgatcgcagatggtgctttgacggagaacggaacaatcaggtgcttgaggaaaacatggacgttgagatttggaccaaggaaggcgagcgcaaaaagctgcgcccccggtggctggatgcgagaacgtattccgaccctctcgccctgcgcgagttcaaagaatttgctgccgggcggagaagcgtgtccggagatcttatcctggagattggcaagctcccccagcacctgacactgcgggctcaaaatgccctcgacaaccttgtgatgctgcacaattctgaacaagggggaaaggcttaccgccatgccatggaggaactgcctgataccatcgagaccctcatgctgcttgcgctgatcgccgtcctcacaggcggcgttaccctgttctttctgagcgggaagggactcggcaagacatccattgggcttctgtgtgtgatggcttctagcgtgctgctctggatggcctccgtcgagccccactggatcgctgccagcattatcctggagttctttcttatggtgctgctcattccggagcctgacagacagcggacgccccaggataaccaactggcctatgttgtgatcggactcctgttccttatcctgaccgtcgctgcgaacgaaatgggcctgctcgagacaaccaaaaaggacctggggattggacatgtggtcgccgagaatcaccaccatgctacaatgcttgatatcgacctgcaccctgcctctgcctggaccctctacgctgtggccacgaccattatcacacccatgatgcgccataccattgaaaacacaaccgcgaatatctccctgacggccattgctaaccaggccgctatcctgatgggcctcgataaaggctggcctatcagcaagatggacattggggttccccttctggccctgggatgctactctcaggtgaatccgctcacactgaccgcggccgtccttatgctggtggctcactatgccatcattggccctgggctccaagctaaagccacaagagaggctcagaagcggaccgccgcgggaatcatgaagaaccccaccgttgatggcattgtggccatcgacctggaccccgtcgtgtacgatgctaaatttgaaaagcagctggggcagatcatgctccttattctgtgtacatcccaaatcctgctcatgcgcacgacctgggccctgtgcgagagcattacacttgctaccggacctctgacaaccctctgggaaggctctccgggcaaattctggaatacgacaatcgccgtgagcatggccaacattttcagagggtcctatctggcgggagctggcctggccttttctctcatgaaaagccttgggggaggccggcgcgggaccggagctcagggcgagaccctgggcgagaaatggaagagacagctgaatcagctctccaagagcgagttcaacacatacaaacggtccgggatcatggaggttgacagatctgaagccaaggagggactgaaacgcggcgaaaccacaaagcatgccgtcagccgggggacggctaaacttagatggtttgtggagcgcaatctggtgaagcccgagggaaaggtcatcgatctcggctgtgggcggggaggctggtcctattactgcgccggcctgaaaaaggttaccgaagtgaaagggtatacaaagggaggccctgggcacgaggaacccattcctatggcgacctacggatggaacatcgtgaaactgcactctggcagagacgtcttctttacaccccctgagaagtgtgataccctcctttgcgacattggggaaagctccccgaatcccacgatcgaggagggacgcaccctgcgggtgctgaaaatggttgaaccttggctcagaggcaaccaattctgtattaagatcctgaatccctacatgccttctgtggtcgagacacttgaacagatgcagcgcaagcatggcgggatgctggtgcggaaccccctcagcagaaattccacccacgagatgtattgggttagctgcggaacaggcaacattgtgtctgccgtcaacatgacctcccgcatgctgctgaatcggtttacaatggctcatagaaaaccgacctacgagcgcgatgtggacctcggggccggaacgagacacgtggctgtcgaacctgagatcgccaacctggatatcattggccagcggatcgaaaatattaagaacgagcacaaaagcacatggcattatgacgaagataatccctacaagacctgggcgtatcacgggtcttacgaggttaaaccctccggaagcgcctcttccatggtgaacggcgtggtccgccttctgaccaagccttgggacgtgatccccatggttacacaaattgctatgacggacaccacacctttcggccagcagagagtgtttaaggagaaagtcgatacccggacaccgagacccaagcgggggaccgcccaaatcatggaagtgacagctaaatggctctggggattcctgagccgcaataagaaacctagaatctgtacccgggaggaatttacgcgcaaggttagatccaacgccgctattggcgccgtgttcgtcgacgagaatcagtggaacagcgcgaaggaagccgtggaggatgagcggttttgggaccttgttcatcgcgaaagagagctgcacaaacaggggaagtgcgctacctgcgtgtataatatgatgggaaaacgggaaaagaaactcggcgagttcgggaaggccaagggctctcgcgctatctggtacatgtggctgggagccagattcctggaatttgaggccctcggcttcatgaacgaggatcattggtttagccgggaaaattccctgtctggggtcgagggagaaggccttcacaaactggggtacattctccgcgacatcagcaagattcccggaggcaacatgtatgcggatgacacagctgggtgggataccagaatcacagaggacgatctgcagaatgaggccaaaatcaccgacattatggaacctgagcacgcccttctggctacgtccatcttcaagctcacataccaaaacaaagtggtccgggtgcagcgccccgccaagtctggcaccgttatggatgtgattagcagacgggaccagagaggatccggccaggtcgggacatatggactgaacacctttacgaatatggaagtgcaactgatccgccagatggagtctgaaggcattttcagcccgtccgagctcgagaacagcaatctggctgaacgggtgcttgactggctggagaaacatggggttgaaagactcaagcgcatggccatctctggagatgactgtgtggtcaagcctaccgatgaccggtttgcgacagccctgaccgctcttaacgatatgggcaaagtgagaaaggacatcccccagtgggagccttccaaagggtggaatgattggcagcaagttcccttctgcagccaccattttcaccagctgattatgaaggacggccgcgaaatcgtggtcccttgtcggaaccaggatgagctcgtgggacgggcccgcgtctctcagggcgctgggtggtccctgcgggagacagcctgcctgggaaaaagctacgcgcaaatgtggcagctcatgtatttccacagacgcgacctgcggcttgccgctaatgccatttgttccgctgtgcccgttaactgggtgccgacctctagaacaacctggagcatccatgcccaccatcagtggatgacgacagaagatatgctgtccgtctggaatcgggtgtggattgaggaaaacccttggatggaggacaagacccacgttagctcttgggaagacgtgccctacctcggcaagagagaggatcaatggtgcgggtccctgatcggacttaccgctcgcgccacatgggcgaccaatattcaggtcgccatcaaccaggtgcggagactgatcggcaatgagaactatctcgactacatgacaagcatgaaacgctttaagaatgaatctgatcccgagggggctctgtggtga

SEQ ID NO: 19348 - RNA, 9879 nt, synthetic construct
  misc_feature 1..9879: note = derived and/or modified CDS sequence (opt5) from DENV-1__KT187562__SS-prME
  source 1..9879: mol_type = other RNA
agcgtgaccatgctgctcatgctgcttcccacagccctggctttccacctcacgacccggggcggggaacctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagagaagacactgaagctgagctggtttaagaaaggctctagcattgggaagatgttcgaggccaccgctagaggcgcccgccggatggctatcctcggagacacagcctgggattttggctccatcgggggagtgttcacctctgtgggcaaactggtccatcaggtgtttgggacggcgtacggagttcttttcagcggcgtgtcctggaccatgaagattgggatcggcattctgctcacatggctgggactgaatagcagatctacctcccttagcatgacatgtatcgccgtcggcatggtgaccctctacctgggggttatggtgcaggctgactctggatgcgtcattaactggaaaggccgcgaactgaagtgtgggtccggaatctttgtgacaaacgaggttcacacctggacggaacaatataagttccaggccgatagccctaaacggctctccgctgccattggcaaggcgtgggaggagggggtgtgcggcatcagatctgccacacgcctggaaaatatcatgtggaaacagattagcaacgagcttaatcatatcctgctcgaaaacgacatgaagtttaccgtcgtggtgggagacgctaatggcattctgacccaggggaaaaagatgatccggccgcaacccatggagcacaaatactcctggaagtcttggggaaaggccaaaattatcggcgctgatacacagaacaccacgttcatcattgacgggcctgatacacccgaatgtcctgacgatcagagagcctggaatatctgggaggtcgaggactatggatttggcgttttcaccacaaacatttggctgaaacttcgcgatagctacacccagatgtgcgaccaccggctcatgtccgccgctatcaaagatagcaaggcggtgcatgccgacatgggctattggattgaatctgagaaaaatgaaacatggaagctggctagagcctcctttatcgaggtgaagacctgtatctggccccgcagccacacgctgtggtctaacggggtcctcgaatccgagatgattatcccgaaaatttacggaggccctatcagccaacataattatcggcccgggtacttcacccagacagccggaccttggcacctgggcaaacttgagctggatttcaacctctgcgaagggaccacagtggttgtggacgagcactgcggaaatagaggcccctctctgcggaccacgacagtcaccggcaaaattatccatgaatggtgttgccgcagctgtacactgcctccccttagatttagaggggaagatggatgctggtacggcatggagatcagaccggtgaaggaaaaagaggaaaacctcgttcgctccatggtgagcgctgggtctggagaggtcgactccttcagcctgggcctgctctgtgtgtccattatgatcgaagaggttatgcggtctagatggagccgcaagatgctgatgaccgggacccttgccgtgtttttcctgctcattatgggacagctgacatggaatgacctgatcagactttgcattatggtcggcgcgaacgtgtccgatcggatgggcatggggacgacctatctggctctcatggccacatttaagatgcgccctatgttcgccgtgggactgctctttagacggctgacctctcgcgaggtccttctgctcacaatcggcctgagcctggttgcttccgtggaacttcccaactctctggaggaactcggggacggactggccatgggcattatgatgctcaaactgcttaccgatttccaaagccaccagctgtggacgacactcctgtccctgacctttatcaagaccacacttagcctggactacgcgtggaaaaccatggctatggtgctctctatcgtctccctgttccccctctgtctgagcacaacgtctcagaagaccacatggcttcctgtgctgctggggtcctttggatgcaaaccgctcaccatgttcctgattacagagaataagatctggggcagaaagagctggccccttaacgaaggcattatggccgttgggatcgtgtctattctgctctccagcctgctcaaaaatgatgtccctctggccggaccccttatcgctggcgggatgctgatcgcctgttatgtgatttccggaagctctgctgacctgagcctcgagcgggccgcggaggtttcctgggaagaggaagccgagcattctggcgctagccacaacatcctggtggaagtccaggatgacgggaccatgaagattaaagatgaggagcgcgacgatacgcttaccatcctgctcaaggccacactgctcgctgtgtccggagtctaccctatgtctattcccgccaccctgtttgtgtggtatttctggcagaagaagaaacagagaagcggcgttctttgggacacacctagccctcccgaagtggagcgggccgtcctggatgacggcatctaccgcatcctgcagagagggctcctgggacggtctcaggtgggcgttggggtgttccaagacggagtctttcataccatgtggcacgtgacaagaggcgctgtgcttatgtatcaggggaagcgcctggaacccagctgggcgtccgttaagaaagatctcattagctacggaggcggctggcggttccaggggtcttggaatacgggagaggaggtccaggtgatcgccgtggaacccggcaagaaccctaaaaatgtccaaaccacacccgggacctttaagaccccggagggagaagtgggcgctattgccctggacttcaaacctgggacatccggaagccccatcgttaacagagagggcaagattgtgggcctctacgggaatggagtcgtgacgacctctggcacatatgtttccgccatcgctcaggccaaggcgagccaggaagggcctctgcccgagattgaggatgaagtgtttaaaaagcgcaaccttaccatcatggacctgcaccccggatccggcaaaacacggagatacctgcctgctatcgtccgcgaggccattaagcggaaactcagaaccctgatccttgccccgacgcgcgtggttgcttctgaaatggccgaggcgctgaaggggatgcccattcggtatcaaacaaccgctgtgaagtccgaacataccggcaaagagatcgtcgatctcatgtgccacgccacattcaccatgagactgctgtcccctgtgcgggtgcccaattacaacatgattatcatggacgaggcccattttacagatcctgctagcatcgccgctcgcggatatatttctaccagagtcggcatgggggaagccgcggccatcttcatgacggctacaccccctggatccgttgaggcctttccgcagagcaatgctgtgattcaggacgaagaacgggatatccccgaacgctcttggaacagcggctacgactggattaccgatttccctgggaagacagtgtggtttgtcccctccatcaaatctggaaatgacatcgccaactgtctcagaaagaacggcaaacgggtgattcagcttagcagaaagaccttcgacacggagtatcaaaagaccaaaaataacgattgggactacgttgtgacaaccgatatctccgagatgggggccaatttccgcgctgaccgggtcattgatcctagacgctgcctgaagcccgtgatcctgaaagacggcccggaacgggttattctcgcgggacctatgcccgtgacagccgcttctgccgcccagagacgcggccggatcgggagaaaccagaataaggagggagatcagtacatttatatgggccaacccctgaacaatgacgaagatcacgctcattggaccgaggccaaaatgcttctggacaacatcaatacacctgaggggatcattcccgcgctctttgaacctgagcgcgaaaagagcgctgccatcgatggagagtacagactgcggggcgaagcccgcaagaccttcgtcgagctgatgagaagaggggacctcccggtgtggctttcctataaagtcgctagcgagggctttcagtactctgatcgcagatggtgcttcgacggagaacggaacaatcaggtgctggaggaaaacatggacgttgagatttggacgaaggaaggcgagcgcaagaagctgcgcccccggtggctcgatgccagaacatattccgaccctctggcgcttcgcgagtttaaagagttcgccgctgggcggagaagcgtgtccggagatctgatcctcgagattggcaagctgccccagcacctgaccctccgggcccaaaatgctcttgacaacctggtgatgctgcacaattctgaacaagggggaaaagcctaccgccatgctatggaggaactccctgataccatcgagacactgatgcttctggccctcatcgcggtcctgaccggcggcgttacactgtttttcctcagcgggaagggacttggcaagacgtccattgggctgctgtgtgtgatggcctctagcgtgctcctgtggatggcttccgtcgagccccactggatcgccgctagcattatccttgaatttttcctgatggtgctcctgattccggagcctgacagacagcggacaccccaggataaccaactggcctatgttgtgatcggactcctttttatgatcctgacagtcgccgctaacgaaatgggcctgctcgagaccaccaaaaaggacctggggattggacatgtggtcgcggagaatcaccaccatgccaccatgcttgatatcgacctgcaccctgcttctgcctggacgctctacgccgtggctaccacaattatcacccccatgatgcgccatacaattgaaaacaccacggccaatatctccctgacagcgattgccaaccaggctgccatcctgatgggcctcgataaaggctggcctatcagcaagatggacattggggttccccttctggctctgggatgctactctcaggtgaatccgctcaccctgacagccgcggtccttatgctggtggcccactatgctatcattggccctgggctccaagccaaagctaccagagaggcccagaagcggaccgctgccggaatcatgaagaaccccacagttgatggcattgtggcgatcgacctggaccccgtcgtgtacgatgccaaattcgaaaagcagctggggcagatcatgctccttattctgtgtacgtcccaaatcctgctcatgcgcaccacatgggctctgtgcgagagcattacccttgccacaggacctctgaccacgctctgggaaggctctccgggcaaattttggaatacaaccatcgctgtgagcatggccaacattttcagagggtcctatctggccggagcgggcctggctttctctctcatgaaaagccttgggggaggccggcgcgggaccggagcccagggcgagacactgggcgagaaatggaagagacagctgaatcagctctccaagagcgaatttaacacctacaaacggtccgggatcatggaggttgacagatctgaagctaaggagggactgaaacgcggcgaaacaacgaagcatgccgtcagccgggggaccgccaaacttagatggttcgtggagcgcaatctggtgaagcccgagggaaaggtcatcgatctcggctgtgggcggggaggctggtcctattactgcgctggcctgaaaaaggttacagaagtgaaagggtataccaagggaggccctgggcacgaggaacccattcctatggccacatacggatggaacatcgtgaaactgcactctggcagagacgtctttttcacgccccctgagaagtgtgataccctcctttgcgacattggggaaagctccccgaatcccaccatcgaggagggacgcacactgcgggtgctgaaaatggttgaaccttggctcagaggcaaccaattttgtattaagatcctgaatccctacatgccttctgtggtcgagacccttgaacagatgcagcgcaagcatggcgggatgctggtgcggaaccccctcagcagaaattccacacacgagatgtattgggttagctgcggaaccggcaacattgtgtctgcggtcaacatgacatcccgcatgctgctgaatcggttcaccatggcccatagaaaaccgacgtacgagcgcgatgtggacctcggggctggaacaagacacgtggccgtcgaacctgagatcgctaacctggatatcattggccagcggatcgaaaatattaagaacgagcacaaaagcacctggcattatgacgaagataatccctacaagacctgggcctatcacgggtcttacgaggttaaaccctccggaagcgcgtcttccatggtgaacggcgtggtccgccttctgacaaagccttgggacgtgatccccatggttacgcaaattgccatgaccgacacaaccccttttggccagcagagagtgttcaaggagaaagtcgatacacggaccccgagacccaagcgggggacagctcaaatcatggaagtgaccgccaaatggctctggggatttctgagccgcaataagaaacctagaatctgtacgcgggaggagttcacccgcaaggttagatccaacgctgccattggcgctgtgtttgtcgacgagaatcagtggaacagcgccaaggaagcggtggaggatgagcggttctgggaccttgttcatcgcgaaagagagctgcacaaacaggggaagtgcgccacatgcgtgtataatatgatgggaaaacgggaaaagaaactcggcgagtttgggaaggctaagggctctcgcgccatctggtacatgtggctgggagctagattcctggagttcgaggccctcggctttatgaacgaggatcattggttcagccgggaaaattccctgtctggggtcgagggagaaggccttcacaaactggggtacattctccgcgacatcagcaagattcccggaggcaacatgtatgccgatgacaccgcggggtgggatacaagaatcaccgaggacgatctgcagaatgaggctaaaatcacggacattatggaacctgagcacgcccttctggccacatccatctttaagctcacctaccaaaacaaagtggtccgggtgcagcgccccgctaagtctggcacagttatggatgtgattagcagacgggaccagagaggatccggccaggtcgggacctatggactgaacacgttcaccaatatggaagtgcaactgatccgccagatggagtctgaaggcatttttagcccgtccgagctcgagaacagcaatctggccgaacgggtgcttgactggctggagaaacatggggttgaaagactcaagcgcatggctatctctggagatgactgtgtggtcaagcctacagatgaccggttcgccaccgcgctgacagcccttaacgatatgggcaaagtgagaaaggacatcccccagtgggagccttccaaagggtggaatgattggcagcaagttcccttttgcagccaccatttccaccagctgattatgaaggacggccgcgaaatcgtggtcccttgtcggaaccaggatgagctcgtgggacgggctcgcgtctctcagggcgccgggtggtccctgcgggagaccgcttgcctgggaaaaagctacgcccaaatgtggcagctcatgtattttcacagacgcgacctgcggcttgcggccaatgctatttgttccgccgtgcccgttaactgggtgccgacatctagaaccacgtggagcatccatgctcaccatcagtggatgacaaccgaagatatgctgtccgtctggaatcgggtgtggattgaggaaaacccttggatggaggacaagacccacgttagctcttgggaagacgtgccctacctcggcaagagagaggatcaatggtgcgggtccctgatcggacttacagcccgcgctacctgggccacaaatattcaggtcgcgatcaaccaggtgcggagactgatcggcaatgagaactatctcgactacatgacgagcatgaaacgcttcaagaatgaatctgatcccgagggggccctgtggtga

SEQ ID NO: 19349 - RNA, 9879 nt, synthetic construct
  misc_feature 1..9879: note = derived and/or modified CDS sequence (opt5) from DENV-1__JQ045628__SS-prME
  source 1..9879: mol_type = other RNA
agcgtgaccatgctgctgatgctgatgcccacagctcttgctttccacctgacgaccagaggcggggagcctcatatgattgtgtccaagcaggaacggggaaagtctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgcctttttccttgcccatgcgattgggacctctatcacccagaagggaatcatttttatcctgctcatgctggtcacacctagcatggccatgagatgcgtgggcattgggtcccgggatttcgttgagggacttagcggcgctacgtgggtggacgtcgtgctggagcacgggtcttgtgtgaccacaatggccaaggataaacccaccctcgacatcgaactgctgaagacagaggtcaccaaccctgctattctccgcaaactgtgcatcgaagccaagatttccaatacgacaaccgatagcagatgtccgacccaaggagaggcgacacttgttgaagaacaagacgccaactttgtgtgccggcgcaccttcgtggatagaggctggggcaatgggtgtggactgtttggcaaagggtctctcatcacatgcgctaagttcaagtgcgtcacgaaactggagggaaagatcgtgcagtacgaaaaccttaaatattccgttattgtgaccgtccacacaggcgaccagcatcaagtggggaatgagagcaccgaacacggaacaaccgccacgatcacaccccaagctcctaccaccgagattcagctgacagactacggcgccctcaccctggattgttctccccggacgggcctggactttaacgaaatggttctcctgacaatgaaggagaaatcctggcttgtgcataagcagtggttcctggatctccctctgccctggaccagcggggcctccacatctcaagagacctggaatcgccaggaccttctggtcacctttaaaacagctcacgcgaagaagcaggaagtggtcgtgctcggaagccaagagggcgccatgcacacggctctgaccggggccacagaaatccagacctccggaacaaccacgattttcgccggccatctgaaatgcagactcaagatggataaactgacacttaaggggatgagctatgttatgtgtaccggctctttcaaactggagaaggaagtggctgagacccagcacggaacagtcctcgtgcagatcaagtacgagggcaccgacgccccgtgcaaaatccctttttccacacaagatgaaaagggggttacgcagaacggacggctgattaccgcgaatcccatcgtgacagacaaagagaagcctgtcaacattgaagctgagccgcccttcggcgagagctatatcgtgattggggccggagaaaaagccctgaaactttcttggtttaagaaaggcagctccatcgggaagatgttcgaggctaccgccagaggcgctcgccggatggccatcctcggagatacagcgtgggactttggctctattgggggagtgttcaccagcgttggcaaactggtccatcagatctttgggacggcctacggagtgctgttctccggcgtgagctggaccatgaagattgggatcggcgtcctcctgacatggcttggactcaattctagatccaccagcctctctatgacatgtattgctgtgggcctggttaccctgtaccttggggtgatggtccaggccgattccggatgcgtgatcaactggaaaggccgcgaactcaagtgtgggagcggaatttttgttacaaatgaggtgcacacctggacggaacaatataagttccaggctgactcccctaaacggctgtctgccgcgatcggcaaggcctgggaggagggggtctgcggcatcagaagcgctacacgcctggaaaacattatgtggaaacagatctccaacgagctcaatcatattctgcttgaaaacgacatgaagtttaccgtggttgtgggagatgtcgccggcatcctggctcaggggaaaaagatgattcggccgcaacccatggagtacaaatattcttggaaaagctggggaaaggccaagatcatcggcgccgacgtgcagaataccacattcattatcgatgggcctaacacccccgaatgtcctgacgatcagagagcttggaatatttgggaggtggaggactacggatttggcatcttcacgacaaacatttggctcaagctgcgcgattcctatacccaggtctgcgaccaccggctgatgagcgcggccatcaaagattctaaggctgttcacgccgacatgggctactggatcgaatccgagaaaaatgaaacatggaaacttgccagagctagcttcattgaggtgaagacctgtatctggcccaaatctcatacactctggtccaacggggtgctggaaagcgagatgattatcccgaagatttatggaggccctatctctcaacacaattaccgccccgggtactttacccagacggccggaccttggcatctgggcaaactcgagctggatttcgacctttgcgaagggaccacagtcgtggttgatgagcactgcggaaaccggggccccagcctgagaaccacaaccgtgacgggcaagatcattcacgaatggtgttgccggtcctgtacactccctcccctgcgctttagaggggaggacggatgctggtatggcatggagatccggccggtcaaagaaaaggaggaaaatctggtcaagagcatggtttctgcggggtccggagaggtggacagcttctcccttggcctcctgtgtatttctatcatgattgaagaggtcatgagaagccgctggtcccggaaaatgctgatgaccgggacactcgctgtgtttctgcttctgatcatgggacagctcacctggaacgatctgattagactgtgcatcatggttggcgccaatgcctctgaccgcatgggcatggggaccacataccttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccatcagctttgggccacactgctcagcctgaccttcattaagacgacattttctctgcactatgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttacgttattagcggatctagcgccgacctgtccctggagaaagctgccgaggtgtcttgggaagaggaagccgagcatagcggcgcttcccacaatatcctcgtcgaagtgcaggatgacgggaccatgaagatcaaagatgaggagagagacgatacactgaccattcttctgaaggcgacactcctggccgtttctggagtgtatcctctcagcatccccgctaccctgttcgtctggtacttctggcagaagaagaagcagcggtccggcgtgctttgggacacgccttctcccccggaagtcgagcgcgccgtgctggatgacggcatttatagaatcatgcagcgggggctgctcggacgcagccaggttggcgtgggggtctttcaagaaaacgtgttccataccatgtggcacgttacaagaggagccgtgctgatgtaccagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacaacccccggcacatttaagacgctggaaggggaggtgggagcgattgctctcgatttcaagccgggcaccagcgggtctcctatcgtgaaccgcgaaggaaaaatcgtcggcctgtatggcaatggggtggttacaacctccggaacctacgtgagcgccattgcccaggctaaggcctcccaggagggcccccttcctgagatcgaagacgaggtctttcggaaaagaaacctgacaattatggatctgcaccccgggtctggaaagacgcgccggtatctccccgcgatcgtgagagaagctattaaacgcaagctgcggacccttatcctggcccctacaagagttgtggccagcgagatggctgaagccctcaagggcatgccgatccgctaccaaaccacagctgtcaaatccgagcataccgggaaggagattgtggacctgatgtgccacgccacgttcacaatgcggctgctcagccccgttagagtgcctaattataacatgatcattatggatgaagcgcattttaccgacccctcttccatcgccgctcggggctacattagcacccgcgtcggaatgggcgaggccgctgccatcttcatgacagccacccctcccgggtctgtggaggcttttcctcagagcaatgcggtgatccaggatgaagaaagagacattccggagcggtcctggaactctggatatgagtggatcacagatttccccggcaaaaccgtctggtttgttcctagcattaagtccgggaatgacatcgccaactgtcttcgcaaaaatggaaagagagtgattcagctgtctcggaagacgttcgatacagaataccagaagaccaagaacaacgactgggactacgtggtcacaaccgatatcagcgagatgggcgctaatttcagagccgaccgcgtgattgatccccggagatgcctgaaacctgttatcctcaaggacgggcccgaacgcgtgatcctggccggcccgatgcctgtcacggtggcttccgccgcgcagcggagaggacgcattggccggaaccacaataaagagggggatcagtatatctacatgggacagccccttaacaatgacgaggatcatgctcactggaccgaagccaagatgctgctcgacaacattaatacacccgagggcatcattcctgccctgtttgaacccgagagagaaaagagcgctgccatcgatggggagtatcgcctgagaggagaggcgcggaaaaccttcgttgaactcatgcgcagaggcgaccttcctgtgtggctgtcttacaaggtcgcctccgaggggtttcaatatagcgatcggcgctggtgcttcgacggcgaaagaaacaatcaggtgctggaggaaaacatggatgtcgagatctggacaaaagagggagaacggaagaaactcagaccgcgctggctggacgctcggacctactccgacccccttgccctgagagagtttaaggagttcgctgccggccgccggtctgtgagcggggatctcattctggagatcggaaaactgcctcagcacctcacacagagagctcaaaatgcccttgacaacctggttatgctgcataattccgaacagggcgggcgggcgtatcgccacgccatggaggagctccccgataccattgaaacgctgatgcttctggctctcatcgccgtgctgacaggaggcgtgaccctgtttttcctctctggcagagggcttggaaagaccagcattggcctgctgtgtgtcatcgcttccagcgttctcctgtggatggcctctgtggagcctcattggatcgccgcttccattatccttgaatttttcctgatggtgctcctgattcccgagccggaccggcagcgcacacctcaggataaccaactggcgtacgtcgtgatcgggctcctttttatgattctgaccgttgccgctaatgagatgggactgctcgaaacaacgaagaaagacctgggcatcgggcacgtggccgtcggaaaccaccatcacgccgctatgcttgatgtggacctgcatcccgccagcgcgtggaccctctacgccgtcgctacaaccattatcacacctatgatgagacacaccatcgagaacacgaccgccaatatttctctgacagctatcgccaaccaggcggccattctgatgggcctcgataagggctggcccatctccaaaatggacattggggtgcctcttctggctctgggatgctatagccaggttaatcccctcaccctgacagccgctgtgcttatgctggtcgcccattacgctatcatcggcccggggctccaagccaaggcgacccgggaagcccagaaacgcacggctgccggaattatgaagaaccctacagtggatggcatcgttgctattgacctggatcccgtggtctatgacgccaagttcgagaaacagctggggcagatcatgctccttattctgtgtacctctcaaatcctgctcatgagaacaacctgggccctgtgcgaaagcatcacccttgcgacaggacccctgacgaccctctgggagggctcccctggcaagttttggaatacaaccattgctgtgtctatggccaacatcttccgggggagctacctggctggagccggcctggccttctccctcatgaaaagccttgggggaggccgcagagggacaggagctcagggcgagaccctgggcgaaaagtggaaacggcagctgaatcagctctccaagtctgagtttaacacgtataagagaagcgggattatggaagtggaccgctccgaggccaaagaaggactgaagcggggcgagacaaccaaacacgcggtttctagagggaccgccaaacttcgctggttcgtcgagcggaatctggtgaaaccggaaggaaaggtgatcgatctcggctgtgggagaggaggctggagctactattgcgctggcctgaagaaagtcacagaggttaaggggtacaccaaaggaggccccgggcacgaggaacctattcccatggccacatacggatggaacctggtgaagctccattccggcaaagacgtgtttttcatccctcccgaaaagtgtgatacgcttctgtgcgacattggggagtctagccctaatccgaccatcgaggaaggacgcacactgcgggtcctcaaaatggtggagccctggctgagaggcaaccaattttgtatcaagattcttaatccttatatgccctccgttgtggaaaccctggagcagatgcagcgcaagcacggcgggatgctcgtccggaaccctctgagcagaaattctacacatgagatgtactgggtgtcctgcggaaccggcaacatcgttagcgctgtgaatatgacgtctcgcatgctgctcaaccggttcaccatggcccacagaaaacccacatatgaacgcgatgtcgacctgggggcgggaaccagacacgtggccgtggagccggaagtcgctaaccttgatattatcggccagcggattgagaatatcaagcatgaacacaaatccacatggcattacgacgaggataacccttataagacctgggcctaccacgggagctatgaggttaaaccctctggatccgctagctccatggtgaatggcgtggtcaagctgctcacaaagccctgggacgtgatccctatggttacccaaattgccatgacggatacaaccccctttggccagcagcgcgtgttcaaagaaaaggtcgacaccagaacacctaaagctaagcgggggacggcccaaatcatggaggtgaccgcgaaatggctgtggggatttcttagcagaaacaagaagccgcggatttgtacacgcgaagagttcaccagaaaagttcggtctaatgccgctatcggcgccgtgtttgtcgacgaaaaccagtggaatagcgctaaggaggccgtggaggatgaacgcttctgggacctggttcatagagagcgggaactccacaaacaggggaagtgcgccacatgcgtgtacaacatgatgggaaaacgcgagaagaagctgggcgaatttgggaaagcgaagggctccagagctatttggtacatgtggctgggagcccggttcctcgagttcgaggccctgggctttatgaatgaagatcactggttctctcgcgagaacagcctttccggggtcgaaggagagggcctgcataaactcgggtatatcctgagagacatctctaagattcccggaggcaatatgtacgctgatgacaccgccgggtgggatacacggatcaccgaggacgatcttcagaacgaagctcgcattacggacatcatggagcctgaacacgccctgctcgcgaaaagcatttttaagctgacctatcaaaataaagtggtcagagtgcagcggcccgccaagaacggcacagttatggatgtgatctcccgcagagaccagcggggatctggccaggtcgggacctacggactgaatacattcaccaacatggaggctcaactcatcagacagatggaaagcgagggcatcttttcccctagcgagctggaaacgcccaaccttgccgagcgcgtgctggattggctcgaaaagtatggggtggagcggctgaaaagaatggctatctctggagacgactgtgttgtgaagccgattgatgaccgcttcgccacagcgcttaccgccctgaatgatatgggcaaagtccggaaggacatccctcagtgggaaccctccaaagggtggaacgattggcagcaagtgcctttttgcagccatcacttccaccagctcattatgaaggacggcagagagatcgttgtgccctgtcgcaatcaggatgagctggtcggacgggctagagtgtctcagggcgccgggtggtccctgcgcgaaacagcttgcctcggaaagagctacgcccaaatgtggcagctgatgtattttcatcggagagaccttcgcctggctgccaacgcgatttgttccgccgtccctgtggattggatccccacctctcggacgacctggagcatccacgctcatcaccagtggatgacaaccgaggacatgctctccgtttggaatagagtgtggattgaagagaacccgtggatggaagataaaacacatatcagctcttggggcgacgtcccttacctggggaagcgggaggaccaatggtgcggatcccttattggcctgaccgccagagccacatgggctaccaatatccaggtggccattaaccaggttcgccggctcatcgggaatgagaactacctggattatatgacgagcatgaaaagattcaagaatgaatctgaccccgagggcgcgctgtggtga

SEQ ID NO: 19350 - RNA, 9879 nt, synthetic construct
  misc_feature 1..9879: note = derived and/or modified CDS sequence (opt5) from DENV-1__JQ045629__SS-prME
  source 1..9879: mol_type = other RNA
agcgtgaccatgctgctcatgctgatgcccacagcccttgctttccacctgacgaccagaggcggggaacctcatatgatggtgtccaagcaggaacgggggaaatctctcctgtttaagacaagcgccggcgttaacatgtgcacccttattgcgatggacctgggggagctctgtgaagatacaatgacctacaaatgcccccgcattacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagatccagcgggttgaaacctgggccctgcgccaccccggcttcacagtgattgctctttttctggcccatgcgatcgggacctctattacccagaagggaatcatcttcattctcctgatgcttgtcacacctagcatggccatgagatgcgtgggcatcgggtcccgggattttgttgagggactgagcggcgctacgtgggtggacgtcgtgctcgagcacgggtcttgtgtgaccacaatggccaaggataaacccaccctggacattgaactgctcaagacagaggtcaccaaccctgctgttctgcgcaaactttgcatcgaagccaagatttccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgatcacatgcgctaagtttaagtgcgtgacgaaacttgagggaaagattgttcagtacgaaaacctgaaatattccgtgatcgtcaccgtgcacacaggcgaccagcatcaagttgggaatgagagcaccgaacacggaacaaccgccacgatcacaccccaagctcctaccaccgagattcagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaatccagacctccggaacaaccacgatttttgccggccatctcaaatgcagactgaagatggataaacttacactgaaggggatgagctatgtgatgtgtaccggctctttcaaactcgagaaggaactggctgagacccagcacggaacagtcctggtgcagatcaagtacgagggcaccgacgccccgtgcaaaattcctttctccacacaagatgaaaagggggttacgcagaacggacggcttatcaccgcgaatcccatcgtgacagacaaagagaagcctgtcaacattgaagctgagccgccctttggcgagagctatatcgtgattggggccggagaaaaagccctcaagctgtcttggttcaagaaaggcagctccatcgggaagatgtttgaggctaccgccagaggcgctcgccggatggccattctgggagatacagcgtgggacttcggctctatcgggggagtgtttaccagcgttggcaaactcgtccatcagatcttcgggacggcctacggagtgctgttttccggcgtgagctggaccatgaagattgggatcggcgtccttctgacatggctcggactcaattctagatccaccagcctgtctatgacatgtattgctgtgggccttgttaccctctacctgggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctctctgccgcgatcggcaaggcctgggaggagggggtctgcggcattagaagcgctacacgcctggaaaacatcatgtggaaacagatctccaacgagcttaatcatattctgctcgaaaacgacatgaagttcaccgtggttgtgggagatgtcgccggcatcctggctcaggggaaaaagatgattcggccgcaacccatggagtacaaatattcttggaaaagctggggaaaggccaagatcattggcgccgacgtgcagaataccacatttatcatcgatgggcctaacacccccgaatgtcctgacgatcagagagcttggaatatttgggaggtggaggactacggattcggcatctttacgacaaacatttggctgaaacttcgcgattcccacacccaggtctgcgaccaccggctcatgagcgcggccatcaaagattctaaggctgttcatgccgacatgggctattggattgaatccgagaaaaatgaaacatggaagctggccagagctagcttcatcgaggtgaagacctgtatctggcccaaatctcacacactgtggtccaacggggtgctcgaaagcgagatgattatcccgaagatttacggaggccctatctctcaacataattatcgccccgggtacttcacccagacggccggaccttggcacctgggcaaacttgagctggattttgacctctgcgaagggaccacagtcgtggttgatgagcactgcggaaaccggggccccagcctgagaaccacaaccgtgacgggcaagattatccatgaatggtgttgccggtcctgtacactgcctccccttcgcttcagaggggaggacggatgctggtacggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgaccgggacacttgctgtgttctttctgctcatcatgggacagctgacctggaacgatctgattagactttgcatcatggttggcgccaatgcctctgaccgcatgggcatggggaccacatatctggctctcatggccacgttcaagatgagacctatgtttgcggtgggactgctgttccggcgcctgaccagcagagaggtccttctgctcacaattggcctgtccctggtggcttctgtggaacttcccaacagcctggaggaactcggggatggactggccatgggcatcatgatcctcaaactgcttaccgactttcaatcccaccagctgtgggccacactcctgagcctgaccttcattaagacgacattttctcttcattacgcttggaaaaccatggccatggtcctgtccatcgttagcctcttccccctgtgtctctctaccacatcccagaagaccacatggctgcctgtgcttctggggagcctgggatgcaagccgctcacgatgtttctgattgctgagaataaaatctggggccggcgctcttggccccttaacgaaggcattatggccgtggggatcgtctccatcctgctcagctccctgctcaagaacgatgtgcctctggcgggaccccttattgccggcgggatgctgatcgcttgttatgttattagcggatctagcgccgacctgtccctcgagaaagctgccgaggtgtcttgggaagaggaagccgagcacagcggcgcttcccataatatcctggtcgaagtgcaggatgacgggaccatgaagattaaagatgaggagagagacgatacacttaccatcctgctcaaggcgacactgctcgccgtttctggagtgtaccctctgagcatccccgctacccttttcgtctggtatttctggcagaagaagaagcagcggtccggcgtgctgtgggacacgccttctcccccggaagtcgagcgcgccgtgctggatgacggcatttacagaatcatgcagcgggggctcctgggacgcagccaggttggcgtgggggtctttcaagaaaacgtgttccacaccatgtggcacgttacaagaggagccgtgcttatgtatcagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacagcgcccggcacctttaagacaccggaaggggaggtgggagctattgccctcgatttcaagcctggcacgagcgggtctcccatcgtgaaccgcgaaggaaaaattgtcggcctgtacggcaatggggtggttaccacatccggaacctatgtgagcgccatcgctcaggccaaggcgtcccaggagggccctcttcccgagatcgaagacgaggtctttcggaaaagaaacctgaccattatggatctgcatcccgggtctggaaagacacgccggtacctccctgctatcgtgagagaagccattaaacgcaagctgcggacgcttatcctggccccgaccagagttgtggctagcgagatggccgaagctctcaagggcatgcccattcgctatcaaacaaccgccgtcaaatccgagcacacagggaaggagatcgtggacctgatgtgccatgcgaccttcacgatgcggctgctcagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgattcaggatgaggaaagagacatccccgagcggtcctggaactctggatacgagtggatcaccgatttccctggcaaaacagtctggtttgttcccagcattaagtccgggaatgacatcgctaactgtcttcgcaaaaatggaaagagagtgattcagctgtctcggaagaccttcgatacggaatatcagaagaccaagaacaacgactgggactacgtggtcaccacagatatcagcgagatgggcgccaatttcagagccgaccgcgtgattgatcctcggagatgcctgaaacccgttatcctcaaggacgggccggaacgcgtgattctggctggccctatgcccgtcaccgtggcctccgcggctcagcggagaggacgcatcggccggaaccataataaagagggggatcagtacatctatatgggacagccccttaacaatgacgaggatcacgcccactggacggaagccaagatgctgctcgacaacattaatacccctgagggcatcattcccgctctgtttgaacctgagagagaaaagagcgccgcgatcgatggggagtaccgcctgagaggagaggcccggaaaacattcgttgaactcatgcgcagaggcgaccttccggtgtggctgtcttataaggtcgcttccgaggggtttcaatacagcgatcggcgctggtgcttcgacggcgaaagaaacaatcaggtgctggaggaaaacatggatgtcgagatttggaccaaagagggagaacggaagaaactcagaccccgctggctggacgcccggacatattccgaccctcttgctctgagagagtttaaggagttcgccgctggccgccggtctgtgagcggggatctcatcctggagatcggaaaactgccccagcatctcacccagagagcccaaaatgcgcttgacaacctggttatgctgcacaattccgaacagggcgggcgggcctaccgccatgctatggaggagctccctgatacaattgaaaccctgatgcttctggccctcatcgctgtgctgacgggaggcgtgacactgtttttcctctctggcagagggcttggaaagaccagcattggcctgctgtgtgtcatggcctccagcgttctcctgtggatggcctctgtggagccccactggatcgctgcgtccattatccttgaatttttcctgatggtgctcctgatcccggagcctgaccggcagcgcacaccccaggataaccaactggcctatgtcgtgattgggctcctttttatgatcctgacagttgctgccaatgagatgggactgctcgaaaccacaaagaaagacctgggcattgggcacgtggccgtcgagaaccatcaccatgctgccatgcttgatgtggacctgcaccctgcgagcgcctggacgctctacgctgtcgccaccacaatcattacccccatgatgagacatacaatcgaaaacaccacggctaatatttctctgaccgccatcgcgaaccaggccgctatcctgatgggactcgataagggctggcctatttccaaaatggacatcggcgtgccccttctggccctggggtgctacagccaggttaatccgctcacactgaccgctgccgtgcttatgctggtcgctcactatgccattatcggacctggcctccaagcgaaggccacacgggaggctcagaaacgcaccgccgctgggattatgaagaaccccacggtggatggaatcgttgccatcgacctggatcccgtggtctacgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaattgccgtgtctatggctaacatcttccggggcagctatctggccggggccggactggctttctccctcatgaaaagccttggcgggggacgcagaggcaccggggcccagggagaaacactgggcgagaagtggaaacggcagctgaatcagctctccaagtctgaatttaacacctacaagagaagcggcatcatggaggtggaccgctccgaagcgaaagaggggctgaagcggggagagacgacaaaacacgccgtttctagaggcaccgctaaacttcgctggttcgtcgaacggaatctggtgaaacccgaggggaaggtgattgatctcggatgtggcagagggggatggagctattactgcgccggcctgaagaaagtcaccgaagttaagggctatacaaaagggggacctggccatgaggaacccatccctatggctacctacgggtggaacctggtgaagctccactccggaaaagacgtgtttttcattccccctgagaagtgtgatacacttctgtgcgacatcggcgagtctagcccgaatcccacgattgaagaggggcgcaccctgcgggtcctcaaaatggtggaaccttggctgagaggaaaccaattttgtatcaagattcttaatccctacatgccttccgttgtggagacactggagcagatgcagcgcaagcatggcggcatgctcgtccggaaccccctgagcagaaattctacccacgaaatgtattgggtgtcctgcgggacaggaaacatcgttagcgccgtgaatatgacctctcgcatgctgctcaaccggttcacgatggcgcacagaaaaccgacctacgagcgcgatgtcgacctgggcgccgggacaagacatgtggctgtggaacctgaggtcgccaaccttgatatcattggacagcggatcgaaaatattaagcacgagcataaatccacctggcactatgacgaggataacccctacaagacatgggcttatcatggcagctacgaagttaaaccctctgggtccgccagctccatggtgaatggagtggtcaagctgctcaccaagccttgggacgtgatccccatggttacacaaattgctatgaccgatacgacaccttttggccagcagcgcgtgttcaaagagaaggtcgacaccagaaccccgaaagccaagcggggcacagcgcaaatcatggaagtgacggccaaatggctgtgggggtttcttagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggacctggttcacagagaacgggagctccacaaacagggcaagtgcgcgacctgcgtgtataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgtcgagggggagggactgcacaaactcggctacattctgagagacatctctaagattcctgggggaaatatgtatgccgatgacacagctggctgggatacccggatcacagaagacgatcttcagaacgaggcccgcatcaccgacattatggaacccgagcatgcgctgctcgccaaaagcatctttaagctgacgtaccaaaataaagtggtcagagtgcagcggcctgctaagaacgggaccgttatggatgtgatttcccgcagagaccagcggggctctggacaggtcggcacatatgggctgaataccttcacaaacatggaagcccaactcatcagacagatggagagcgagggaatcttttcccccagcgaactggagaccccgaaccttgctgaacgcgtgctggattggctcgagaagtacggcgtggaacggctgaaaagaatggccatctctggggacgactgtgttgtgaagcctatcgatgaccgcttcgcgacggcccttacagctctgaatgatatgggaaaagtccggaaggacattccccagtgggagccttccaaaggctggaacgattggcagcaagtgcccttttgcagccaccacttccatcagctcatcatgaaggacgggagagagattgttgtgccttgtcgcaatcaggatgaactggtcggccgggccagagtgtctcagggagctggctggtccctgcgcgagaccgcctgcctcggaaagagctatgctcaaatgtggcagctgatgtactttcaccggagagaccttcgcctggccgcgaacgccatctgttccgctgtccccgtggattggattccgacatctcggaccacgtggagcatccatgcccaccatcagtggatgaccacagaagacatgctctccgtttggaatagagtgtggattgaggaaaacccttggatggaggataaaacccacatcagctcttggggagacgtcccctatctgggcaagcgggaggaccaatggtgcgggtcccttatcggactgacagccagagctacctgggccacaaatattcaggtggcgatcaaccaggttcgccggctcattggcaatgaaaactacctggattacatgaccagcatgaaaagattcaagaatgagtctgaccccgaaggggctctgtggtga

SEQ ID NO: 19351 - RNA, 9879 nt, synthetic construct
  misc_feature 1..9879: note = derived and/or modified CDS sequence (opt5) from DENV-1__JQ045630__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccgtttctggagtgtatcctctgagcatccccgctaccctttttgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtcttccaagaaaacgtgtttcataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacaacccccggcacattcaagacgccggaaggggaggtgggagcgattgctctcgattttaagcctggcaccagcgggtctcccatcgtgaaccgcgaaggaaaaatcgtcggcctgtatggcaatggggtggttacaacctccggaacctacgtgagcgccattgcccaggctaaggcctcccaggagggccctcttcccgagatcgaagacgaggtcttccggaaaagaaacctgacaattatggatctgcaccccgggtctggaaagacgcgccggtatctccctgcgatcgtgagagaagctattaaacgcaagctgcggacccttatcctggccccgacaagagttgtggccagcgagatggctgaagccctcaagggcatgcccatccgctaccaaaccacagctgtcaaatccgagcataccgggaaggagattgtggacctgatgtgccacgccacgtttacaatgcggctgctcagccctgttagagtgcccaattataacatgatcattatggatgaagcgcatttcaccgacccttcttccatcgccgctcggggctacattagcacccgcgtcggaatgggcgaggccgctgccatctttatgacagccacaccccctgggtctgtggaggctttcccgcagagcaatgcggtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacgtttgatacagaataccagaaaaccaagaacaacgactgggactacgtggtcacaaccgatatcagcgagatgggcgctaatttcagagccgaccgcgtgattgatcctcggagatgcctgaaacccgttatcctcaaggacgggccggaacgcgtgatcctggccggccctatgcccgtcacggtggcttccgccgcgcagcggagaggacgcattggccggaaccacaataaagagggggatcagtatatctacatgggacagccccttaacaatgacgaggatcatgctcactggaccgaagccaagatgctgctcgacaacattaatacacctgagggcatcattcccgccctgttcgaacctgagagagaaaagagcgctgccatcgatggggagtatcgcctgagaggagaggcgcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagctcaaaatgcccttgacaacctggttatgctgcataattccgaacagggcgggcgggcgtatcgccacgccatggaggagctccctgataccattgaaacgctgatgcttctggctctcatcgccgtgctgacaggaggcgtgaccctgttctttctctctggcagagggcttggaaagaccagcattggcctgctgtgtgtcatcgcttccagcgttctcctgtggatggcctctgtggagccccattggatcgccgcttccattatccttgagttctttctgatggtgctcctgattccggagcctgaccggcagcgcacaccccaggataaccaactggcgtacgtcgtgatcgggctccttttcatgattctgaccgttgccgctaatgagatgggactgctcgaaacaacgaagaaagacctgggcatcgggcacgtggccgtcggaaaccaccatcacgccgctatgcttgatgtggacctgcatcctgccagcgcgtggaccctctacgccgtcgctacaaccattatcacacccatgatgagacacaccatcgagaacacgaccgccaatatttctctgacagctatcgccaaccaggcggccattctgatgggcctcgataagggctggcctatctccaaaatggacattggggtgccccttctggctctgggatgctatagccaggttaatccgctcaccctgacagccgctgtgcttatgctggtcgcccattacgctatcatcggccctgggctccaagccaaggcgacccgggaagcccagaaacgcacggctgccggaattatgaagaaccccacagtggatggcatcgttgctattgacctggatcccgtggtctatgacgccaagtttgagaaacagctggggcagatcatgctccttattctgtgtacctctcaaatcctgctcatgagaacaacctgggccctgtgcgaaagcatcacccttgcgacaggacctctgacgaccctctgggagggctccccgggcaagttctggaatacaaccattgctgtgtctatggccaacatctttcgggggagctacctggctggagccggcctggccttctccctcatgaaaagccttgggggaggccgcagagggacaggagctcagggcgagaccctgggcgaaaagtggaaacggcagctgaatcagctctccaagtctgagttcaacacgtataagagaagcgggattatggaagtggaccgctccgaggccaaagaaggactgaagcggggcgagacaaccaaacacgcggtttctagagggaccgccaaacttcgctggtttgtcgagcggaatctggtgaaacccgaaggaaaggtgatcgatctcggctgtgggagaggaggctggagctactattgcgctggcctgaagaaagtcacagaggttaaggggtacaccaaaggaggccctgggcacgaagaacccattcctatggccacatacggatggaacctggtgaagctccattccggcaaagacgtgttctttattccccctgaaaagtgtgatacgcttctgtgcgacattggggagtctagcccgaatcccaccatcgaggaaggacgcacactgcgggtcctcaaaatggtggagccttggctgagaggcaaccaattctgtatcaagattcttaatccctatatgccttccgttgtggaaaccctggagcagatgcagcgcaagcacggcgggatgctcgtccggaaccccctgagcagaaattctacacatgagatgtactgggtgtcctgcggaaccggcaacatcgttagcgctgtgaatatgacgtctcgcatgctgctcaaccggtttaccatggcccacagaaaaccgacatatgaacgcgatgtcgacctgggggcgggaaccagacacgtggccgtggagcctgaagtcgctaaccttgatattatcggccagcggattgagaatatcaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaattgccatgacggatacaacccctttcggccagcagcgcgtgtttaaagaaaaggtcgacaccagaacaccgaaagctaagcgggggacggcccaaatcatggaggtgaccgcgaaatggctgtggggattccttagcagaaacaagaagccccggatttgtacacgcgaagagtttaccagaaaagttcggtctaatgccgctatcggcgccgtgttcgtcgacgaaaaccagtggaatagcgctaaggaggccgtggaggatgaacgcttttgggacctggttcatagagagcgggaactccacaaacaggggaagtgcgccacatgcgtgtacaacatgatgggaaaacgcgagaagaagctgggcgagttcgggaaagcgaagggctccagagctatttggtacatgtggctgggagcccggtttctcgagttcgaggccctgggcttcatgaatgaagatcactggttttctcgcgagaacagcctttccggggtcgaaggagagggcctgcataaactcgggtatatcctgagagacatctctaagattcctggaggcaatatgtacgctgatgacaccgccgggtgggatacacggatcaccgaggacgatcttcagaacgaagctcgcattacggacatcatggagcccgaacacgccctgctcgcgaaaagcattttcaagctgacctatcaaaataaagtggtcagagtgcagcggcctgccaagaacggcacagttatggatgtgatctcccgcagagaccagcggggatctggccaggtcgggacctacggactgaatacatttaccaacatggaggctcaactcatcagacagatggaaagcgagggcattttctcccccagcgagctggaaacgccgaaccttgccgagcgcgtgctggattggctcgaaaagtatggggtggagcggctgaaaagaatggctatctctggagacgactgtgttgtgaagcctattgatgaccgctttgccacagcgcttaccgccctgaatgatatgggcaaagtccggaaggacatcccccagtgggaaccttccaaagggtggaacgattggcagcaagtgcccttctgcagccatcactttcaccagctcattatgaaggacggcagagagatcgttgtgccttgtcgcaatcaggatgagctggtcggacgggctagagtgtctcagggcgccgggtggtccctgcgcgaaacagcttgcctcggaaagagctacgcccaaatgtggcagctgatgtatttccatcggagagaccttcgcctggctgccaacgcgatttgttccgccgtccccgtggattggatcccgacctctcggacgacctggagcatccacgctcatcaccagtggatgacaaccgaggacatgctctccgtttggaatagagtgtggattgaagagaacccttggatggaagataaaacacatatcagctcttggggcgacgtcccctacctggggaagcgggaggaccaatggtgcggatcccttattggcctgaccgccagagccacatgggctaccaatatccaggtggccattaaccaggttcgccggctcatcgggaatgagaactacctggattatatgacgagcatgaaaagatttaagaatgaatctgaccccgagggcgcgctgtggtga

SEQ ID NO: 19352 - RNA, 9879 nt, synthetic construct
  misc_feature 1..9879: note = derived and/or modified CDS sequence (opt5) from DENV-1__JQ045632__SS-prME
  source 1..9879: mol_type = other RNA
tccgtgaccatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttatcgcgatggacctgggggagctctgtgaagatacaatgacctacaaatgcccgagaatcacagagaccgaacccgacgatgtggactgttggtgcaatgctacggatacctgggtgacatatggaacctgttcccaaacaggcgagcaccggcgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttccttacacaagatgaaaagggggttacgcagaacggacggctcatcaccgcgaatcccattgtgacagacaaagagaagcctgtcaacatcgaagctgagccgccctttggcgagtcctatattgtgatcggggccggagaaaaagccctgaagctgagctggttcaagaaaggctctagcattgggaagatgtttgaggctaccgccagaggcgctcgccggatggccatcctcggagatacagcgtgggacttcggctccatcgggggagtgtttacctctattggcaaactggttcatcagatcttcgggacggcctacggagtcctttttagcggcgtgtcctggaccatgaagattgggatcggcgtgctgctcacatggctgggactgaatagcagatctacctcccttagcatgacatgtattgctgtcggcctcgtgaccctgtacctgggggttatggtgcaggccgattctggatgcgtcatcaactggaaaggccgcgaactcaagtgtgggtccggaattttcgtgacaaatgaggttcacacctggacggaacaatataagtttcaggctgacagccctaaacggctgtccgccgcgatcggcaaggcctgggaggagggggtgtgcggcatcagatctgctacacgccttgaaaacattatgtggaaacagatcagcaacgagctgaatcatattctcctggaaaacgacatgaagttcaccgtcgtggttggagatgtggccggcatcctggctcaggggaaaaagatgattcggccgcaacccatggagcacaaatactcctggaagtcttggggaaaggccaaaatcatcggcgccgacgtccagaataccacatttattatcgatgggcctaacacccccgaatgtcctgacgatcagagagcttggaatatttgggaggtggaggactatggattcggcatctttacgacaaacatttggcttaagctccgcgatagctacacccaggtgtgcgaccaccggctgatgtccgcggccatcaaagatagcaaggctgtccatgccgacatgggctattggatcgaatctgagaaaaatgaaacatggaagctggccagagcttccttcattgaggttaagacctgtatctggcccaaaagccacacactctggtctaacggggtgctggaatccgagatgattatcccgaagatttacggaggccctatcagccaacataattatcgccccgggtacttcacccagacggccggaccttggcaccttggcaaactggagctcgattttgacctgtgcgaagggaccacagtggtcgtggatgagcactgcggaaaccggggcccctctctgagaaccacaaccgttacgggcaagatcattcatgaatggtgttgccggagctgtacacttcctcccctccgcttcagaggggaggacggatgctggtacggcatggagatccggccggtgaaagaaaaggaggaaaatctggtcaagtccatggtgagcgcggggtctggagaggttgactcctttagcctgggcctcctgtgtatttccatcatgattgaagaggtgatgagatctcgctggagccggaaaatgcttatgaccgggacactggctgtcttctttctcctgatcatgggacagctgacctggaacgatcttattagactgtgcatcatggtgggcgccaatgcctccgaccgcatgggcatggggaccacatatctcgctctgatggccacgttcaagatgagacctatgtttgcggttggactcctgttccggcgccttacctctagagaggtgctgctcctgacaatcggcctgagccttgtcgcttccgtggaactgcccaactctctcgaggaactgggggatggactcgccatgggcattatgatcctgaaacttctgaccgactttcaaagccaccagctctgggccacactgctgtcccttaccttcattaagacgacatttagcctgcattacgcttggaaaaccatggccatggtgctctctatcgtctccctgttccccctctgtctgagcaccacatctcagaagaccacatggcttcctgttctgctggggtccctcggatgcaagccgctgacgatgtttcttattgctgagaataaaatctggggccggcgcagctggcccctgaacgaaggcatcatggccgtggggattgtgtctatcctcctgtccagcctcctgaagaacgatgtccctcttgcgggacccctgattgccggcgggatgctgatcgcttgttatgtgatttccggaagctctgccgacctcagcctggagaaagctgccgaggtttcctgggaagaggaagccgagcactctggcgctagccataatatccttgtggaagtccaggatgacgggaccatgaagatcaaagatgaggagagagacgatacactgaccattctcctgaaggcgacactcctggccgtgtccggagtttaccctctttctatccccgctaccctgttcgtgtggtatttctggcagaagaagaagcagcggagcggcgtcctgtgggacacgcctagccctcccgaagtggagcgcgccgtcctcgatgacggcatttacagaatcatgcagcgggggctgcttggacgctctcaggtgggcgttggggtgtttcaagaaaacgtcttccacaccatgtggcacgtgacaagaggagccgttctgatgtatcagggcaaacggctcgagcccagctgggcttccgtgaagaaagacctgattagctacgggggaggctggagactccagggctcttggaataccggggaggaagtccaggtgatcgccgtggagcccggaaagaaccctaaaaatgttcaaacagcgcccggcacctttaagacaccggaaggggaggtcggagctattgccctggatttcaagcctggcacgtccgggagccccatcgtgaaccgcgaaggaaaaatcgtgggcctttacggcaatggggtcgtgaccacatctggaacctatgtttccgccattgctcaggccaaggcgagccaggagggccctctgcccgagatcgaagacgaggtgtttcggaaaagaaacctgaccattatggatctccatcccgggtccggaaagacacgccggtacctgcctgctatcgtcagagaagccattaaacgcaaacttcggacgctgatcctcgccccgaccagagtggttgcttctgagatggccgaagctctgaagggcatgcccatccgctatcaaacaaccgccgtgaaaagcgagcacacagggaaggagattgtcgacctgatgtgccatgcgaccttcacgatgcggctcctttcccctgtgagagttcccaattacaacatgatcattatggatgaagcccactttacagaccctagctctatcgctgcccggggctatatttccacccgcgtgggaatgggcgaggctgccgccatcttcatgaccgctacaccccctgggagcgtcgaagcgtttccgcagtctaatgccgtgatccaggatgaggaaagagacattcccgagcggagctggaactccggatacgagtggatcaccgatttccctggcaaaacagtgtggtttgtcccctctattaagagcgggaatgacatcgctaactgtctgaaaaagaatggaaagcgcgttattcagctgtccagaaaaaccttcgatacggaatatcaaaagaccaagaataacgactgggactacgtggtgaccacagatatctctgagatgggcgccaatttccgggccgacagagtcattgatcctcgccggtgcctcaagcccgtgatcctgaaagacgggccggaaagagttatccttgctggccctatgcccgtgaccgtcgccagcgcggctcagcgccggggaagaattggccgcaaccataataaggagggggatcagtacatctatatgggacagcccctgaacaatgacgaggatcacgcccactggacggaagccaagatgctcctggacaacattaatacccctgagggcatcattcccgctctgtttgaacctgagcgggaaaaatccgccgcgatcgatggggagtacagactccgcggagaggccagaaagacattcgtggaacttatgcggcgcggcgacctgccggtttggctgagctataaagtggcttctgaggggtttcaatactccgatagacggtggtgcttcgacggcgaacgcaacaatcaggtcctcgaggaaaacatggatgtggagatctggaccaaggagggagaacgcaaaaagctgcggcccagatggcttgacgcccgcacatatagcgaccctctggctctccgggagtttaaagagttcgccgctggcagacgctccgtctctggggatctgattctggagatcggaaagctcccccagcatcttacccagcgggcccaaaatgcgctggacaacctggtgatgctccacaatagcgaacagggcgggagagcctaccggcatgctatggaggagctgcctgatacaattgaaacccttatcctgctcgccctgattgctgttctgacgggaggcgtgacactctttttcctttccggccgcgggctgggaaagacctctatcggcctgctctgtgtgatggccagctccgtcctgctttggatggccagcgttgagccccactggatcgctgcgtctattatcctggaatttttcctcatggtgctgctgattccggagcctgacagacagcggacaccccaggataaccaactcgcctatgtggtcatcgggcttctgtttatgattctgacagtggctgccaatgagatgggactcctggaaaccaccaaaaaggaccttggcatcgggcacgttgccgtggagaaccatcaccatgctgccatgctggatgtcgacctccaccctgcgtccgcctggacgctgtacgctgtggccaccacaattatcacccccatgatgcgccatacaatcgaaaacaccacggctaatattagcctgaccgccatcgcgaaccaggccgctattctcatgggacttgataaaggctggcctatctctaagatggacattggcgtccccctgctggccctcgggtgctactcccaggtgaatccgctgacacttaccgctgccgttctgatgctcgtggctcactatgccatcatcggacctggcctgcaagcgaaagccacaagagaggctcagaagcggaccgccgctgggattatgaagaaccccacggtcgatggaatcgtggccattgacctggatcccgttgtgtacgacgccaaattcgaaaagcagctcggccagatcatgcttctgattctgtgtacaagccaaatcctcctgatgcgcaccacatgggcgctttgcgagtctatcaccctggctaccgggcctctcacaacgctgtgggagggaagcccgggcaaattttggaataccacaattgccgtctccatggctaacatcttcagaggctcttatctggccggggccggactcgctttcagccttatgaagtccctgggcgggggacggcgcggcaccggggcccagggagaaacactgggcgagaaatggaagagacagctcaatcagctgagcaagtccgaatttaacacctacaaacggtctggcattatggaggtggacagaagcgaagcgaaggaggggcttaaacgcggagagacgacaaagcacgccgtgtcccggggcaccgctaaactgagatggttcgttgaacgcaatctcgtcaagcccgaggggaaggtgatcgatctgggatgtggcagagggggatggtcttattactgcgccggcctgaaaaaggtgaccgaagtcaaaggctatacaaaagggggacctggccatgaggaacccattcctatggctacctacgggtggaacctcgttaaacttcacagcggaaaggacgtgtttttcattccccctgagaaatgtgatacactgctgtgcgacattggcgagtcctctccgaatcccacgatcgaagaggggagaaccctccgcgtgctgaagatggtcgaaccttggcttcggggaaaccaattttgtatcaaggtgctgaatccctacatgcctagcgttgtggagacactcgagcagatgcagagaaaacatggcggcatgctggtccgcaaccccctgtcccggaatagcacccacgaaatgtattgggtgtcttgcgggacaggaaacattgtttccgccgtgaatatgaccagcagaatgctcctgaaccgcttcacgatggcgcaccggaagccgacctacgagagagatgtcgaccttggcgccgggacacgccatgtggctgtggaacctgaggtcgccaacctggatatcattggacagagaatcgaaaatattaaacacgagcataagtctacctggcactatgacgaggataacccctacaaaacatgggcttatcatggctcctacgaagttaagcccagcgggtctgcctccagcatggtgaatggagtggtcaagctcctgaccaaaccttgggacgtgatccccatggttacacaaatcgctatgaccgatacgacaccttttggccagcagcgggtgttcaaggagaaagtcgacacccgcaccccgaaggccaaaagaggcacagcgcaaattatggaagtgacggccaagtggctttgggggtttctgtcccggaacaagaaacccagaatctgtacccgggaggagttcacacgcaaggttagaagcaatgctgccattggagctgtgtttgtcgacgagaaccagtggaactctgccaaagaggccgtggaagatgagcggttctgggacctcgttcaccgcgaaagagagctgcacaagcagggcaaatgcgcgacctgcgtgtataacatgatggggaagcgggaaaagaaactgggagagtttggcaaggctaaagggagccgcgccatctggtacatgtggctcggcgccagattcctggagttcgaagctcttggatttatgaatgaggatcattggttctcccgggaaaactctctgagcggcgtcgagggggagggactccacaagctgggctacattcttcgcgacatctccaaaatccctgggggaaatatgtatgccgatgacacagctggctgggataccagaattacagaagacgatctgcagaacgaggcccggatcaccgacattatggaacccgagcatgcgctcctggccaagtctatctttaaactgacgtaccaaaataaggtggtccgcgtgcagagacctgctaagaacgggaccgttatggatgtgattagccggcgcgaccagagaggctccggacaggtcggcacatatgggctcaataccttcacaaacatggaagcccaactgatccggcagatggagtctgagggaatctttagcccctccgaacttgagaccccgaacctggctgaaagagtgctcgattggctggagaaatacggcgtggaacgccttaagcggatggccattagcggggacgactgtgttgtgaaacctatcgatgacagattcgcgacggccctgacagctctcaatgatatgggaaaggtccgcaaagacattccccagtgggagccttctaagggctggaacgattggcagcaagtgcccttttgctcccaccacttccatcagctgatcatgaaggacgggcgggagattgttgtgccttgtagaaatcaggatgaactggtcggccgcgcccgggtgagccagggagctggctggtctctcagagagaccgcctgcctggggaaatcctatgctcaaatgtggcagcttatgtactttcaccgccgggacctgagactcgccgcgaacgccatctgtagcgctgtccccgtggattggattccgacatcccgcaccacgtggtctatccatgcccaccatcagtggatgaccacagaagacatgctgagcgtttggaatcgggtgtggatcgaggaaaacccttggatggaggataagacccacatttccagctggggagacgtcccctatcttggcaaaagagaggaccaatggtgcgggtctctgatcggactcacagcccgggctacctgggccacaaatattcaggtggcgatcaaccaggttagacgcctgattggcaatgaaaactacctggattacatgacctccatgaagcggttcaaaaatgagagcgaccccgaaggggctctctggtga

SEQ ID NO: 19353 - RNA, 9879 nt, synthetic construct
  misc_feature 1..9879: note = derived and/or modified CDS sequence (opt5) from DENV-1__JQ045633__SS-prME
  source 1..9879: mol_type = other RNA
agcgtgaccatgctgctgatgctgatgcccaccgcccttgctttccacctgacgaccagaggcggggaacctcatatgatcgtgtccaagcaggaacgggggaagtctctcctgtttaagacaagcgccggcgttaacatgtgcacccttattgcgatggacctgggggagctctgtgaagatacaatgacctacaagtgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaagcagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcgccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaactggccgagacccagcacggaaccgtcctggtgcagattaagtacgagggcacagacgcgccgtgcaaaatccctttctccacccaagatgaaaagggggttacacagaacggacggcttatcacggctaatcccattgtgaccgacaaagagaagcctgtcaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgttggcaaactcgtccatcagattttcggggctgcctacggagtgctgttttccggcgtgagctggaccatgaagatcgggattggcgtccttctgacgtggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacagaacaatataagtttcaggcggactcccctaaacggctctctgccgctattggcaaggcctgggaggagggggtctgcggcatcagaagcgctacccgcctggaaaacatcatgtggaaacagatttccaacgagcttaatcatatcctgctcgaaaacgacatgaagttcacggtggttgtgggagatgtcgccggcattctggcccaggggaaaaagatgatccggccgcaacccatggagtacaaatattcttggaaaagctggggaaaggctaagattatcggcgcggacgtgcagaatacaacctttatcattgatgggcagaacacccctgaatgtcccgacgatcagagagcctggaatatctgggaggtggaggactacggattcggcatttttacaaccaacatctggctgaaacttcgcgattcctatacgcaagtctgcgaccaccggctcatgagcgctgccattaaagattctaaggccgttcacgctgacatgggctactggatcgaatccgagaaaaatgaaacatggaagctggccagagcgagcttcatcgaggtgaagacctgtatttggcctaaatctcatacactgtggtccaacggggtgctcgaaagcgagatgatcattcccaagatctatggaggcccgatttctcagcacaattaccgccctgggtacttcacccagacagctggaccctggcatctgggcaaacttgagctggattttgacctctgcgaagggaccacggtcgtggttgatgagcactgcggaaaccggggccctagcctgagaaccacaaccgtgacaggcaagatcatccacgaatggtgttgccggtcctgtaccctgccccctcttcgcttcagaggggaggacggatgctggtatggcatggagattcggcccgtcaaagaaaaggaggaaaatctcgtcaagagcatggtttctgccgggtccggagaggtggacagcttttccctgggcctgctctgtatctctattatgatcgaagaggtcatgagaagccgctggtcccggaaaatgctgatgacggggacacttgccgtgttcctgctcctgattatgggacaactgacctggaacgatcttatcagactgtgcattatggttggcgctaatgcctctgaccgcatgggcatggggacaacctacctcgcgctgatggctacctttaagatgagaccgatgttcgccgtgggactcctgtttcggcgccttacaagcagagaggtcctgctcctgacgatcggcctgtcccttgtggcctctgtggaactgcctaacagcctcgaggaactgggggatggactcgctatgggcatcatgattctgaaacttctgaccgacttccagtcccatcagctctgggccacactgctgagccttacctttatcaagacaaccttctctctgcactatgcttggaaaacgatggccatggtcctctccattgttagcctgtttcccctctgtctgtctacaacctcccagaagaccacatggcttcccgtgctgctggggagcctcggatgcaagcctctgaccatgttccttatcgcggagaataaaatttggggccggcgctcttggccgctgaacgaaggcatcatggccgtggggatcgtctccattctcctgagctccctcctgaagaacgatgtgccccttgctggacctctgatcgccggcgggatgctgattgcttgttacgttatcagcggatctagcgccgacctctccctggagaaagccgctgaggtgtcttgggaagaggaagcggagcatagcggcgcctcccacaatattcttgtcgaagtgcaagatgacgggacaatgaagatcaaagatgaggagagagacgatacgctgaccatcctcctgaaggctacactcctggccgtttctggagtgtatccccttagcattcctgccaccctgtttgtctggtacttctggcagaaaaagaagcagcggtccggcgtgctgtgggacacaccctctcctcccgaagtcgagcgcgctgtgctcgatgacggcatctatagaattatgcagcgggggctgcttggacgcagccaagttggcgtgggggtcttccaggaaaacgtgtttcataccatgtggcacgttacgagaggagccgtgctgatgtaccagggcaaacggctcgagccgtcctgggcgagcgtcaagaaagacctgatctcttacgggggaggctggagactccagggctcctggaataccggggaggaagtgcaagtgattgctgttgagcctggaaagaaccccaaaaatgtccagacagcccctggcaccttcaagacacccgaaggggaggtgggagccatcgctctggattttaagccgggcaccagcgggtctcctattgtgaaccgcgaaggaaaaatcgtcggcctttatggcaatggggtggttacaacgtccggaacctacgtgagcgccatcgcgcaggctaaggtctcccaagagggccccctgcctgagattgaagacgaggtgttccggaaaagaaacctgacaatcatggatctccaccccgggtctggaaagacccgccggtatctgcccgccattgttagagaagccatcaaacgcaaacttcggaccctgattctcgctcctacaagagtggtcgccagcgagatggctgaagccctgaagggcatgccgatccgctaccagacgaccgcggtgaaatccgagcatacagggaaggagatcgttgacctgatgtgccacgccacctttacaatgcggctccttagccccgtgagagtccctaattataacatgattatcatggatgaagctcatttcaccgacccctcttccattgccgctcggggctacatcagcacgcgcgtgggaatgggcgaggccgccgctatttttatgacagcgacccctcccgggtctgtggaagccttccctcagagcaatgctgtcatccaggatgaggaaagagacatcccggagcggtcctggaactctggatatgagtggattaccgattttcccggcaaaacagtttggttcgtgcctagcatcaagtccgggaatgacattgccaactgtctgcgcaaaaatggaaagagagtgatccaactgtctcggaagacctttgatacagaataccagaaaaccaagaacaacgactgggactacgtcgtgacgacagatattagcgagatgggcgccaatttcagagctgaccgcgttatcgatccccggagatgcctcaaacctgtgattctgaaggacgggcccgaacgcgtcatccttgccggcccgatgcctgtgaccgttgcgtccgctgcccagcggagaggacgcatcggccggaaccacaataaagagggggatcagtatatttacatgggacaacccctgaacaatgacgaggatcatgcccactggacagaagctaagatgctcctggacaacatcaatacccccgagggcattatccctgccctgttcgaacccgagagagaaaagagcgcggccattgatggggagtatcgcctcagaggagaggctcggaaaacgtttgtggaacttatgcgcagaggcgacctgcctgtctggctgtcttacaaggtggcctccgaggggttccagtatagcgatcggcgctggtgctttgacggcgaaagaaacaatcaggtcctcgaggaaaacatggatgtggagatctggaccaaagagggagaacggaagaaactgagaccgcgctggcttgacgctcggacatactccgaccccctggccctcagagagttcaaggaatttgctgccggccgccggtctgttagcggggatctgatcctggagattggaaaactccctcagcaccttacccaaagagcgcagaatgccctggacaacctggtgatgctccataattccgaacagggcgggcgggcttatcgccacgccatggaggagctgcccgatacaatcgaaacccttatgctgctcgctctgattgccgtgctgacaggaggcgtcaccctcttctttctttctggcagagggctgggaaagacgagcatcggcctgctctgtgttatggcctccagcgtgctgctttggatggcttctgtggagcctcattggattgcggcctccatcatcctggagttctttctcatggtcctgctgattcccgagccggaccggcagcgcacacctcaagataaccagctcgcttacgtggttatcgggcttctgttcatgattctgaccgtggccgccaatgagatgggactcctggaaaccacaaagaaagaccttggcatcgggcacgtcgctgtggagaaccaccatcacgccgcgatgctggatgtcgacctccatcccgccagcgcttggaccctgtacgccgtggctacaacgattatcacccctatgatgagacacacaattgaaaacaccacagccaatatctctctgaccgcgatcgccaaccaggctgccattctcatgggacttgataagggctggcccatctccaaaatggacattggcgttcctctgctggctctcgggtgctatagccaagtgaatcccctgacgcttaccgccgctgtcctgatgctcgtggcccattacgcgatcattggaccgggcctgcaggccaaggctacacgggaggcccagaaacgcaccgctgccgggatcatgaagaaccctacagttgatggaatcgtggccattgacctggatcccgtcgtgtatgacgcgaagtttgaaaaacagctcggccaaatcatgcttctgattctgtgtacctctcagatcctcctgatgagaacgacatgggctctttgcgagagcattaccctggccacagggcccctcaccaccctgtgggagggatcccctggcaagttctggaatacaacgatcgctgtgtctatggccaacatctttcggggcagctacctggccggggctggactcgccttctcccttatgaaaagcctgggcgggggacgcagaggcaccggggcgcagggagaaacactgggcgagaagtggaaacggcagctcaatcaactgtccaagtctgagttcaacacctataagagaagcggcattatggaggttgaccgctccgaagccaaagaggggcttaagcggggagagacaaccaaatacgctgtctctagaggcacggccaagctgcgctggtttgtggaacggaatctcgtgaaaccggaggggaaggtcatcgatctgggatgtggcagagggggatggagctattactgcgctggcctgaagaaagttacagaagtgaagggctacaccaaagggggacccggccacgaggaacctattcccatggccacctatgggtggaacctcgtgaaacttcactccggaaaagacgtcttctttgtgcctcccgagaagtgtgatacactgctgtgcgacatcggcgagtctagccctaatccgaccattgaagaggggcgcacactccgggttctgaaaatggtggaaccctggcttagaggaaaccagttctgtatcaagattctgaatccttacatgccctccgtcgtggagacgctcgagcagatgcagcgcaagcatggcggcatgctggttcggaaccctctgagcagaaattctacccacgaaatgtattgggtgtcctgcgggacaggaaacatcgtcagcgcggtgaatatgacctctcgcatgctcctgaaccggtttacaatggcccatagaaaacccacctacgagcgcgatgtggaccttggcgctgggacgagacacgtcgccgttgaaccggaggtggctaacctggatatcattggacaacggatcgaaaatattaagcacgagcataaatccacctggcactatgacgaggataacccttacaagacatgggcctatcatggcagctacgaagtgaaaccctctgggtccgctagctccatggtcaatggagtggttaagctcctgaccaagccctgggacgtgatccctatggtcacacagattgccatgaccgatacaacccccttcggccagcaacgcgtgtttaaagagaaggttgacacgagaacacctaaagcgaagcggggcaccgcccagatcatggaagtgaccgctaaatggctttgggggttcctgagcagaaacaagaagccgcggatctgtacacgcgaggaatttacgagaaaagtccggtctaatgccgctattggagccgtgttcgttgacgagaaccagtggaatagcgccaaggaggcggtggaagatgagcgcttttgggacctcgtccacagagaacgggagctgcataaacagggcaagtgcgctacctgcgtgtacaacatgatggggaaacgcgaaaagaagctgggagagttcggcaaagccaaggggtccagagccatctggtatatgtggctcggcgctcggtttctggagttcgaagcccttggattcatgaatgaggatcactggttttctcgcgaaaacagcctgtccggcgtcgagggggagggactccacaaactgggctacattcttagagacatctctaagattcccgggggaaatatgtatgctgatgacacagccggctgggatacccggatcacagaagacgatctgcaaaacgaggcgcgcatcaccgacattatggaacctgagcatgccctcctggctaaaagcatcttcaagctgacataccagaataaagtggttagagtgcagcggcccgccaagaacgggaccgtcatggatgtgatttcccgcagagaccagcggggctctggacaagtgggcacgtatgggctcaatacctttacaaacatggaagctcagctgatcagacagatggagagcgagggaattttctcccctagcgaacttgagacccccaacctggccgaacgcgttctcgattggctggagaagtacggcgtggaacggcttaaaagaatggcgatctctggggacgactgtgtcgtgaagccgatcgatgaccgctttgccacagctctgaccgccctcaatgatatgggaaaagttcggaaggacattcctcagtgggagccctccaaaggctggaacgattggcaacaggtgcctttctgcagccaccattttcaccagctgatcatgaaggacgggagagagattgtcgtgccctgtcgcaatcaggatgaactggtcggccgggctagagtgtctcaaggagccggctggtccctccgcgagacggcttgcctgggaaagagctatgcccagatgtggcagcttatgtacttccaccggagagacctgcgcctcgcggccaacgctatctgttccgccgttcctgtggattggattcccacatctcggaccacatggagcatccatgcccaccatcaatggatgaccacggaagacatgctgtccgtctggaatagagtgtggattgaggaaaacccgtggatggaggataaaacccacatcagctcttggggagacgttccttaccttggcaagcgggaggaccagtggtgcgggtccctgatcggactcacagctagagccacctgggcgacaaatattcaggtggctatcaaccaggtccgccggctgattggcaatgaaaactatctggattacatgaccagcatgaaaagatttaagaatgagtctgaccccgaaggggccctctggtga

SEQ ID NO: 19354 - RNA, 9879 nt, synthetic construct
  misc_feature 1..9879: note = derived and/or modified CDS sequence (opt5) from DENV-1__JQ045634__SS-prME
  source 1..9879: mol_type = other RNA
agcgtgaccatgctgctgatgctgatgcccaccgcccttgctttccacctgacgaccagaggcggggaacctcatatgatcgtgtccaagcaggaacggggaaagtctctcctgtttaagacaagcgccggcgttaatatgtgcacccttattgccatggacctgggggagctctgtgaagatacaatgacctacaagtgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaagcagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcgccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaactggccgagacccagcacggaaccgtcctggtgcagattaagtacgagggcacagacgcgccgtgcaaaatccctttctccacccaagatgaaaagggggttacacagaacggacggcttatcacggctaatcccattgtgaccgacaaagagaagcctgtcaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgttggcaaactcgtccatcagattttcggggctgcctacggagtgctgttttccggcgtgagctggaccatgaagatcgggattggcgtccttctgacgtggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacagaacaatataagtttcaggcggactcccctaaacggctctctgccgctattggcaaggcctgggaggagggggtctgcggcatcagaagcgctacccgcctggaaaacatcatgtggaaacagatttccaacgagcttaatcatatcctgctcgaaaacgacatgaagttcacggtggttgtgggagatgtcgccggcattctggcccaggggaaaaagatgatccggccgcaacccatggagtacaaatattcttggaaaagctggggaaaggctaagattatcggcgcggacgtgcagaatacaacctttatcattgatgggcagaacacccctgaatgtcccgacgatcagagagcctggaatatctgggaggtggaggactacggattcggcatttttacaaccaacatctggctgaaacttcgcgattcctatacgcaagtctgcgaccaccggctcatgagcgctgccattaaagattctaaggccgttcacgctgacatgggctactggatcgaatccgagaaaaatgaaacatggaagctggccagagcgagcttcatcgaggtgaagacctgtatttggcctaaatctcatacactgtggtccaacggggtgctcgaaagcgagatgatcattcccaagatctatggaggcccgatttctcagcacaattaccgccctgggtacttcacccagacagctggaccctggcatctgggcaaacttgagctggattttgacctctgcgaagggaccacggtcgtggttgatgagcactgcggaaaccggggccctagcctgagaaccacaaccgtgacaggcaagatcatccacgaatggtgttgccggtcctgtaccctgccccctcttcgcttcagaggggaggacggatgctggtatggcatggagattcggcccgtcaaagaaaaggaggaaaatctcgtcaagagcatggtttctgccgggtccggagaggtggacagcttttccctgggcctgctctgtatctctattatgatcgaagaggtcatgagaagccgctggtcccggaaaatgctgatgacggggacacttgccgtgttcctgctcctgattatgggacaactgacctggaacgatcttatcagactgtgcattatggttggcgctaatgcctctgaccgcatgggcatggggacaacctacctcgcgctgatggctacctttaagatgagaccgatgttcgccgtgggactcctgtttcggcgccttacaagcagagaggtcctgctcctgacgatcggcctgtcccttgtggcctctgtggaactgcctaacagcctcgaggaactgggggatggactcgctatgggcatcatgattctgaaacttctgaccgacttccagtcccatcagctctgggccacactgctgagccttacctttatcaagacaaccttctctctgcactatgcttggaaaacgatggccatggtcctctccattgttagcctgtttcccctctgtctgtctacaacctcccagaagaccacatggcttcccgtgctgctggggagcctcggatgcaagcctctgaccatgttccttatcgcggagaataaaatttggggccggcgctcttggccgctgaacgaaggcatcatggccgtggggatcgtctccattctcctgagctccctcctgaagaacgatgtgccccttgctggacctctgatcgccggcgggatgctgattgcttgttacgttatcagcggatctagcgccgacctctccctggagaaagccgctgaggtgtcttgggaagaggaagcggagcatagcggcgcctcccacaatattcttgtcgaagtgcaagatgacgggacaatgaagatcaaagatgaggagagagacgatacgctgaccatcctcctgaaggctacactcctggccgtttctggagtgtatccccttagcattcctgccaccctgtttgtctggtacttctggcagaaaaagaagcagcggtccggcgtgctgtgggacacaccctctcctcccgaagtcgagcgcgctgtgctcgatgacggcatctatagaattatgcagcgggggctgcttggacgcagccaagttggcgtgggggtcttccaggaaaacgtgtttcataccatgtggcacgttacgagaggagccgtgctgatgtaccagggcaaacggctcgagccgtcctgggcgagcgtcaagaaagacctgatctcttacgggggaggctggagactccagggctcctggaataccggggaggaagtgcaagtgattgctgttgagcctggaaagaaccccaaaaatgtccagacagcccctggcaccttcaagacacccgaaggggaggtgggagccatcgctctggattttaagccgggcaccagcgggtctcctattgtgaaccgcgaaggaaaaatcgtcggcctttatggcaatggggtggttacaacgtccggaacctacgtgagcgccatcgcgcaggctaaggtctcccaagagggccccctgcctgagattgaagacgaggtgttccggaaaagaaacctgacaatcatggatctccaccccgggtctggaaagacccgccggtatctgcccgccattgttagagaagccatcaaacgcaaacttcggaccctgattctcgctcctacaagagtggtcgccagcgagatggctgaagccctgaagggcatgccgatccgctaccagacgaccgcggtgaaatccgagcatacagggaaggagatcgttgacctgatgtgccacgccacctttacaatgcggctccttagccccgtgagagtccctaattataacatgattatcatggatgaagctcatttcaccgacccctcttccattgccgctcggggctacatcagcacgcgcgtgggaatgggcgaggccgccgctatttttatgacagcgacccctcccgggtctgtggaagccttccctcagagcaatgctgtcatccaggatgaggaaagagacatcccggagcggtcctggaactctggatatgagtggattaccgattttcccggcaaaacagtttggttcgtgcctagcatcaagtccgggaatgacattgccaactgtctgcgcaaaaatggaaagagagtgatccaactgtctcggaagacctttgatacagaataccagaaaaccaagaacaacgactgggactacgtcgtgacgacagatattagcgagatgggcgccaatttcagagctgaccgcgttatcgatccccggagatgcctcaaacctgtgattctgaaggacgggcccgaacgcgtcatccttgccggcccgatgcctgtgaccgttgcgtccgctgcccagcggagaggacgcatcggccggaaccacaataaagagggggatcagtatatttacatgggacaacccctgaacaatgacgaggatcatgcccactggacagaagctaagatgctcctggacaacatcaatacccccgagggcattatccctgccctgttcgaacccgagagagaaaagagcgcggccattgatggggagtatcgcctcagaggagaggctcggaaaacgtttgtggaacttatgcgcagaggcgacctgcctgtctggctgtcttacaaggtggcctccgaggggttccagtatagcgatcggcgctggtgctttgacggcgaaagaaacaatcaggtcctcgaggaaaacatggatgtggagatctggaccaaagagggagaacggaagaaactgagaccgcgctggcttgacgctcggacatactccgaccccctggccctcagagagttcaaggaatttgctgccggccgccggtctgttagcggggatctgatcctggagattggaaaactccctcagcaccttacccaaagagcgcagaatgccctggacaacctggtgatgctccataattccgaacagggcgggcgggcttatcgccacgccatggaggagctgcccgatacaatcgaaacccttatgctgctcgctctgattgccgtgctgacaggaggcgtcaccctcttctttctttctggcagagggctgggaaagacgagcatcggcctgctctgtgttatggcctccagcgtgctgctttggatggcttctgtggagcctcattggattgcggcctccatcatcctggagttctttctcatggtcctgctgattcccgagccggaccggcagcgcacacctcaagataaccagctcgcttacgtggttatcgggcttctgttcatgattctgaccgtggccgccaatgagatgggactcctggaaaccacaaagaaagaccttggcatcgggcacgtcgctgtggagaaccaccatcacgccgcgatgctggatgtcgacctccatcccgccagcgcttggaccctgtacgccgtggctacaacgattatcacccctatgatgagacacacaattgaaaacaccacagccaatatctctctgaccgcgatcgccaaccaggctgccattctcatgggacttgataagggctggcccatctccaaaatggacattggcgttcctctgctggctctcgggtgctatagccaagtgaatcccctgacgcttaccgccgctgtcctgatgctcgtggcccattacgcgatcattggaccgggcctgcaggccaaggctacacgggaggcccagaaacgcaccgctgccgggatcatgaagaaccctacagttgatggaatcgtggccattgacctggatcccgtcgtgtatgacgcgaagtttgaaaaacagctcggccaaatcatgcttctgattctgtgtacctctcagatcctcctgatgagaacgacatgggctctttgcgagagcattaccctggccacagggcccctcaccaccctgtgggagggatcccctggcaagttctggaatacaacgatcgctgtgtctatggccaacatctttcggggcagctacctggccggggctggactcgccttctcccttatgaaaagcctgggcgggggacgcagaggcaccggggcgcagggagaaacactgggcgagaagtggaaacggcagctcaatcaactgtccaagtctgagttcaacacctataagagaagcggcattatggaggttgaccgctccgaagccaaagaggggcttaagcggggagagacaaccaaatacgctgtctctagaggcacggccaagctgcgctggtttgtggaacggaatctcgtgaaaccggaggggaaggtcatcgatctgggatgtggcagagggggatgggcttattactgcgccggcctgaagaaagttacagaagtgaagggctacaccaaagggggacccggccacgaggaacctattcccatggcgacctatgggtggaacctcgtgaaacttcacagcggaaaagacgtcttctttgtgcctcccgagaagtgtgatacactgctgtgcgacatcggcgagtcctctcctaatccgaccattgaagaggggcgcacactccgggttctgaaaatggtggaaccctggcttagaggaaaccagttctgtatcaagattctgaatccttacatgcccagcgtcgtggagacgctcgagcagatgcagcgcaagcatggcggcatgctggttcggaaccctctgtccagaaatagcacccacgaaatgtattgggtgtcttgcgggacaggaaacatcgtctccgccgtgaatatgaccagccgcatgctcctgaaccggtttacaatggctcatagaaaacccacctacgagcgcgatgtggaccttggcgccgggacgagacacgtcgctgttgaaccggaggtggccaacctggatatcattggacaacggatcgaaaatattaagcacgagcataaatctacctggcactatgacgaggataacccttacaagacatgggcttatcatggctcctacgaagtgaaacccagcgggtctgcctccagcatggtcaatggagtggttaagctcctgaccaagccctgggacgtgatccctatggtcacacagattgcgatgaccgatacaacccccttcggccagcaacgcgtgtttaaagagaaggttgacacgagaacacctaaagccaagcggggcaccgctcagatcatggaagtgaccgccaaatggctttgggggttcctgtccagaaacaagaagccgcggatctgtacacgcgaggaatttacgagaaaagtccggagcaatgctgccattggagccgtgttcgttgacgagaaccagtggaactctgcgaaggaggctgtggaagatgagcgcttttgggacctcgtccacagagaacgggagctgcataaacagggcaagtgcgcgacctgcgtgtacaacatgatggggaaacgcgaaaagaagctgggagagttcggcaaagccaaggggagcagagctatctggtatatgtggctcggcgcccggtttctggagttcgaagctcttggattcatgaatgaggatcactggttttcccgcgaaaactctctgagcggcgtcgagggggagggactccacaaactgggctacattcttagagacatctccaagattcccgggggaaatatgtatgccgatgacacagcgggctgggatacccggatcacagaagacgatctgcaaaacgaggcccgcatcaccgacattatggaacctgagcatgctctcctggccaaatctatcttcaagctgacataccagaataaagtggttagagtgcagcggcccgctaagaacgggaccgtcatggatgtgattagccgcagagaccagcggggctccggacaagtgggcacgtatgggctcaatacctttacaaacatggaagcccagctgatcagacagatggagtctgagggaattttcagcccttccgaacttgagacccccaacctggcggaacgcgttctcgattggctggagaagtacggcgtggaacggcttaaaagaatggccatcagcggggacgactgtgtcgtgaagccgatcgatgaccgctttgctacagccctgaccgctctcaatgatatgggaaaagttcggaaggacattcctcagtgggagccctctaaaggctggaacgattggcaacaggtgcctttctgctcccaccattttcaccagctgatcatgaaggacgggagagagattgtcgtgccctgtcgcaatcaggatgaactggtcggccgggccagagtgagccaaggagctggctggtctctccgcgagacggcctgcctggggaagtcctatgcgcagatgtggcagcttatgtacttccaccggagagacctgcgcctcgccgctaacgccatctgtagcgccgttcctgtggattggattcccacatcccggaccacatggtctatccatgctcaccatcaatggatgaccacggaagacatgctgagcgtctggaatagagtgtggattgaggaaaacccgtggatggaggataaaacccacatctccagctggggagacgttccttaccttggcaagcgggaggaccagtggtgcgggtctctgatcggactcacagccagagcgacctgggctacaaatattcaggtggccatcaaccaggtccgccggctgattggcaatgaaaactatctggattacatgacctccatgaaaagatttaagaatgagagcgaccccgaaggggccctctggtga

SEQ ID NO: 19355 - RNA, 9879 nt, synthetic construct
  misc_feature 1..9879: note = derived and/or modified CDS sequence (opt5) from DENV-1__JQ045636__SS-prME
  source 1..9879: mol_type = other RNA
agcgtgaccatgctgctgatgctgatgcccacagctcttgctttccacctgacgacccggggaggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccattgctacaatcacaccccaggccccttctacggagattcagctgaccgactacggcgccctcacactggattgtagcccccggaccggcctggactttaacgaaatggtgctcctgacaatgaaggagaaaagctggcttgtccataagcagtggttcctggatctccctctgccctggacctccggggcttctacgagccaagagacatggaatcgccaggaccttctggtgacctttaaaacagcgcacgccaagaagcaggaagtcgtggttctcggatcccaagagggcgctatgcacaccgccctgaccggggccacagaaatccagacgagcggaaccacaaccattttcgctggccatctgaaatgcagactcaagatggataaactgacacttaaggggatgtcttatgtgatgtgtaccggctccttcaaactggagaaggaagtcgccgagacgcagcacggaacagtgctcgttcagatcaagtacgagggcaccgacgcgccgtgcaaaatcccttttagcacccaagatgaaaagggggctacacagaacggacggctgattaccgccaatcccatcgtgacagacaaagagaagcctgtcaacattgaagccgagccgcccttcggcgagtcttatatcgtgattggggctggagaaaaagccctgaaacttagctggtttaagaaaggctcctctatcgggaagatgttcgaggctacggccagaggcgcgcgccggatggccatcctcggagataccgcttgggactttggcagcattgggggagtgttcacatccgttggcaaactggtccatcagatctttgggaccgcctacggagtgctgttcagcggcgtgtcttggacaatgaagattgggatcggcgtcctcctgacctggcttggactcaattccagaagcacgtctctctccatgacctgtattgctgtgggcctggttacactgtaccttggggtgatggtccaggccgatagcggatgcgtgatcaactggaaaggccgcgaactcaagtgtgggtccggaatttttgttaccaatgaggtgcacacatggaccgaacaatataagttccaggcggactctcctaaacggctgagcgccgctatcggcaaggcctgggaggagggggtctgcggcatcagatccgctacacgcctggaaaacattatgtggaaacagatctctaacgagctcaatcatattctgcttgaaaacgacatgaagctgaccgtggttgtgggagatgtcgccggcatcctcgcccaggggaaaaagatgattcggccgcaacccatggagtacaaatatagctggaagtcctggggaaaggctaaaatcatcggcgcggacgtgcagaatacgacatttattatcgatgggcctaacacccccgaatgtcctgacgatcagagagcctggaatatttgggaggtggaggactacggattcggcatctttaccacaaacatttggctgaagctgcgcgatagctatacccaggtctgcgaccaccggcttatgtctgctgccatcaaagattccaaggccgttcacgctgacatgggctactggatcgaaagcgagaaaaatgaaacgtggaagctcgccagagcgtctttcattgaggtgaagacatgtatctggcccaaatcccataccctgtggagcaacggggtgctggaatctgagatgattatcccgaagatttatggaggccctatcagccaacacaattaccgccccgggtacttcacacagaccgctggaccttggcatctcggcaaactggagcttgattttgacctgtgcgaagggacaaccgtcgtggttgatgagcactgcggaaaccggggcccctccctcagaacgaccacagtgaccggcaagatcattcacgaatggtgttgccggagctgtacactgcctcccctgcgcttcaaaggggaggacggatgctggtatggcatggagatcagaccggtcaaggaaaaggaggaaaatcttgtgaaatctatggtttccgccgggagcggagaggtggactccttttctctcggcctgctgtgtattagcatcatgattgaagaggtcatgcggtccagatggtctcgcaagatgctcatgaccgggacgctggccgtgttctttcttctgatcatgggacagctcacatggaacgatctgattcggctgtgcatcatggttggcgctgacgccagcgatagaatgggcatggggaccacataccttgcgctgatggctaccttcaaaatgcgccctatgtttgccgtgggactcctgttcagacggctcacctcccgcgaggtcctgcttctgacaatcggcctctctctggtggccagcgtggaactgcccaattcccttgaggaactgggggacggactcgctatgggcattatgatcctgaagctcctgacggattttcaaagccatcagctttgggccaccctgctctctctgacattcattagaaccacattttccctgcactatgcttggaaaaccatggccatggtccttagcatcgtttctctgttccccctctgtctgtccacgacaagccagaagaccacctggctccctgtgctgcttgggtctctgggatgcaagccgctgacaatgtttctcattgcggagaacaaaatctggggccggaagtcctggcccctgaatgaaggcatcatggccgtggggattgtcagcatccttctgtccagcctcctgaaaaacgacgtgcctctcgctggacccctgattgccggcgggatgcttatcgcttgttacgttatttctggaagctccgccgatctgtctctggagaaggccgctgtggtcagctgggaggaagaggcggaacattccggcgcctctcacaacatcctcgtggaggttcaggacgatgggaccatgaaaatcaaggacgaagaaagagatgacacactgacgattcttctgaaagctaccctcctggccgtgagcggagtctatcctctctccatccccgccacactgttcgtgtggtacttctggcaaaagaagaaacagagatctggcgtcctttgggataccccttcccctcccgaggtggaacgggctgttctggacgacggcatttatcgcatcatgcagagagggctgctcggacggtcccaggtgggcgtcggggtgtttcaagagaatgttttccatacaatgtggcacgtgacccgcggagccgtcctgatgtaccagggcaagagacttgaacccagctgggcgtctgtgaaaaaggatctgatttcctacgggggaggctggcggctccagggcagctggaacacgggggaggaggtgcaggttatcgctgtcgaacccggcaagaatcctaagaacgtgcaaaccgcccccggcacatttaagacctctgagggggaagtgggagccattgctctggacttcaaaccgggcacatccgggagccctatcgtcaatagagagggaaagatcgtgggcctctatggcaacggggttgtgaccacatccggaacgtacgtctctgccattgcgcaggctaaagccagccaggaaggccccctgcctgagatcgaggatgaagtgtttcgcaagcggaatcttaccattatggacctgcaccccgggtccggaaaaacaagacgctatctgcccgccatcgttcgggaggctattaagagaaagctccgcaccctgatccttgcccctacccgggtggtcgctagcgaaatggccgaggcgctgaaaggcatgccgatcagataccaaacaacggccgtgaagtctgaacataccgggaaagagattgttgatctcatgtgccacgctacattcaccatgcgcctgctgtcccccgtgcgggtccctaactataatatgatcattatggacgaggcccattttacagatcccagctctatcgctgccagaggctacattagcacccgggtgggaatgggcgaagccgctgcgatcttcatgacggccacacctcccgggtccgtggaggcttttcctcagtctaacgccgtcatccaggacgaagaacgcgatattccggaaagaagctggaactccggatatgagtggatcaccgacttccccggcaagaccgtttggtttgtgccttctattaaaagcgggaacgatatcgccaattgtctccggaagaacggaaagcgcgtgattcagctttccagaaaaacattcgacaccgagtaccaaaagaccaagaataacgactgggattacgtcgtgaccacggacatcagcgaaatgggcgctaacttccgggccgatagagttattgacccccgccggtgcctgaagcctgtgatcctgaaagatgggcccgagagagtcatcctcgcgggcccgatgcctgtgacagttgcttctgccgcccagcgccggggaagaattggccgcaatcacaacaaggaaggggaccagtatatctacatgggacagcccctgaataacgatgaggaccatgctcactggaccgaggccaagatgcttctggataatattaacacacccgaaggcatcattcctgcgctctttgaccccgagcgggaaaaatccgccgctatcgatggggagtatagactgcgcggagaagccagaaagaccttcgtggagctgatgcggcgcggcgacctccctgtctggcttagctacaaagtggcttccgaggggtttcaatattctgatagacggtggtgcttcgacggcgaacgcaataaccaggtcctggaggaaaatatggacgtggagatctggacgaaggaaggagagcgcaagaagctgcggccgagatggctcgatgcccgcacctacagcgaccccctggcccttcgggagtttaaagagttcgccgcgggcagacgctccgtttctggggatctgattctcgagatcggaaagctgcctcagcacctgacacagcgggcccaaaacgctctcgacaatcttgtgatgctgcataacagcgaacagggcgggagagcctatcggcacgctatggaggaactgcccgataccattgagacactcatgctgcttgccctgatcgccgtgctcaccggaggcgtcacactgtttttcctgtccggccgcgggctcggaaagaccagcattggccttctgtgtgttatggcttcttccgtgctgctctggatggcgagcgtggagcctcattggatcgccgcttctatcattctggaatttttccttatggtcctgctcatccccgagccggacagacagcggacgcctcaggataatcaactggcctacgtggttattgggctgctctttatgatccttacagtggccgctaacgaaatgggactgctggagaccaccaaaaaggacctcggcattgggcacgtcgccgtggagaatcaccatcacgcggccatgctggatgtcgaccttcatcccgcttccgcctggacactgtacgctgtggccaccacaatcattacgcctatgatgcgccacaccatcgaaaacacaaccgcgaacatcagcctcacagccattgctaatcaggccgctatcctgatgggactggataaaggctggcccatttctaagatggacatcggcgttcctctccttgccctggggtgctatagccaggtgaaccccctgaccctcacggctgccgtcctgatgcttgtggcgcattacgccattatcggaccgggcctgcaagctaaagccaccagagaggctcagaagcggacagccgccgggatcatgaagaatcctaccgttgatggaattgtggcgatcgacctcgaccccgtcgtgtatgatgctaaattcgaaaagcagctgggccagattatgctgctcatcctttgtacatcccaaattctgctgatgcgcaccacgtgggccctctgcgagtctatcacactggctaccgggccccttacaaccctgtgggaaggaagccctggcaaattttggaacaccacaatcgccgtgtccatggccaatattttcagaggcagctacctcgctggggccggactggcgttctccctgatgaagtctctcggcgggggacggcgcggcacgggggcccagggagagacccttggcgagaaatggaagagacagctgaaccagctgagcaagtccgaatttaatacatataaacggtctggcatcatggaggttgacagaagcgaagctaaggaggggctcaaacgcggagaaaccacaaagcacgccgtctcccggggcaccgctaaactgagatggttcgtggagcgcaaccttgtgaagccggaggggaaggtcattgatctgggatgtggcagagggggatggtcttactattgcgccggcctcaaaaaggttacggaagtgaaaggctacacaaaagggggacccggccacgaggaacctatccccatggcgacctacgggtggaatctggtgaaactgcatagcggaaaggacgtctttttcattcctcccgagaaatgtgataccctcctttgcgacatcggcgaatccagccctaacccgacaattgaggaggggagaaccctgcgcgtgctgaagatggttgaaccctggctccggggaaatcaattttgtatcaagatcctgaacccttatatgccctctgtggtcgagacacttgaacagatgcagagaaaacacggcggcatgctggtgcgcaatcctctctcccggaacagcacgcatgagatgtactgggtttcttgcgggaccggaaatattgtgtccgccgtcaacatgacaagcagaatgctgctgaatcgcttcaccatggctcaccggaagcccacatatgagagagatgtggacctcggcgccgggacccgccacgtggctgtcgaaccggaggttgccaacctggatatcattggacagagaatcgaaaacattaaacatgagcacaagtctacgtggcattacgacgaagataatccttataaaacctgggcttaccacggctcctatgaggtgaagcccagcgggtccgccagctctatggtgaacggagtcgtgaaacttctgacaaaaccctgggacgttatccctatggtgacccaaatcgcgatgacagacaccacaccctttggccagcagcgggtcttcaaggagaaagtggatacccgcacgcctaaggccaaaagaggcacagctcaaattatggaagttaccgccaagtggctctgggggtttctgagccggaataagaaaccgagaatctgtacccgggaggagttcacacgcaaggtgagatccaacgctgccattggagccgtctttgtggacgagaatcagtggaactctgcgaaagaagctgttgaggatgagcggttctgggaccttgtgcatcgcgaaagagagctgcacaagcagggcaaatgcgccacgtgcgtctacaatatgatggggaagcgggaaaagaaactcggagagtttggcaaggccaaagggagccgcgctatctggtacatgtggctgggcgccagattcctggagttcgaggctctcggatttatgaacgaggatcactggttctcccgggaaaattctctgagcggcgtggagggggaaggacttcataagctgggctatattctccgcgacatctccaaaatccccgggggaaacatgtacgccgatgacaccgcgggctgggatacaagaattaccgaggacgatctgcagaatgaggccaagatcacagacattatggaacctgagcacgcccttctggccaaatctatctttaagctcacctatcaaaacaaggtcgtgcgggttcagcgccccgctaaaaatgggacagtgatggatgtcattagcagacgggaccagcgcggctccggacaggtgggcacctacgggctgaacacgttcaccaatatggaagcccaactgatcagacagatggagagcgaaggaatcttttctccttccgagctcgagacacccaacctggcgggccgggtgcttgactggctggaaaagcatggggttgagagactcaaacgcatggccattagcggagatgactgtgtggtcaagccgatcgatgaccggttcgctaccgccctgacagctcttaacgatatgggcaaagtgagaaaggacattcctcagtgggaaccctctaaggggtggaatgattggcagcaagttcctttttgctcccaccacttccatcagctgatcatgaaagacggccgcgagattgtggtcccctgtcggaaccaggatgaactcgtgggcagagctcgcgtcagccagggagctgggtggtccctgcgggagaccgcctgcctgggaaagtcttatgcgcaaatgtggcagctcatgtactttcacagacgcgacctgcggcttgccgctaatgccatctgtagcgccgtgcctgttgattgggtgcccacgtccagaacaacctggagcattcatgctcaccatcagtggatgacaaccgaggacatgctgtctgtctggaaccgcgtgtggatcgaagagaatccgtggatggaagacaaaacgcacatctccagctggggcgatgttccttatctcgggaagcgggaggaccaatggtgcggatctctgattggccttaccgccagagcgacatgggctaccaacatccaggtggccattaatcaggtccggagactgctcgggaacgaaaattacctggattacatgacaagcatgaaacgcttcaagaacgagtccgaccccgagggcgccctgtggtga

SEQ ID NO: 19356 - RNA, 9879 nt, synthetic construct
  misc_feature 1..9879: note = derived and/or modified CDS sequence (opt5) from DENV-1__JQ045635__SS-prME
  source 1..9879: mol_type = other RNA
agcgtgaccatgctgctgatgctgatgcccacagctcttgctttccacctgacgacccggggaggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccattgctacaatcacaccccaggccccttctacggagattcagctgaccgactacggcgccctcacactggattgtagcccccggaccggcctggactttaacgaaatggtgctcctgacaatgaaggagaaaagctggcttgtccataagcagtggttcctggatctccctctgccctggacctccggggcttctacgagccaagagacatggaatcgccaggaccttctggtgacctttaaaacagcgcacgccaagaagcaggaagtcgtggttctcggatcccaagagggcgctatgcacaccgccctgaccggggccacagaaatccagacgagcggaaccacaaccattttcgctggccatctgaaatgcagactcaagatggataaactgacacttaaggggatgtcttatgtgatgtgtaccggctccttcaaactggagaaggaagtcgccgagacgcagcacggaacagtgctcgttcagatcaagtacgagggcaccgacgcgccgtgcaaaatcccttttagcacccaagatgaaaagggggctacacagaacggacggctgattaccgccaatcccatcgtgacagacaaagagaagcctgtcaacattgaagccgagccgcccttcggcgagtcttatatcgtgattggggctggagaaaaagccctgaaacttagctggtttaagaaaggctcctctatcgggaagatgttcgaggctacggccagaggcgcgcgccggatggccatcctcggagataccgcttgggactttggcagcattgggggagtgttcacatccgttggcaaactggtccatcagatctttgggaccgcctacggagtgctgttcagcggcgtgtcttggacaatgaagattgggatcggcgtcctcctgacctggcttggactcaattccagaagcacgtctctctccatgacctgtattgctgtgggcctggttacactgtaccttggggtgatggtccaggccgatagcggatgcgtgatcaactggaaaggccgcgaactcaagtgtgggtccggaatttttgttaccaatgaggtgcacacatggaccgaacaatataagttccaggcggactctcctaaacggctgagcgccgctatcggcaaggcctgggaggagggggtctgcggcatcagatccgctacacgcctggaaaacattatgtggaaacagatctctaacgagctcaatcatattctgcttgaaaacgacatgaagctgaccgtggttgtgggagatgtcgccggcatcctcgcccaggggaaaaagatgattcggccgcaacccatggagtacaaatatagctggaagtcctggggaaaggctaaaatcatcggcgcggacgtgcagaatacgacatttattatcgatgggcctaacacccccgaatgtcctgacgatcagagagcctggaatatttgggaggtggaggactacggattcggcatctttaccacaaacatttggctgaagctgcgcgatagctatacccaggtctgcgaccaccggcttatgtctgctgccatcaaagattccaaggccgttcacgctgacatgggctactggatcgaaagcgagaaaaatgaaacgtggaagctcgccagagcgtctttcattgaggtgaagacatgtatctggcccaaatcccataccctgtggagcaacggggtgctggaatctgagatgattatcccgaagatttatggaggccctatcagccaacacaattaccgccccgggtacttcacacagaccgctggaccttggcatctcggcaaactggagcttgattttgacctgtgcgaagggacaaccgtcgtggttgatgagcactgcggaaaccggggcccctccctcagaacgaccacagtgaccggcaagatcattcacgaatggtgttgccggagctgtacactgcctcccctgcgcttcaaaggggaggacggatgctggtatggcatggagatcagaccggtcaaggaaaaggaggaaaatcttgtgaaatctatggtttccgccgggagcggagaggtggactccttttctctcggcctgctgtgtattagcatcatgattgaagaggtcatgcggtccagatggtctcgcaagatgctcatgaccgggacgctggccgtgttctttcttctgatcatgggacagctcacatggaacgatctgattcggctgtgcatcatggttggcgctgacgccagcgatagaatgggcatggggaccacataccttgcgctgatggctaccttcaaaatgcgccctatgtttgccgtgggactcctgttcagacggctcacctcccgcgaggtcctgcttctgacaatcggcctctctctggtggccagcgtggaactgcccaattcccttgaggaactgggggacggactcgctatgggcattatgatcctgaagctcctgacggattttcaaagccatcagctttgggccaccctgctctctctgacattcattagaaccacattttccctgcactatgcttggaaaaccatggccatggtccttagcatcgtttctctgttccccctctgtctgtccacgacaagccagaagaccacctggctccctgtgctgcttgggtctctgggatgcaagccgctgacaatgtttctcattgcggagaacaaaatctggggccggaagtcctggcccctgaatgaaggcatcatggccgtggggattgtcagcatccttctgtccagcctcctgaaaaacgacgtgcctctcgctggacccctgattgccggcgggatgcttatcgcttgttacgttatttctggaagctccgccgatctgtctctggagaaggccgctgtggtcagctgggaggaagaggcggaacattccggcgcctctcacaacatcctcgtggaggttcaggacgatgggaccatgaaaatcaaggacgaagaaagagatgacacactgacgattcttctgaaagctaccctcctggccgtgagcggagtctatcctctctccatccccgccacactgttcgtgtggtacttctggcaaaagaagaaacagagatctggcgtcctttgggataccccttcccctcccgaggtggaacgggctgttctggacgacggcatttatcgcatcatgcagagagggctgctcggacggtcccaggtgggcgtcggggtgtttcaagagaatgttttccatacaatgtggcacgtgacccgcggagccgtcctgatgtaccagggcaagagacttgaacccagctgggcgtctgtgaaaaaggatctgatttcctacgggggaggctggcggctccagggcagctggaacacgggggaggaggtgcaggttatcgctgtcgaacccggcaagaatcctaagaacgtgcaaaccgcccccggcacatttaagacctctgagggggaagtgggagccattgctctggacttcaaaccgggcacatccgggagccctatcgtcaatagagagggaaagatcgtgggcctctatggcaacggggttgtgaccacatccggaacgtacgtctctgccattgcgcaggctaaagccagccaggaaggccccctgcctgagatcgaggatgaagtgtttcgcaagcggaatcttaccattatggacctgcaccccgggtccggaaaaacaagacgctatctgcccgccatcgttcgggaggctattaagagaaagctccgcaccctgatccttgcccctacccgggtggtcgctagcgaaatggccgaggcgctgaaaggcatgccgatcagataccaaacaacggccgtgaagtctgaacataccgggaaagagattgttgatctcatgtgccacgctacattcaccatgcgcctgctgtcccccgtgcgggtccctaactataatatgatcattatggacgaggcccattttacagatcccagctctatcgctgccagaggctacattagcacccgggtgggaatgggcgaagccgctgcgatcttcatgacggccacacctcccgggtccgtggaggcttttcctcagtctaacgccgtcatccaggacgaagaacgcgatattccggaaagaagctggaactccggatatgagtggatcaccgacttccccggcaagaccgtttggtttgtgccttctattaaaagcgggaacgatatcgccaattgtctccggaagaacggaaagcgcgtgattcagctttccagaaaaacattcgacaccgagtaccaaaagaccaagaataacgactgggattacgtcgtgaccacggacatcagcgaaatgggcgctaacttccgggccgatagagttattgacccccgccggtgcctgaagcctgtgatcctgaaagatgggcccgagagagtcatcctcgcgggcccgatgcctgtgacagttgcttctgccgcccagcgccggggaagaattggccgcaatcacaacaaggaaggggaccagtatatctacatgggacagcccctgaataacgatgaggaccatgctcactggaccgaggccaagatgcttctggataatattaacacacccgaaggcatcattcctgcgctctttgaccccgagcgggaaaaatccgccgctatcgatggggagtatagactgcgcggagaagccagaaagaccttcgtggagctgatgcggcgcggcgacctccctgtctggcttagctacaaagtggcttccgaggggtttcaatattctgatagacggtggtgcttcgacggcgaacgcaataaccaggtcctggaggaaaatatggacgtggagatctggacgaaggaaggagagcgcaagaagctgcggccgagatggctcgatgcccgcacctacagcgaccccctggcccttcgggagtttaaagagttcgccgcgggcagacgctccgtttctggggatctgattctcgagatcggaaagctgcctcagcacctgacacagcgggcccaaaacgctctcgacaatcttgtgatgctgcataacagcgaacagggcgggagagcctatcggcacgctatggaggaactgcccgataccattgagacactcatgctgcttgccctgatcgccgtgctcaccggaggcgtcacactgtttttcctgtccggccgcgggctcggaaagaccagcattggccttctgtgtgttatggcttcttccgtgctgctctggatggcgagcgtggagcctcattggatcgccgcttctatcattctggaatttttccttatggtcctgctcatccccgagccggacagacagcggacgcctcaggataatcaactggcctacgtggttattgggctgctctttatgatccttacagtggccgctaacgaaatgggactgctggagaccaccaaaaaggacctcggcattgggcacgtcgccgtggagaatcaccatcacgcggccatgctggatgtcgaccttcatcccgcttccgcctggacactgtacgctgtggccaccacaatcattacgcctatgatgcgccacaccatcgaaaacacaaccgcgaacatcagcctcacagccattgctaatcaggccgctatcctgatgggactggataaaggctggcccatttctaagatggacatcggcgttcctctccttgccctggggtgctatagccaggtgaaccccctgaccctcacggctgccgtcctgatgcttgtggcgcattacgccattatcggaccgggcctgcaagctaaagccaccagagaggctcagaagcggacagccgccgggatcatgaagaatcctaccgttgatggaattgtggcgatcgacctcgaccccgtcgtgtatgatgctaaattcgaaaagcagctgggccagattatgctgctcatcctttgtacatcccaaattctgctgatgcgcaccacgtgggccctctgcgagtctatcacactggctaccgggccccttacaaccctgtgggaaggaagccctggcaaattttggaacaccacaatcgccgtgtccatggccaatattttcagaggcagctacctcgctggggccggactggcgttctccctgatgaagtctctcggcgggggacggcgcggcacgggggcccagggagagacccttggcgagaaatggaagagacagctgaaccagctgagcaagtccgaatttaatacatataaacggtctggcatcatggaggttgacagaagcgaagctaaggaggggctcaaacgcggagaaaccacaaagcacgccgtctcccggggcaccgctaaactgagatggttcgtggagcgcaaccttgtgaagccggaggggaaggtcattgatctgggatgtggcagagggggatgggcctactattgcgcgggcctcaaaaaggttacggaagtgaaaggctacacaaaagggggacccggccacgaggaacctatccccatggccacctacgggtggaatctggtgaaactgcattctggaaaggacgtctttttcattcctcccgagaaatgtgataccctcctttgcgacatcggcgaaagctcccctaacccgacaattgaggaggggagaaccctgcgcgtgctgaagatggttgaaccctggctccggggaaatcaattttgtatcaagatcctgaacccttatatgcccagcgtggtcgagacacttgaacagatgcagagaaaacacggcggcatgctggtgcgcaatcctctctctcggaactccacgcatgagatgtactgggttagctgcgggaccggaaatattgtgtctgctgtcaacatgacatccagaatgctgctgaatcgcttcaccatggcccaccggaagcccacatatgagagagatgtggacctcggcgctgggacccgccacgtggccgtcgaaccggaggttgctaacctggatatcattggacagagaatcgaaaacattaaacatgagcacaagagcacgtggcattacgacgaagataatccttataaaacctgggcctaccacggctcttatgaggtgaagccctccgggagcgcgtccagcatggtgaacggagtcgtgaaacttctgacaaaaccctgggacgttatccctatggtgacccaaatcgccatgacagacaccacaccctttggccagcagcgggtcttcaaggagaaagtggatacccgcacgcctaaggctaaaagaggcacagcccaaattatggaagttaccgctaagtggctctgggggtttctgtctcggaataagaaaccgagaatctgtacccgggaggagttcacacgcaaggtgagaagcaacgccgccattggagcggtctttgtggacgagaatcagtggaactccgctaaagaagccgttgaggatgagcggttctgggaccttgtgcatcgcgaaagagagctgcacaagcagggcaaatgcgccacgtgcgtctacaatatgatggggaagcgggaaaagaaactcggagagtttggcaaggctaaagggtctcgcgccatctggtacatgtggctgggcgctagattcctggagttcgaggccctcggatttatgaacgaggatcactggttcagccgggaaaattccctgtctggcgtggagggggaaggacttcataagctgggctatattctccgcgacatcagcaaaatccccgggggaaacatgtacgcggatgacaccgccggctgggatacaagaattaccgaggacgatctgcagaatgaggctaagatcacagacattatggaacctgagcacgcccttctggctaaatccatctttaagctcacctatcaaaacaaggtcgtgcgggttcagcgccccgccaaaaatgggacagtgatggatgtcatttctagacgggaccagcgcggcagcggacaggtgggcacctacgggctgaacacgttcaccaatatggaagcgcaactgatcagacagatggagtccgaaggaatctttagcccttctgagctcgagacacccaacctggccggccgggtgcttgactggctggaaaagcatggggttgagagactcaaacgcatggctatttccggagatgactgtgtggtcaagccgatcgatgaccggttcgccaccgctctgacagcccttaacgatatgggcaaagtgagaaaggacattcctcagtgggaacccagcaaggggtggaatgattggcagcaagttcctttttgctctcaccacttccatcagctgatcatgaaagacggccgcgagattgtggtcccctgtcggaaccaggatgaactcgtgggcagagctcgcgtctcccagggagccgggtggagcctgcgggagaccgcgtgcctgggaaagtcctatgcccaaatgtggcagctcatgtactttcacagacgcgacctgcggcttgctgccaatgccatctgttctgctgtgcctgttgattgggtgcccacgagcagaacaacctggtccattcatgcccaccatcagtggatgacaaccgaggacatgctgagcgtctggaaccgcgtgtggatcgaagagaatccgtggatggaagacaaaacgcacatctcttcctggggcgatgttccttatctcgggaagcgggaggaccaatggtgcggaagcctgattggccttaccgcgagagctacatgggccaccaacatccaggtggccattaatcaggtccggagactgctcgggaacgaaaattacctggattacatgacatctatgaaacgcttcaagaacgagagcgaccccgagggcgctctgtggtga

SEQ ID NO: 19357 - RNA, 9879 nt, synthetic construct
  misc_feature 1..9879: note = derived and/or modified CDS sequence (opt5) from DENV-1__JQ045637__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagaccagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagatgtccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggattggcgtgctgcttacctggctgggactcaattctagatccacaagcctgtctatgacctgtatcgctgttggcctggtgacactttacctcggggtcatggtgcaggccgattccggatgcgttattaactggaaaggccgcgaactgaagtgtgggagcggaatcttcgtgaccaatgaggtccacacatggaccgaacaatataagtttcaggctgactcccctaaacggctgtctgccgcgattggcaaggcctgggaggagggggtgtgcggcatcagaagcgctacgcgcctcgaaaacatcatgtggaaacagatttccaacgagctgaatcatatccttctggaaaacgacatgaagttcacagttgtggtcggagatgtggccggcattctcgctcaggggaaaaagatgatccggccgcaacccatggagtacaaatattcttggaaaagctggggaaaggccaagattatcggcgccgacgtgcagaataccacctttatcattgatgggcctaacacacccgaatgtcctgacgatcagagagcttggaatatctgggaggtcgaggactacggattcggcatttttaccacgaacatctggctgaagctgcgcgattcctatacacaggtttgcgaccaccggcttatgagcgcggccattaaagattctaaggctgtgcacgccgacatgggctactggatcgaatccgagaaaaatgaaacctggaagctcgccagagctagcttcatcgaggtgaagacatgtatttggcccaaatctcataccctgtggtccaacggggtcctggaaagcgagatgatcattccgaagatctatggaggccctatttctcaacacaattaccgccccgggtacttcacacagaccgccggaccttggcatctcggcaaactggagcttgattttgacctgtgcgaagggacgaccgtggttgtggatgagcactgcggaagccggggcccctccctcagaacaaccacagtcaccggcaagatcatccacgaatggtgttgccggagctgtacgctgcctcccctgcgcttcagaggggaggacggatgctggtatggcatggagattcggccggtgaaagaaaaggaggaaaaccttgttaagtctatggtgtccgcggggagcggagaggtcgactccctctctctgggcctgctctgtatcagcattatgatcgaagaggtgatgagatcccgctggtctcggaaaatgctgatgacagggacccttgctgtctttttcctgctcattatgggacagctgacatggaatgatctgatcagactttgcattatggtgggcgccaacgccagcgaccgcatgggcatggggaccacctacctggctctcatggccgcgtttaagatgagacctatgttcgctgtcggactgctctttcggcgcctgacatccagagaggtgcttctgctcacgatcggcctgtctctggtggccagcgtcgaacttcccaattccctggaggaactcggggatggactggccatgggcatcatgattctcaaactgcttaccgacttccaaagccatcagctgtgggctacactcctgtctctgacctttatcaagacaaccttctcccttcactatgcctggaaaacgatggctatggttctgagcattgtgtctctctttcccctgtgtctctccacaaccagccagaagaccacatggctgcctgtgcttctggggtctctgggatgcaagccgctcaccatgttcctgatcgccgagaacaaaatttggggccggcgctcctggccccttaatgaaggcatcatggcggtcgggatcgtgagcattctgctctccagcctgctcaagaacgatgttcctctggccggaccccttatcgctggcgggatgctgattgcctgttacgtgatctctggaagctccgctgacctgtctctcgagaaagccgccgaggtcagctgggaagaggaagctgagcattccggcgcgtctcacaacattctggtggaagttcaggatgacgggacaatgaagatcaaagatgaggagagagacgatacgcttaccatcctgctcaaggccacactgctcgctgtgagcggagtctatcctctgtccattcccgccaccctttttgtgtggtacttctggcagaagaagaagcagcggtctggcgtcctgtgggacacacctagccctcccgaagtggagcgcgccgttctggatgacggcatctatagaattatgcagcgggggctcctgggacgctcccaggtgggcgtcggggtgttccaagaaaatgtttttcataccatgtggcacgtgacgagaggagctgtccttatgtaccagggcaaacggctggagcccagctgggcctctgtgaagaaagacctcatctcctacgggggaggctggagactgcagggcagctggaacaccggggaggaagtgcaggttattgcggtcgagcccggaaagaatcctaaaaacgtgcaaacagctcccggcaccttcaagacaccggaaggggaggtgggagccatcgccctcgattttaagcctggcacctctgggtcccccattgtcaatcgcgaaggaaaaatcgtgggcctgtatggcaacggggttgtgacaacgagcggaacctacgtctccgctatcgcccaggcgaaggcttctcaggagggccctcttcccgagattgaagacgaggtgttccggaaaagaaatctgacaatcatggatctgcaccccgggagcggaaagacccgccggtatctccctgccattgttagagaagccatcaaacgcaagctgcggacccttattctggctccgacaagagtggtcgcctccgagatggctgaagccctcaagggcatgcccatccgctaccaaacgaccgcggtgaaaagcgagcatacagggaaggagatcgttgacctgatgtgccacgccacctttacaatgcggctgctctctcctgtgagagtccccaactataatatgattatcatggatgaagctcatttcaccgacccttccagcattgccgctcggggctacatctctacgcgcgtgggaatgggcgaggccgccgctatttttatgacagcgacaccccctgggagcgtggaagccttcccgcagtccaacgctgtcatccaggatgaggaaagagacatccccgagcggtcttggaatagcggatatgagtggattaccgattttcctggcaaaacagtttggttcgtgccctccatcaagtctgggaacgacattgccaattgtcttcgcaaaaacggaaagagagtgatccagctgagccggaagacctttgatacagaataccagaaaaccaagaataacgactgggactacgtcgtgacgacagatatttccgagatgggcgccaacttcagagctgaccgcgttatcgatcctcggagatgcctgaaacccgtgattctcaaggacgggccggaacgcgtcatcctggccggccctatgcccgtgaccgttgcgagcgctgcccagcggagaggacgcatcggccggaatcacaacaaagagggggatcagtatatttacatgggacagccccttaataacgacgaggatcatgcccactggacagaagctaagatgctgctcgacaatatcaacacccctgagggcattatccccgccctgttcgaacctgagagagaaaagtctgcggccattgatggggagtatcgcctgagaggagaggctcggaaaacgtttgtggaactcatgcgcagaggcgaccttccggtctggctgtcctacaaggtggccagcgaggggttccaatattccgatcggcgctggtgctttgacggcgaaagaaataaccaggtcctggaggaaaatatggatgtggagatctggaccaaagagggagaacggaagaaactcagaccccgctggctggacgctcggacatactctgaccctcttgccctgagagagttcaaggaatttgctgccggccgccggagcgtttccggggatctcatcctggagattggaaaactgccccagcacctcacccagagagcgcaaaacgcccttgacaatctggtgatgctgcataactctgaacagggcgggcgggcttatcgccacgccatcgaggagctccctgatacaattgaaaccctgatgcttctggctctcatcgccgtgctgacaggaggcgtcaccctgttctttctcagcggcagagggcttggaaagacgtccattggcctgctgtgtgttatggccagctctgtgctcctgtggatggcttccgtggagccccattggatcgcggccagcatcattcttgagttctttctgatggtcctcctgatcccggagcctgaccggcagcgcacaccccaggataatcaactggcttacgtggttattgggctccttttcatgatcctgaccgtggccgccaacgagatgggactgctcgaaaccacaaagaaagacctgggcattgggcacgtcgctgtggagaatcaccatcacgccgcgatgcttgatgtcgacctgcatcctgcctctgcttggaccctctacgccgtggctacaacgatcattacccccatgatgagacacacaatcgaaaacaccacagccaacatctccctgaccgcgattgccaatcaggctgccatcctgatgggactcgataagggctggcctattagcaaaatggacatcggcgttccccttctggctctggggtgctattctcaggtgaacccgctcacgctgaccgccgctgtccttatgctggtggcccattacgcgattatcggacctggcctccaagccaaggctacacgggaggcccagaaacgcaccgctgccgggatcatgaagaatcccacagttgatggaattgtggccatcgacctggatcccgtcgtgtatgacgcgaagtttgaaaaacagctgggccagattatgctccttatcctgtgtaccagccaaattctgctcatgagaacgacatgggctctgtgcgagtccatcacccttgccacagggcctctgaccaccctctgggagggatctccgggcaagttctggaacacaacgatcgctgtgagcatggccaatatttttcggggctcctacctggccggggctggactggccttcagcctcatgaaatcccttggcgggggacgcagaggcaccggggcgcagggagaaacactgggcgagaagtggaaacggcagctgaaccagctctctaagagcgagttcaatacctataagagatccggcatcatggaggttgaccgctctgaagccaaagaggggctgaagcggggagagacaaccaaacacgctgtcagcagaggcacggccaaacttcgctggtttgtggaacggaacctggtgaaacccgaggggaaggtcattgatctcggatgtggcagagggggatggtcctactattgcgctggcctgaagaaagttacagaagtgaagggctacaccaaagggggacctggccacgaggaacccatccctatggccacctacgggtggaatctggtgaagctccattctggaaaagacgtcttctttattccccctgagaagtgtgatacacttctgtgcgacatcggcgagagctccccgaaccccaccattgaagaggggcgcacactgcgggtgctcaaaatggttgaaccttggctgagaggaaatcaattctgtatcaagatccttaacccctatatgcctagcgtggtcgagacgctggagcagatgcagcgcaagcacggcggcatgctcgtgcggaatcccctgtctagaaactccacccatgaaatgtactgggttagctgcgggacaggaaatattgtgtctgcggtcaacatgacctcccgcatgctgctcaatcggtttacaatggcccacagaaaaccgacctatgagcgcgatgtggacctgggcgctgggacgagacacgtggccgtcgaacctgaggttgctaaccttgatatcattggacagcggatcgaaaacattaagcatgagcacaaaagcacctggcattacgacgaggataatccctataagacatgggcctaccacggctcttatgaagtgaaaccctccgggagcgcttccagcatggtgaacggagtcgtgaagctgctcaccaagccttgggacgttatccccatggtgacacaaatcgccatgaccgatacaacccctttcggccagcagcgcgtctttaaagagaaggtggacacgagaacaccgaaagcgaagcggggcaccgcccaaattatggaagttaccgctaaatggctgtgggggttcctttctagaaataagaagccccggatctgtacacgcgaggaatttacgagaaaagtgcggagcaacgccgctattggagccgtcttcgtggacgagaatcagtggaactccgccaaggaggcggttgaagatgagcgcttttgggacctggtgcatagagaacgggagctccacaaacagggcaagtgcgctacctgcgtctacaatatgatggggaaacgcgaaaagaagctgggagagttcggcaaagccaaggggtctagagccatctggtacatgtggctgggcgctcggtttctcgagttcgaagccctgggattcatgaacgaggatcactggtttagccgcgaaaattccctttctggcgtggagggggagggactgcataaactcggctatattctgagagacatcagcaagatccctgggggaaacatgtacgctgatgacacagccggctgggatacccggattacagaagacgatcttcagaatgaggcgcgcatcaccgacattatggaacccgagcacgccctgctcgctagatccatcttcaaactgacatatcaaaacaaggtcgtgcgggttcagcgccctgccaaaaatgggaccgtgatggatgtcatttctagacgggaccagagaggcagcggacaggtgggcacgtacgggctgaacacctttacaaatatggaagctcaactcatccgccagatggagtccgagggaatcttcagcccctctgaactggagaccccgaaccttgccgaacgggtgctggattggctcgagaagtatggcgttgaaagactgaagcgcatggcgatttccggggacgactgtgtggtcaaacctatcgatgaccggtttgccacagctcttaccgccctgaacgatatgggaaaggtgagaaaagacattccccagtgggagcctagcaagggctggaatgattggcagcaagttcccttctgctctcatcactttcaccagctcatcatgaaagacgggcgcgagattgtggtcccttgtcggaaccaggatgaactggtgggcagagctcgcgtctcccagggagccggctggagcctgcgggagacggcttgcctcgggaagtcctacgcccaaatgtggcagctgatgtatttccatagacgcgaccttcggctggcggccaatgctatctgttctgccgtgcccgttgattggattccgacaagcagaaccacatggtccatccacgcccatcaccagtggatgaccacggaagacatgctcagcgtgtggaaccgggtctggatcgaggaaaatccttggatggaggataagacccatatttcttcctggggagacgtgccctacctgggcaaaagagaggaccaatggtgcgggagccttatcggactgacagctcgcgccacctgggcgacaaacattcaggttgctatcaatcaggtgcggagactcattggcaacgaaaattacctggattatatgacctctatgaagcgctttaaaaacgagagcgaccccgaaggggccctgtggtga

SEQ ID NO: 19358 - RNA, 9879 nt, synthetic construct
  misc_feature 1..9879: note = derived and/or modified CDS sequence (opt5) from DENV-1__JQ045638__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagaccagcgccggcgttaacatgtgcacccttattgccatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagatgtccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggattggcgtgctgcttacctggctgggactcaattctagatccacaagcctgtctatgacctgtatcgctgttggcctggtgacactttacctcggggtcatggtgcaggccgattccggatgcgttattaactggaaaggccgcgaactgaagtgtgggagcggaatcttcgtgaccaatgaggtccacacatggaccgaacaatataagtttcaggctgactcccctaaacggctgtctgccgcgattggcaaggcctgggaggagggggtgtgcggcatcagaagcgctacgcgcctcgaaaacatcatgtggaaacagatttccaacgagctgaatcatatccttctggaaaacgacatgaagttcacagttgtggtcggagatgtggccggcattctcgctcaggggaaaaagatgatccggccgcaacccatggagtacaaatattcttggaaaagctggggaaaggccaagattatcggcgccgacgtgcagaataccacctttatcattgatgggcctaacacacccgaatgtcctgacgatcagagagcttggaatatctgggaggtcgaggactacggattcggcatttttaccacgaacatctggctgaagctgcgcgattcctatacacaggtttgcgaccaccggcttatgagcgcggccattaaagattctaaggctgtgcacgccgacatgggctactggatcgaatccgagaaaaatgaaacctggaagctcgccagagctagcttcatcgaggtgaagacatgtatttggcccaaatctcataccctgtggtccaacggggtcctggaaagcgagatgatcattccgaagatctatggaggccctatttctcaacacaattaccgccccgggtacttcacacagaccgccggaccttggcatctcggcaaactggagcttgattttgacctgtgcgaagggacgaccgtggttgtggatgagcactgcggaagccggggcccctccctcagaacaaccacagtcaccggcaagatcatccacgaatggtgttgccggagctgtacgctgcctcccctgcgcttcagaggggaggacggatgctggtatggcatggagattcggccggtgaaagaaaaggaggaaaaccttgttaagtctatggtgtccgcggggagcggagaggtcgactccctctctctgggcctgctctgtatcagcattatgatcgaagaggtgatgagatcccgctggtctcggaaaatgctgatgacagggacccttgctgtctttttcctgctcattatgggacagctgacatggaatgatctgatcagactttgcattatggtgggcgccaacgccagcgaccgcatgggcatggggaccacctacctggctctcatggccgcgtttaagatgagacctatgttcgctgtcggactgctctttcggcgcctgacatccagagaggtgcttctgctcacgatcggcctgtctctggtggccagcgtcgaacttcccaattccctggaggaactcggggatggactggccatgggcatcatgattctcaaactgcttaccgacttccaaagccatcagctgtgggctacactcctgtctctgacctttatcaagacaaccttctcccttcactatgcctggaaaacgatggctatggttctgagcattgtgtctctctttcccctgtgtctctccacaaccagccagaagaccacatggctgcctgtgcttctggggtctctgggatgcaagccgctcaccatgttcctgatcgccgagaacaaaatttggggccggcgctcctggccccttaatgaaggcatcatggcggtcgggatcgtgagcattctgctctccagcctgctcaagaacgatgttcctctggccggaccccttatcgctggcgggatgctgattgcctgttacgtgatctctggaagctccgctgacctgtctctcgagaaagccgccgaggtcagctgggaagaggaagctgagcattccggcgcgtctcacaacattctggtggaagttcaggatgacgggacaatgaagatcaaagatgaggagagagacgatacgcttaccatcctgctcaaggccacactgctcgctgtgagcggagtctatcctctgtccattcccgccaccctttttgtgtggtacttctggcagaagaagaagcagcggtctggcgtcctgtgggacacacctagccctcccgaagtggagcgcgccgttctggatgacggcatctatagaattatgcagcgggggctcctgggacgctcccaggtgggcgtcggggtgttccaagaaaatgtttttcataccatgtggcacgtgacgagaggagctgtccttatgtaccagggcaaacggctggagcccagctgggcctctgtgaagaaagacctcatctcctacgggggaggctggagactgcagggcagctggaacaccggggaggaagtgcaggttattgcggtcgagcccggaaagaatcctaaaaacgtgcaaacagctcccggcaccttcaagacaccggaaggggaggtgggagccatcgccctcgattttaagcctggcacctctgggtcccccattgtcaatcgcgaaggaaaaatcgtgggcctgtatggcaacggggttgtgacaacgagcggaacctacgtctccgctatcgcccaggcgaaggcttctcaggagggccctcttcccgagattgaagacgaggtgttccggaaaagaaatctgacaatcatggatctgcaccccgggagcggaaagacccgccggtatctccctgccattgttagagaagccatcaaacgcaagctgcggacccttattctggctccgacaagagtggtcgcctccgagatggctgaagccctcaagggcatgcccatccgctaccaaacgaccgcggtgaaaagcgagcatacagggaaggagatcgttgacctgatgtgccacgccacctttacaatgcggctgctctctcctgtgagagtccccaactataatatgattatcatggatgaagctcatttcaccgacccttccagcattgccgctcggggctacatctctacgcgcgtgggaatgggcgaggccgccgctatttttatgacagcgacaccccctgggagcgtggaagccttcccgcagtccaacgctgtcatccaggatgaggaaagagacatccccgagcggtcttggaatagcggatatgagtggattaccgattttcctggcaaaacagtttggttcgtgccctccatcaagtctgggaacgacattgccaattgtcttcgcaaaaacggaaagagagtgatccagctgagccggaagacctttgatacagaataccagaaaaccaagaataacgactgggactacgtcgtgacgacagatatttccgagatgggcgccaacttcagagctgaccgcgttatcgatcctcggagatgcctgaaacccgtgattctcaaggacgggccggaacgcgtcatcctggccggccctatgcccgtgaccgttgcgagcgctgcccagcggagaggacgcatcggccggaatcacaacaaagagggggatcagtatatttacatgggacagccccttaataacgacgaggatcatgcccactggacagaagctaagatgctgctcgacaatatcaacacccctgagggcattatccccgccctgttcgaacctgagagagaaaagtctgcggccattgatggggagtatcgcctgagaggagaggctcggaaaacgtttgtggaactcatgcgcagaggcgaccttccggtctggctgtcctacaaggtggccagcgaggggttccaatattccgatcggcgctggtgctttgacggcgaaagaaataaccaggtcctggaggaaaatatggatgtggagatctggaccaaagagggagaacggaagaaactcagaccccgctggctggacgctcggacatactctgaccctcttgccctgagagagttcaaggaatttgctgccggccgccggagcgtttccggggatctcatcctggagattggaaaactgccccagcacctcacccagagagcgcaaaacgcccttgacaatctggtgatgctgcataactctgaacagggcgggcgggcttatcgccacgccatcgaggagctccctgatacaattgaaaccctgatgcttctggctctcatcgccgtgctgacaggaggcgtcaccctgttctttctcagcggcagagggcttggaaagacgtccattggcctgctgtgtgttatggccagctctgtgctcctgtggatggcttccgtggagccccattggatcgcggccagcatcattcttgagttctttctgatggtcctcctgatcccggagcctgaccggcagcgcacaccccaggataatcaactggcttacgtggttattgggctccttttcatgatcctgaccgtggccgccaacgagatgggactgctcgaaaccacaaagaaagacctgggcattgggcacgtcgctgtggagaatcaccatcacgccgcgatgcttgatgtcgacctgcatcctgcctctgcttggaccctctacgccgtggctacaacgatcattacccccatgatgagacacacaatcgaaaacaccacagccaacatctccctgaccgcgattgccaatcaggctgccatcctgatgggactcgataagggctggcctattagcaaaatggacatcggcgttccccttctggctctggggtgctattctcaggtgaacccgctcacgctgaccgccgctgtccttatgctggtggcccattacgcgattatcggacctggcctccaagccaaggctacacgggaggcccagaaacgcaccgctgccgggatcatgaagaatcccacagttgatggaattgtggccatcgacctggatcccgtcgtgtatgacgcgaagtttgaaaaacagctgggccagattatgctccttatcctgtgtaccagccaaattctgctcatgagaacgacatgggctctgtgcgagtccatcacccttgccacagggcctctgaccaccctctgggagggatctccgggcaagttctggaacacaacgatcgctgtgagcatggccaatatttttcggggctcctacctggccggggctggactggccttcagcctcatgaaatcccttggcgggggacgcagaggcaccggggcgcagggagaaacactgggcgagaagtggaaacggcagctgaaccagctctctaagagcgagttcaatacctataagagatccggcatcatggaggttgaccgctctgaagccaaagaggggctgaagcggggagagacaaccaaacacgctgtcagcagaggcacggccaaacttcgctggtttgtggaacggaacctggtgaaacccgaggggaaggtcattgatctcggatgtggcagagggggatgggcttactattgcgccggcctgaagaaagttacagaagtgaagggctacaccaaagggggacctggccacgaggaacccatccctatggcgacctacgggtggaatctggtgaagctccattccggaaaagacgtcttctttattccccctgagaagtgtgatacacttctgtgcgacatcggcgagtctagcccgaaccccaccattgaagaggggcgcacactgcgggtgctcaaaatggttgaaccttggctgagaggaaatcaattctgtatcaagatccttaacccctatatgccttccgtggtcgagacgctggagcagatgcagcgcaagcacggcggcatgctcgtgcggaatcccctgagcagaaactctacccatgaaatgtactgggtttcctgcgggacaggaaatattgtgagcgccgtcaacatgacctctcgcatgctgctcaatcggtttacaatggctcacagaaaaccgacctatgagcgcgatgtggacctgggcgccgggacgagacacgtggctgtcgaacctgaggttgccaaccttgatatcattggacagcggatcgaaaacattaagcatgagcacaaatccacctggcattacgacgaggataatccctataagacatgggcttaccacggcagctatgaagtgaaaccctctgggtccgccagctccatggtgaacggagtcgtgaagctgctcaccaagccttgggacgttatccccatggtgacacaaatcgcgatgaccgatacaacccctttcggccagcagcgcgtctttaaagagaaggtggacacgagaacaccgaaagccaagcggggcaccgctcaaattatggaagttaccgccaaatggctgtgggggttccttagcagaaataagaagccccggatctgtacacgcgaggaatttacgagaaaagtgcggtctaacgctgccattggagccgtcttcgtggacgagaatcagtggaacagcgcgaaggaggctgttgaagatgagcgcttttgggacctggtgcatagagaacgggagctccacaaacagggcaagtgcgcgacctgcgtctacaatatgatggggaaacgcgaaaagaagctgggagagttcggcaaagccaaggggtccagagctatctggtacatgtggctgggcgcccggtttctcgagttcgaagctctgggattcatgaacgaggatcactggttttctcgcgaaaatagcctttccggcgtggagggggagggactgcataaactcggctatattctgagagacatctctaagatccctgggggaaacatgtacgccgatgacacagcgggctgggatacccggattacagaagacgatcttcagaatgaggcccgcatcaccgacattatggaacccgagcacgctctgctcgccagaagcatcttcaaactgacatatcaaaacaaggtcgtgcgggttcagcgccctgctaaaaatgggaccgtgatggatgtcatttccagacgggaccagagaggctctggacaggtgggcacgtacgggctgaacacctttacaaatatggaagcccaactcatccgccagatggagagcgagggaatcttctcccccagcgaactggagaccccgaaccttgcggaacgggtgctggattggctcgagaagtatggcgttgaaagactgaagcgcatggccatttctggggacgactgtgtggtcaaacctatcgatgaccggtttgctacagcccttaccgctctgaacgatatgggaaaggtgagaaaagacattccccagtgggagccttccaagggctggaatgattggcagcaagttcccttctgcagccatcactttcaccagctcatcatgaaagacgggcgcgagattgtggtcccttgtcggaaccaggatgaactggtgggcagagcccgcgtctctcagggagctggctggtccctgcgggagacggcctgcctcggaaagagctacgcgcaaatgtggcagctgatgtatttccatagacgcgaccttcggctggccgctaatgccatctgttccgccgtgcccgttgattggattccgacatctagaaccacatggagcatccacgctcatcaccagtggatgaccacggaagacatgctctccgtgtggaaccgggtctggatcgaggaaaatccttggatggaggataagacccatattagctcttggggagacgtgccctacctgggcaaaagagaggaccaatggtgcgggtcccttatcggactgacagcccgcgcgacctgggctacaaacattcaggttgccatcaatcaggtgcggagactcattggcaacgaaaattacctggattatatgaccagcatgaagcgctttaaaaacgagtctgaccccgaaggggccctgtggtga

SEQ ID NO: 19359 - RNA, 9879 nt, synthetic construct
  misc_feature 1..9879: note = derived and/or modified CDS sequence (opt5) from DENV-1__JQ045639__SS-prME
  source 1..9879: mol_type = other RNA
agcgtgaccatgttcctgatgctcatgcccaccgccctggcttttcaccttacgaccagaggcggggaacctcatatgatcgtgtccaagcaggaacggggaaaatctctcctgttcaagacaagcgccggcgttaacatgtgcaccctgatcgcgatggaccttggggagctgtgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggtgacacctagcatggccatgagatgcgtgggcattgggtcccgggatttcgttgagggacttagcggcgctacgtgggtggacgtggtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctacaaccgagatccagctgacagactacggcgccctcaccctggattgttctccccggacgggcctggactttaacgaaatggtgctcctgacaatgaaggagaaatcctggcttgtccataagcagtggttcctggatctccctctgccctggaccagcggggcctccacatctcaagagacctggaatcgccaggaccttctggtgacctttaaaacagctcacgcgaagaagcaggaagtcgtggttctcggaagccaagagggcgccatgcacacggctctgaccggggccacagaaattcagacctccggaacaaccacgatcttcgccggccatctgaaatgcagactcaagatggataaactgacacttaaggggatgagctatgtgatgtgtaccggctctttcaaactggagaaggaactcgctgagacccagcacggaacagtcctggtgcagattaagtacgagggcaccgacgccccgtgcaaaatccctttttccacacaagatgaaaagggggttacgcagaacggacggctgatcaccgcgaatcccattgtgacagacaaagagaagcctgtcaacatcgaagctgagccgcccttcggcgagagctatattgtgatcggggccggagaaaaagcccttaagctctcttggtttaagaaaggcagctccattgggaagatgttcgaggctaccgccagaggcgctcgccggatggccatcctgggagatacagcgtgggactttggctctatcgggggagtgttcaccagcgttggcaaactggtccatcagatttttgggacggcctacggagtcctgttctccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagtttaccgtggttgtgggagatgtcgccggcattctcgctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggctgaagctgcgcgattcctatacccaggtctgcgaccaccggcttatgagcgcggccattaaagattctaaggctgttcacgccgacatgggctactggatcgaatccgagaaaaatgaaacatggaagctcgccagagctagcttcatcgaggtgaagacctgtatttggcccaaatctcatacactgtggtccaacggggtgctggaaagcgagatgatcattccgaagatctatggaggccctatttctcaacacaattaccgccccgggtactttacccagacggccggaccttggcatctcggcaaactggagcttgatttcgacctgtgcgaagggaccacagtcgtggttgatgagcactgcggaaaccggggccccagcctcagaaccacaaccgtgacgggcaagatcatccacgaatggtgttgccggtcctgtacactgcctcccctgcgctttagaggggaggacggatgctggtatggcatggagattcggccggtcaaagaaaaggaggaaaatcttgtcaagagcatggtttctgcggggtccggagaggtggacagcttctccctcggcctgctgtgtatctctattatgatcgaagaggtcatgagaagccgctggtcccggaaaatgctcatgaccgggacactggctgtgtttttccttctgattatgggacagctcacctggaacgatctgatcagactgtgcattatggttggcgccaatgcctctgaccgcatgggcatggggaccacataccttgctctgatggccacgtttaagatgagacctatgttcgcggtgggactcctgtttcggcgcctcaccagcagagaggtcctgcttctgacaatcggcctctccctggtggcttctgtggaactgcccaacagccttgaggaactgggggatggactcgccatgggcatcatgattctgaaactcctgaccgacttccaatcccatcagctttgggccacactgctcagcctgacctttatcaagacgacattctctctgcactatgcttggaaaaccatggccatggtcctttccattgttagcctgtttcccctctgtctgtctaccacatcccagaagaccacatggctccctgtgctgcttgggagcctgggatgcaagccgctgacgatgttcctcatcgctgagaataaaatttggggccggcgctcttggcccctgaacgaaggcatcatggccgtggggatcgtctccattcttctgagctccctcctgaagaacgatgtgcctctcgcgggacccctgatcgccggcgggatgcttattgcttgttacgttatcagcggatctagcgccgacctgtccctggagaaagctgccgaggtgtcttgggaagaggaagccgagcatagcggcgcttcccacaatattctcgtcgaagtgcaggatgacgggaccatgaagatcaaagatgaggagagagacgatacactgaccatccttctgaaggcgacactcctggccgtttctggagtgtatcctctcagcattcccgctaccctgttcgtctggcatttttggcagaagaagaagcagcggtccggcgtgctttgggacacgccttctcccccggaagtcgagcgcgccgtgctggatgacggcatctacagaattatgcagcgggggctgctcggacgcagccaggttggcgtgggggtcttccaagaaaacgtgtttcacaccatgtggcacgttacaagaggagccgtgctgatgtatcagggcaaacggcttgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctctacggcaatggggtggttaccacatccggaacctatgtgagcgccatcgctcaggcccgggcgtcccaggagggccctctgcccgagattgaagacgaggtcttcagaaagcgcaaccttaccatcatggatctgcatcccgggtctggaaaaacacggagatacctgcctgctattgtgcgcgaagccatcaagcggaaactcagaacgctgattcttgccccgacccgcgttgtggctagcgagatggccgaagctctgaagggcatgcccatccggtatcaaacaaccgccgtcaagtccgagcacacagggaaagagatcgtggacctcatgtgccatgcgacctttacgatgagactgctgagccctgttcgggtgcccaattacaacatgattatcatggatgaagcccacttcacagacccttcttccattgctgcccgcggctatatcagcaccagagtcggaatgggcgaggctgccgccatttttatgaccgctacaccccctgggtctgtggaagcgttcccgcagagcaatgccgtgatccaggatgaggaacgggacatccccgagcgctcctggaactctggatacgagtggattaccgattttcctggcaagacagtctggttcgttcccagcatcaaatccgggaatgacattgctaactgtctcagaaagaatggaaaacgggtgatccagctttctagaaagaccttcgatacggaatatcaaaagaccaagaacaacgactgggactacgtggtcaccacagatattagcgagatgggcgccaattttcgcgccgaccgggtgatcgatcctagacgctgcctgaagcccgttattctgaaagacgggccggaacgggtgatcctcgctggccctatgcccgtcaccgtggcctccgcggctcagagacgcggacggatcggcagaaaccataataaggagggggatcagtacatttatatgggacagcccctgaacaatgacgaggatcacgcccactggacggaagccaaaatgcttctggacaacatcaatacccctgagggcattatccccgctctcttcgaacctgagcgcgaaaagagcgccgcgattgatggggagtacagactgcggggagaggcccgcaagacatttgttgaactgatgagacggggcgacctcccggtgtggctttcttataaagtcgcttccgaggggttccaatacagcgatcgcagatggtgctttgacggcgaacggaacaatcaggtgctggaggaaaacatggatgtcgagatctggaccaaggagggagaacgcaaaaagctgcgcccccggtggctcgacgccagaacatattccgaccctctggctcttagagagttcaaagaatttgccgctggccggagatctgtgagcggggatctgatcctcgagattggaaagctgccccagcatctgacccagcgggcccaaaatgcgctcgacaaccttgttatgctgcacaattccgaacagggcgggcgcgcctacagacatgctatggaggagctgcctgatacaatcgaaaccctcatgctgcttgccctgattgctgtgctcacgggaggcgtgacactgttctttctgtctggccgggggctcggaaaaaccagcatcggccttctgtgtgtcatggcctccagcgccctgctctggatggcttctgttgagccccactggattgcggcctccatcatcctggagttctttcttatggtgctgctcattccggagcctgaccgccagagaacaccccaggataaccaactggcttatgtggtcatcgggctcctcttcatgattcttacagtggccgccaatgagatgggactgctggaaaccacaaagaaggacctcggcatcgggcacgctgccgttgagaaccatcaccatgcggccatgctggatgtggaccttcaccctgctagcgcctggacgctgtacgctgtcgccaccacaattatcacccccatgatgcggcatacaattgaaaacaccacggcgaatatctctctcaccgccatcgctaaccaggccgctattctgatgggactggataaaggctggcctatctccaagatggacattggcgtgcccctccttgccctggggtgctacagccaggtcaatccgctgacactcaccgctgccgtgctgatgcttgttgcgcactatgccatcattggacctggcctgcaagctaaagccacacgcgaggctcagaagagaaccgccgccgggatcatgaaaaaccccacggtggatggaatcgtcgcgattgacctcgatcccgtggtttacgacgctaagtttgaaaagcagctgggccagatcatgctgctcattctttgtacatctcaaatcctgctgatgcggaccacatgggccctctgcgagagcattaccctggctaccgggcctcttacaacgctgtgggagggatccccgggcaaattctggaataccacaatcgccgtgtctatggccaacatcttccgcggcagctatctcgctggggccggactggcgttttccctgatgaaaagcctcggcgggggaagacggggcaccggggcccagggagaaacacttggcgagaaatggaagagacagctgaatcagctgtccaaatctgagttcaacacctacaagcgcagcggcattatggaggtcgaccggtccgaagctaaggaggggctcaaaagaggagagacgacaaagcacgccgtgtctcgcggcaccgctaaactgcggtggtttgtggaaagaaatcttgttaagcccgaggggaaagtcatcgatctgggatgtggccgcgggggatggagctattactgcgccggcctcaagaaggtgaccgaagtgaaaggctatacaaaagggggacctggccatgaggaacccattcctatggcgacctacgggtggaacctggtcaaactgcactccggaaaggacgttttctttattccccctgagaaatgtgatacactcctttgcgacattggcgagtctagcccgaatcccacgatcgaagaggggcggaccctgagagtgctgaagatggtggaaccttggctccgcggaaaccaattctgtattaaaatcctgaatccctacatgccttccgtcgtggagacacttgagcagatgcagcggaagcatggcggcatgctggttagaaaccccctcagccgcaattctacccacgaaatgtattgggtgtcctgcgggacaggaaacatcgtcagcgccgtgaatatgacctctcggatgctgctgaacagatttacgatggctcaccgcaagccgacctacgagagagatgttgacctcggcgccgggacacggcatgtggctgtcgaacctgaggtggccaacctggatattatcggacagcgcattgaaaatatcaaacacgagcataagtccacctggcactatgacgaggataacccctacaaaacatgggcttatcatggcagctacgaagtgaagccctctgggtccgccagctccatggtcaatggagttgtgaaacttctgaccaagccttgggacgtgattcccatggtcacacaaatcgcgatgaccgatacgacacctttcggccagcagagagtgtttaaggagaaagttgacacccggaccccgaaggccaaaagaggcacagctcaaatcatggaagtgacggccaagtggctctgggggttcctgagccggaacaaaaagccccgcatttgtaccagagaggaatttacacggaaggtccgctctaatgctgccatcggagccgtgttcgttgacgagaaccagtggaatagcgcgaaagaggctgtggaagatgagagattttgggaccttgtccaccgggaacgcgagctgcacaagcagggcagatgcgctacctgcgtgtataacatgatggggaaacgggaaaagaaactcggagagttcggcaaggccaaggggtcccgcgctatttggtacatgtggctgggcgccagattcctggagtttgaagctctcggattcatgaatgaggatcattggttttctcgggaaaacagcctgtccggcgttgagggggagggacttcacaaactgggctacatcctccgcgacatttctaagatccctgggggaaatatgtatgccgatgacacagcgggctgggataccagaatcacagaagacgatctgcagaacgaggcccggattaccgacatcatggaacccgagcatgcccttctggccaaaagcattttcaagctcacgtaccaaaataaagtggtccgcgtgcagagacctgctaagaacgggaccgtcatggatgtgatctcccggagagaccagcgcggctctggacaggttggcacatatgggctgaatacctttacaaacatggaagcccaactgattcggcagatggagagcgagggaatcttctcccccagcgaactcgagaccccgaacctggcggaaagagtgcttgattggctggagaaatacggcgtcgaacgcctcaagcggatggccatctctggggacgactgtgtggtgaagcctattgatgacagatttgctacggccctgacagctcttaatgatatgggaaaagttcgcaaggacatcccccagtgggagccttccaaaggctggaacgattggcagcaagtgcccttctgcagccaccactttcatcagctgattatgaaggacgggcgggagatcgtcgtgccttgtagaaatcaggatgaactcgttggccgcgcccgggtgtctcagggagctggctggtccctgagagagaccgcctgcctggggaaaagctatgcgcaaatgtggcagctcatgtacttccaccgccgggacctgagacttgccgctaacgccatttgttccgccgtccccgtggattggatcccgacatctcggaccacgtggagcattcatgctcaccatcagtggatgaccacagaagacatgctgtccgtctggaatagagtgtggatcgaggaaaacccttggatggaggataagacccacatcagctcttgggaggacgttccctatctcggaaagcgcgaagaccaatggtgcggctccctgattgggcttacagcccgggcgacctgggctacaaatatccaggtggccattaaccaggtcagacgcctgatcggaaatgagaactacctcgattacatgaccagcatgaaaagatttaagaatgaatctgaccccgagggcgccctgtggtga

SEQ ID NO: 19360 - RNA, 9879 nt, synthetic construct
  misc_feature 1..9879: note = derived and/or modified CDS sequence (opt5) from DENV-1__JQ045641__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaagtctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttgcgcagaacggacggcttatcacggctaatcccattgtgaccgacaaagagaagcctgtcaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgttggcaaactcgtccatcagattttcgggaccgcttacggagtgctgttttccggcgtgagctggacgatgaagatcgggattggcgtccttctgacctggctcggactcaattctagatccacaagcctgtctatgacctgtatcgccgtgggccttgttacactctacctgggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctctctgcggccattggcaaggcttgggaggagggggtctgcggcatcagaagcgccacgcgcctggaaaacatcatgtggaaacagatttccaacgagcttaatcatatcctgctcgaaaacgacatgaagttcacagtggttgtgggagatgtcgctggcattctggcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatatctgggaggtggaggactacggattcggcatttttaccacgaacatctggctgaaacttcgcgattcctatacacaggtctgcgaccaccggctcatgagcgccgctattaaagattctaaggccgttcacgccgacatgggctactggatcgaatccgagaaaaatgaaacctggaagctggctagagccagcttcatcgaggtgaagacatgtatttggcccaaatctcataccctgtggtccaacggggtgctcgaaagcgagatgatcattccgaagatctatggaggccctatttctcaacacaattaccgccccgggtacttcacacagaccgcgggaccttggcatctgggcaaacttgagctggattttgacctctgcgaagggacgaccgtcgtggttgatgagcactgcggaaaccggggccccagcctgagaacaaccacagtgaccggcaagatcatccacgaatggtgttgccggtcctgtacgctgcctccccttcgcttcagaggggaggacggatgctggtatggcatggagattcggccggtcaaagaaaaggaggaaaatctcgtcaagagcatggtttctgctgggtccggagaggtggacagcttttccctgggcctgctctgtatctctattatgatcgaagaggtcatgagaagccgctggtcccggaaaatgctgatgacagggacccttgccgtgttctttctgctcattatgggacagctgacatggaacgatctgatcagactttgcattatggttggcgccaatgcttctgaccgcatgggcatggggaccacctacctggccctcatggcgacattcaagatgagacctatgtttgctgtgggactgctgttccggcgcctgacgagcagagaggtccttctgctcaccatcggcctgtccctggtggcctctgtggaacttcccaacagcctggaggaactcggggatggactggccatgggcatcatgattctcaaactgcttacagactttcaatcccatcagctgtgggctaccctcctgagcctgacattcatcaagaccacgctttctctgcactatgcctggaaaacaatggctatggtcctctccattgttagcctgtttcccctctgtctgtctaccacctcccagaagacaacctggcttcctgtgctgctggggagcctcggatgcaagccgctgacaatgttccttatcgccgagaataaaatttggggccggcgctcttggcccctgaacgaaggcatcatggcggtggggatcgtctccattctcctgagctccctcctgaagaacgatgtgcctcttgccggacccctgatcgctggcgggatgctgattgcctgttacgttatcagcggatctagcgctgacctctccctggagaaagccgccgaggtgtcttgggaagaggaagctgagcatagcggcgcgtcccacaatattcttgtcgaagtgcaggatgacgggacgatgaagatcaaagatgaggagagagacgataccctgacaatcctcctgaaggccaccctcctggctgtttctggagtgtatcctcttagcattcccgccacactgtttgtctggtacttctggcagaagaagaagcagcggtccggcgtgctgtgggacaccccttctcccccggaagtcgagcgcgccgtgctcgatgacggcatctatagaattatgcagcgggggctgcttggacgcagccaggttggcgtgggggtcttccaagaaaacgtgtttcatacgatgtggcacgttaccagaggagctgtgctgatgtaccagggcaaacggctcgagccttcctgggccagcgtcaagaaagacctgatctcttacgggggaggctggagactccagggctcctggaatacaggggaggaagtccaggtgattgcggttgagcccggaaagaaccctaaaaatgtccaaaccgctcccggcacattcaagaccccggaaggggaggtgggagccatcgccctggattttaagcctggcacaagcgggtctcccattgtgaaccgcgaaggaaaaatcgtcggcctttatggcaatggggtggttacgacctccggaacatacgtgagcgctatcgcccaggcgaaggcttcccaggagggccctctgcccgagattgaagacgaggtcttccggaaaagaaacctgaccatcatggatctccaccccgggtctggaaagacccgccggtatctgcctgccattgtgagagaagccatcaaacgcaaacttcggacactgattctcgctccgacgagagttgtggccagcgagatggctgaagccctgaagggcatgcccatccgctaccaaaccacagcggtcaaatccgagcataccgggaaggagatcgtggacctgatgtgccacacaacctttacgatgcggctccttagccctgttagagtgcccaattataacatgattatcatggatgaagcccatttcacagacccttcttccattgctgcccggggctacatcagcacccgcgtcggaatgggcgaggctgccgccatttttatgaccgctacaccccctgggtctgtggaagcgttcccgcagagcaatgccgtgatccaggatgaggaaagagacatccccgagcggtcctggaactctggatatgagtggattaccgattttcctggcaaaacagtctggttcgttcccagcatcaagtccgggaatgacattgctaactgtctgcgcaaaaatggaaagagagtgatccagctgtctcggaagacctttgatacggaataccagaagaccaagaacaacgactgggactacgtggtcaccacagatattagcgagatgggcgccaatttcagagccgaccgcgtgatcgatcctcggagatgcctcaaacccgttattctgaaggacgggccggaacgcgtgatccttgctggccctatgcccgtcaccgtggcctccgcggctcagcggagaggacgcatcggccggaaccacaataaagagggggatcagtatatttacatgggacagcccctgaacaatgacgaggatcatgcccactggacggaagccaagatgctcctggacaacatcaatacccctgagggcattatccccgctctgttcgaacctgagagagaaaagagcgccgcgattgatggggagtatcgcctcagaggagaggcccggaaaacatttgttgaacttatgcgcagaggcgacctgccggtgtggctgtcttacaaggtcgcttccgaggggttccaatatagcgatcggcgctggtgctttgacggcgaaagaaacaatcaggtgctcgaggaaaacatggatgtcgagatctggaccaaagagggagaacggaagaaactgagaccccgctggcttgacgcccggacatactccgaccctctggctctcagagagttcaaggaatttgccgctggccgccggtctgtgagcggggatctgatcctggagattggaaaactcccccagcaccttacccagagagcccaaaatgcgctggacaacctggttatgctccataattccgaacagggcgggcgggcctatcgccacgctatggaggagctgcctgatacaatcgaaacccttatgctgctcgccctgattgctgtgctgacgggaggcgtgacactcttctttctttctggcagagggctgggaaagaccagcatcggcctgctctgtgtcatggcctccagcgttctgctttggatggcctctgtggagccccattggattgctgcgtccatcatcctggagttctttctcatggtgctgctgattccggagcctgaccggcagcgcacaccccaggataaccaactcgcctacgtcgtgatcgggcttctgttcatgattctgacagttgctgccaatgagatgggactcctggaaaccacaaagaaagaccttggcatcgggcacgtggccgtcgagaaccaccatcacgctgccatgctggatgtggacctccatcctgcgagcgcctggacgctgtacgctgtcgccaccacaattatcacccccatgatgagacacacaattgaaaacaccacggctaatatctctctgaccgccatcgcgaaccaggccgctattctcatgggacttgataagggctggcctatctccaaaatggacattggcgtgcccctgctggccctcgggtgctatagccaggttaatccgctgacacttaccgctgccgtgctgatgctcgtcgctcattacgccatcattggacctggcctgcaagcgaaggccacacgggaggctcagaaacgcaccgccgctgggatcatgaagaaccccacggtggatggaatcgttgccattgacctggatcccgtggtctatgacgccaagtttgaaaaacagctcggccagatcatgcttctgattctgtgtacatctcaaatcctcctgatgagaaccacatgggcgctttgcgagagcattaccctggctaccgggcctctcacaacgctgtgggagggatccccgggcaagttctggaataccacaatcgccgtgtctatggctaacatctttcggggcagctacctggccggggccggactcgctttctcccttatgaaaagcctgggcgggggacgcagaggcaccggggcccagggagaaacactgggcgagaagtggaaacggcagctcaatcagctgtccaagtctgagttcaacacctataagagaagcggcattatggaggtggaccgctccgaagcgaaagaggggcttaagcggggagagacgacaaaacacgccgtttctagaggcaccgctaagctgcgctggtttgtcgaacggaatctcgtgaaacccgaggggaaggtgatcgatctgggatgtggcagagggggatggagctactattgcgccggcctgaagaaagtcaccgaagttaagggctacacaaaagggggacctggccacgaggaacccattcctatggctacctacgggtggaacctcgtgaaacttcattccggaaaagacgtgttctttattccccctgagaagtgtgatacactgctgtgcgacatcggcgagtctagcccgaatcccacgatcgaagaggggcgcaccctccgggtcctgaaaatggtggaaccttggcttagaggaaaccaattctgtattaagatcctgaatccctatatgccttccgttgtggagacactcgagcagatgcagcgcaagcacggcggcatgctggtccggaaccccctgagcagaaattctacccatgaaatgtactgggtgtcctgcgggacaggaaacatcgttagcgccgtgaatatgacctctcgcatgctcctgaaccggtttacgatggcgcacagaaaaccgacctatgagcgcgatgtcgaccttggcgccgggacaagacacgtggctgtggaacctgaggtcgccaacctggatattatcggacagcggattgaaaatatcaagcatgagcacaaatccacctggcattacgacgaggataacccctataagacatgggcttaccacggcagctatgaagttaaaccctctgggtccgccagctccatggtgaatggagtggtcaagctcctgaccaagccttgggacgtgattcccatggttacacaaatcgctatgaccgatacgacacctttcggccagcagcgcgtgtttaaagagaaggtcgacaccagaaccccgaaagccaagcggggcacagcgcaaatcatggaagtgacggccaaatggctttgggggttcctgagcagaaacaagaagccccggatttgtacccgcgaggaatttacaagaaaagttcggtctaatgctgccatcggagctgtgttcgtcgacgagaaccagtggaatagcgccaaggaggccgtggaagatgagcgcttttgggacctcgttcatagagaacgggagctgcacaaacagggcaagtgcgcgacctgcgtgtacaacatgatggggaaacgcgaaaagaagctgggagagttcggcaaagctaaggggtccagagccatttggtacatgtggctcggcgcccggtttctggagttcgaagctcttggattcatgaatgaggatcactggttttctcgcgaaaacagcctgtccggcgtcgagggggagggactccataaactgggctatatccttagagacatttctaagatccctgggggaaatatgtacgccgatgacacagctggctgggatacccggatcacagaagacgatctgcagaacgaggcccgcattaccgacatcatggaacccgagcacgcgctcctggccaaaagcattttcaagctgacgtatcaaaataaagtggtcagagtgcagcggcctgctaagaacgggaccgttatggatgtgatctcccgcagagaccagcggggctctggacaggtcggcacatacgggctcaatacctttacaaacatggaagcccaactgattagacagatggagagcgagggaatcttctcccccagcgaacttgagaccccgaacctggctgaacgcgtgctcgattggctggagaagtatggcgtggaacggcttaaaagaatggccatctctggggacgactgtgttgtgaagcctattgatgaccgctttgcgacggccctgacagctctcaatgatatgggaaaagtccggaaggacatcccccagtgggagccttccaaaggctggaacgattggcagcaagtgcccttctgcagccatcactttcaccagctgattatgaaggacgggagagagatcgttgtgccttgtcgcaatcaggatgaactggtcggccgggccagagtgtctcagggagctggctggtccctccgcgagaccgcctgcctgggaaagagctacgctcaaatgtggcagcttatgtatttccatcggagagacctgcgcctcgccgcgaacgccatttgttccgctgtccccgtggattggatcccgacatctcggaccacgtggagcattcacgcccatcaccagtggatgaccacagaagacatgctgtccgtttggaatagagtgtggatcgaggaaaacccttggatggaggataaaacccatatcagctcttggggagacgtcccctaccttggcaagcgggaggaccaatggtgcgggtccctgattggactcacagccagagctacctgggccacaaatatccaggtggcgattaaccaggttcgccggctgatcggcaatgaaaactacctggattatatgaccagcatgaaaagatttaagaatgagtctgaccccgaaggggctctctggtga

SEQ ID NO: 19361 - RNA, 9879 nt, synthetic construct
  misc_feature 1..9879: note = derived and/or modified CDS sequence (opt5) from DENV-1__JQ045642__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtgtgaaaacctgaaatactccgtgatcgtcaccgtgcacacaggcgaccagcatcaagttgggaatgagagcaccgaacacggaacaaccgccacgattacaccccaagctcctaccaccgagatccagctcacagactatggcgccctgaccctggattgctctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgtagactgaagatggataaacttacactgaaggggatgagctacgtgatgtgcaccggctctttcaaactcgagaaggaagtcgctgagacccagcacggaacagtgctggttcagattaagtatgagggcaccgacgccccgtgtaaaatccctttctccacacaagatgaaaagggggtgacgcagaacggacggctgatcaccgcgaatcccattgtcacagacaaagagaagcctgtgaacatcgaagctgagccgccctttggcgagagctacattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctatggagtgctcttttccggcgtcagctggaccatgaagatcgggattggcgtgctgcttacatggctgggactcaattctagatccaccagcctgtctatgacatgcatcgctgttggcctggtgaccctttacctcggggtcatggtgcaggccgattccggatgtgttattaactggaaaggccgcgaactgaagtgcgggagcggaatcttcgtgacaaatgaggtccacacctggacggaacaatacaagtttcaggctgactcccctaaacggctgtctgccgcgattggcaaggcctgggaggagggggtgtgtggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtataaatactcttggaaaagctggggaaaggccaagattatcggcgccgacgtgcagaataccacatttatcattgatgggcctaacacccccgaatgccctgacgatcagagagcttggaatatctgggaggtcgaggactatggattcggcatttttacgacaaacatctggctgaagctgcgcgattcctacacccaggtttgtgaccaccggcttatgagcgcggccattaaagattctaaggctgtgcacgccgacatgggctattggatcgaatccgagaaaaatgaaacatggaagctcgccagagctagcttcatcgaggtgaagacctgcatttggcccaaatctcatacactgtggtccaacggggtcctggaaagcgagatgatcattccgaagatctacggaggccctatttctcaacacaattatcgccccgggtacttcacccagacggccggaccttggcatctcggcaaactggagcttgattttgacctgtgcgaagggaccacagtggttgtggatgagcactgtggaaaccggggccccagcctcagaaccacaaccgtcacgggcaagatcatccacgaatggtgctgtcggtcctgcacactgcctcccctgcgcttcagaggggaggacggatgttggtacggcatggagattcggccggtgaaagaaaaggaggaaaatcttgttaagagcatggtgtctgcggggtccggagaggtcgacagcttttccctcggcctgctgtgcatctctattatgatcgaagaggtgatgagaagccgctggtcccggaaaatgctcatgaccgggacactggctgttttctttcttctgattatgggacagctcacctggaacgatctgatcagactgtgtattatggtgggcgccaatgcctctgaccgcatgggcatggggaccacatatcttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactacgcttggaaaaccatggccatggttctttccattgtgagcctgttccccctctgcctgtctaccacatcccagaagaccacatggctccctgtgctgcttgggagcctgggatgtaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgctatgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctaccctctcagcattcccgctaccctgttcgtgtggtatttctggcagaagaagaagcagcggtccggcgtcctttgggacacgccttctcccccggaagtgggccgcgccgttctggatgacgggatctacagaattatgcagcggggactgctcggccgcagccaggtgggggtcggagtgtttcaagagaacgttttccataccatgtggcacgtgacaagaggcgccgtcctgatgtatcaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctacgggaatggagttgtgaccacatccggcacctatgtcagcgccatcgctcaggccaaggcgtcccaggaagggcctctgcccgagattgaggacgaagtgtttcggaaaagaaaccttaccatcatggatctgcaccccggatctggcaagacacgccggtacctgcctgctattgttagagaggccatcaaacgcaagctccggacgctgattcttgccccgaccagagtggtcgctagcgaaatggccgaggctctgaaggggatgcccatccgctatcaaacaaccgccgtgaaatccgaacatacaggcaaggagatcgttgacctcatgtgtcacgcgaccttcacgatgcggctgctgagccctgtgagagtccccaattacaacatgattatcatggatgaggcccattttacagacccttcttccattgctgcccggggatatatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctacgagtggattaccgatttccctgggaaaacagtttggtttgtgcccagcatcaagtccggaaatgacattgctaactgcctccgcaaaaatggcaagagagtgatccagctttctcggaagaccttcgatacggagtatcagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtacatttatatgggccagcccctgaacaatgacgaggatcatgcccactggacggaggccaagatgcttctggacaacatcaatacccctgaagggattatccccgctctctttgagcctgaaagagaaaagagcgccgcgattgatggagaataccgcctgagaggcgaggcccggaaaacattcgtggagctgatgcgcagaggggacctcccggtctggctttcttataaggtggcttccgaaggctttcaatacagcgatcggcgctggtgtttcgacggagagagaaacaatcaggtcctggaagagaacatggatgtggaaatctggaccaaagagggcgagcggaagaaactgagaccccgctggctcgacgcccggacatattccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctaccgccacgctatggaggaactgcctgatacaatcgagaccctcatgctgcttgccctgattgctgtgctcacgggcggcgtcacactgtttttcctgtctgggagaggactcggcaagaccagcatcgggcttctgtgcgttatggcctccagcgtgctgctctggatggcctctgtggaaccccattggattgctgcgtccatcatcctggagtttttccttatggtcctgctcattccggaacctgaccggcagcgcacaccccaggataaccaactggcctatgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgttacagccaggtgaatccgctgacactcaccgctgccgtcctgatgcttgtggctcattatgccatcattggccctgggctgcaagcgaaggccacacgggaagctcagaaacgcaccgccgctggaatcatgaagaaccccacggttgatggcatcgtggccattgacctcgatcccgtcgtgtacgacgccaagttcgagaaacagctggggcagatcatgctgctcattctttgcacatctcaaatcctgctgatgagaaccacatgggcgctctgtgaaagcattaccctggctaccggacctcttacaacgctgtgggagggctccccgggcaagttttggaataccacaatcgccgtgtctatggctaacatcttccgggggagctatctcgccggagccggcctggctttctccctgatgaaaagcctcgggggaggccgcagagggaccggagcccagggcgagacacttggcgaaaagtggaaacggcagctgaatcagctgtccaagtctgagtttaacacctacaagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcatcgatctgggctgcgggagaggaggctggagctattactgtgccggcctcaagaaagttaccgaggtgaaggggtatacaaaaggaggccctgggcacgaggagcccattcctatggctacctacggatggaacctggtgaagctgcattccggcaaagacgtctttttcattccccctgaaaagtgcgatacactcctttgtgacattggggagtctagcccgaatcccacgatcgaggaaggacgcaccctgcgggtgctgaaaatggttgagccttggctcagaggcaaccaattttgcattaagatcctgaatccctacatgccttccgtggtcgaaacacttgagcagatgcagcgcaagcacggcgggatgctggtgcggaaccccctcagcagaaattctacccatgagatgtattgggtttcctgtggaacaggcaacatcgtgagcgccgtcaatatgacctctcgcatgctgctgaaccggttcacgatggcgcacagaaaaccgacctacgaacgcgatgtggacctcggggccggaacaagacacgtggctgtcgagcctgaagttgccaacctggatattatcggccagcggattgagaatatcaagcatgaacacaaatccacctggcattatgacgaggataacccctacaagacatgggcttatcacgggagctacgaggtgaaaccctctggatccgccagctccatggtgaatggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgagcagaaacaagaagccccggatttgcacccgcgaagagttcacaagaaaagtgcggtctaatgctgccatcggcgctgtctttgtggacgaaaaccagtggaatagcgccaaggaggccgttgaggatgaacgcttctgggaccttgtgcatagagagcgggaactgcacaaacaggggaagtgcgcgacctgtgtctataacatgatgggaaaacgcgagaagaagctcggcgaatttgggaaagctaagggctccagagccatttggtacatgtggctgggagcccggttcctggagttcgaggctctcggctttatgaatgaagatcactggttctctcgcgagaacagcctgtccggggtggaaggagagggccttcataaactggggtacatcctcagagacatttctaagatccctggaggcaatatgtatgccgatgacacagctgggtgggatacccggatcacagaggacgatctgcagaacgaagcccgcattaccgacatcatggagcccgaacacgcgcttctggccaaaagcatttttaagctcacgtaccaaaataaagtcgtgagagttcagcggcctgctaagaacggcaccgtgatggatgtcatctcccgcagagaccagcggggatctggccaggtggggacatatggactgaataccttcacaaacatggaggcccaactgattagacagatggaaagcgagggcatcttttcccccagcgagctcgaaaccccgaacctggctgagcgcgtgcttgattggctggaaaagtacggggttgagcggctcaaaagaatggccatctctggagacgactgcgtggtcaagcctattgatgaccgcttcgcgacggccctgacagctcttaatgatatgggcaaagtgcggaaggacatcccccagtgggaaccttccaaagggtggaacgattggcagcaagttcccttttgtagccatcacttccaccagctgattatgaaggacggcagagagatcgtggtcccttgccgcaatcaggatgagctcgtgggacgggccagagtctctcagggcgctgggtggtccctgcgcgaaaccgcctgtctgggaaagagctatgctcaaatgtggcagctcatgtactttcatcggagagacctgcgccttgccgcgaacgccatttgctccgctgtgcccgttgattggatcccgacatctcggaccacgtggagcattcacgcccatcaccagtggatgaccacagaggacatgctgtccgtgtggaatagagtctggatcgaagagaacccttggatggaagataaaacccatatcagctcttggggcgacgtgccctatctcgggaagcgggaggaccaatggtgtggatccctgattggccttacagccagagctacctgggccacaaatatccaggttgcgattaaccaggtgcgccggctgatcgggaatgagaactacctcgattacatgaccagcatgaaaagattcaagaatgaatctgaccccgagggcgctctgtggtga

SEQ ID NO: 19362 - RNA, 9879 nt, synthetic construct
  misc_feature 1..9879: note = derived and/or modified CDS sequence (opt5) from DENV-1__JQ045644__SS-prME
  source 1..9879: mol_type = other RNA
agcgtgaccatgctgctcatgctgatgcccaccgcccttgctttccacctgacgaccagaggcggggaacctcatatgatcgtctccaagcaggaacgggggaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccgcgttcaagatgagacctatgtttgctgtcggactcctgttccggcgcctcacgagcagagaggtgctgcttctgaccatcggcctctccctggtggcctctgtcgaactgcccaacagccttgaggaactgggggatggactcgccatgggcatcatgattctgaaactcctgacagactttcaatcccatcagctttgggctaccctgctcagcctgacattcatcaagaccacgttttctctgcactatgcctggaaaacaatggctatggttctttccattgtgagcctgttccccctctgtctgtctaccacctcccagaagacaacctggctccctgtgctgcttgggagcctgggatgcaagccgctgacaatgtttctcatcgccgagaataaaatttggggccggcgctcttggcccctgaacgaaggcatcatggcggtcgggatcgtgtccattcttctgagctccctcctgaagaacgatgttcctctcgccggacccctgatcgctggcgggatgcttattgcctgttacgtgatcagcggatctagcgctgacctgtccctggagaaagccgccgaggtctcttgggaagaggaagctgagcatagcggcgcgtcccacaatattctcgtggaagttcaggatgacgggacgatgaagatcaaagatgaggagagagacgataccctgacaatccttctgaaggccaccctcctggctgtgtctggagtctatcctctcagcattcccgccacactgttcgtgtggtacttctggcagaagaagaagcagcggtccggcgtcctttgggacaccccttctcccccggaagtggagcgcgccgttctggatgacggcatctatagaattatgcagcgggggctgctcggacgcagccaggtgggcgtcggggtgtttcaagaaaacgttttccatacgatgtggcacgtgaccagaggagctgtcctgatgtaccagggcaaacggcttgagccttcctgggccagcgtgaagaaagacctgatctcttacgggggaggctggagactccagggctcctggaatacaggggaggaagtgcaggttattgcggtcgagcccggaaagaaccctaaaaatgtgcaaaccgctcccggcacatttaagaccccggaaggggaggtgggagccatcgccctggatttcaagcctggcacaagcgggtctcccattgtcaaccgcgaaggaaaaatcgtgggcctctatggcaatggggttgtgacgacctccggaacatacgtcagcgctatcgcccaggcgaaggcttcccaggagggccctctgcccgagattgaagacgaggtgtttcggaaaagaaaccttaccatcatggatctgcaccccgggtctggaaagacccgccggtatctgcctgccattgttagagaagccatcaaacgcaagctccggacactgattcttgctccgacgagagtggtcgccagcgagatggctgaagccctgaagggcatgcccatccgctaccaaaccacagcggtgaaatccgagcataccgggaaggagatcgttgacctcatgtgccacgccacattcaccatgcggctgctgagccctgtgagagtccccaattataacatgattatcatggatgaagctcattttacggacccttcttccattgccgctcggggctacatcagcacacgcgtgggaatgggcgaggccgccgctattttcatgaccgcgacaccccctgggtctgtggaagcctttccgcagagcaatgctgtcatccaggatgaggaaagagacatccccgagcggtcctggaactctggatatgagtggattacagatttccctggcaaaaccgtttggtttgtgcccagcatcaagtccgggaatgacattgccaactgtctccgcaaaaatggaaagagagtgatccagctttctcggaagacattcgataccgaataccagaaaacgaagaacaacgactgggactacgtcgtgacaaccgatattagcgagatgggcgccaatttcagagctgaccgcgttatcgatcctcggagatgcctgaaacccgtgattctgaaggacgggccggaacgcgtcatcctcgccggccctatgcccgtgacagttgcgtccgctgcccagcggagaggacgcatcggccggaaccacaataaagagggggatcagtatatttacatgggacagcccctgaacaatgacgaggatcatgcccactggaccgaagctaagatgcttctggacaacatcaatacgcctgagggcattatccccgccctctttgaacctgagagagaaaagagcgcggccattgatggggagtatcgcctgagaggagaggctcggaaaaccttcgtggaactgatgcgcagaggcgacctcccggtctggctttcttacaaggtggcctccgaggggtttcaatatagcgatcggcgctggtgcttcgacggcgaaagaaacaatcaggtcctggaggaaaacatggatgtggagatctggacaaaagagggagaacggaagaaactgagaccccgctggctcgacgctcggacctactccgaccctctggcccttagagagtttaaggagttcgctgccggccgccggtctgttagcggggatctgatcctcgagattggaaaactgccccagcacctgacacagagagcgcaaaatgccctcgacaaccttgtgatgctgcataattccgaacagggcgggcgggcttatcgccacgccatggaggagctgcctgataccatcgaaacactcatgctgcttgctctgattgccgtgctcaccggaggcgtcacgctgtttttcctgtctggcagagggctcggaaagacaagcatcggccttctgtgtgttatggcctccagcgtgctgctctggatggcttctgtggagccccattggattgcggcctccatcatcctggaatttttccttatggtcctgctcattccggagcctgaccggcagcgcacaccccaggataaccaactggcttacgtggttatcgggctgctctttatgattcttaccgtggccgccaatgagatgggactgctggaaacaaccaagaaagacctcggcatcgggcacgtcgctgtggagaaccaccatcacgccgcgatgctggatgtcgaccttcatcctgccagcgcttggacactgtacgccgtggctacgaccattatcacacccatgatgagacacaccattgaaaacacaaccgccaatatctctctcacggcgatcgccaaccaggctgccattctgatgggactggataagggctggcctatctccaaaatggacattggcgttcccctccttgctctggggtgctatagccaggtgaatccgctgaccctcacagccgctgtcctgatgcttgtggcccattacgcgatcattggacctggcctgcaagccaaggctacccgggaggcccagaaacgcacagctgccgggatcatgaagaaccccaccgttgatggaatcgtggccattgacctcgatcccgtcgtgtatgacgcgaagttcgaaaaacagctgggccagatcatgctgctcattctttgtacgtctcaaatcctgctgatgagaacaacctgggctctctgcgagagcattacactggccaccgggcctcttaccacactgtgggagggatccccgggcaagttttggaatacgaccatcgctgtgtctatggccaacatcttccggggcagctacctcgccggggctggactggccttctccctgatgaaaagcctcggcgggggacgcagaggcacaggggcgcagggagaaacccttggcgagaagtggaaacggcagctgaatcagctgtccaagtctgaatttaacacatataagagaagcggcattatggaggttgaccgctccgaagccaaagaggggctcaagcggggagagaccacgaaacacgctgtctctagaggcacagccaagctgcgctggttcgtggaacggaatcttgtgaaacccgaggggaaggtcatcgatctgggatgtggcagagggggatggagctactattgcgctggcctcaagaaagttaccgaagtgaagggctacaccaaagggggacctggccacgaggaacccattcctatggccacatacgggtggaacctggtgaagctgcattccggaaaagacgtctttttcattccccctgagaagtgtgataccctcctttgcgacattggcgagtctagcccgaatcccacaatcgaagaggggcgcacgctgcgggtgctgaaaatggttgaaccttggctcagaggaaaccaattttgtattaagatcctgaatccctatatgccttccgtggtcgagacccttgagcagatgcagcgcaagcacggcggcatgctggtgcggaaccccctcagcagaaattctacacatgaaatgtactgggtttcctgcgggaccggaaacatcgtgagcgcggtcaatatgacatctcgcatgctgctgaaccggttcaccatggcccacagaaaaccgacgtatgagcgcgatgtggacctcggcgctgggaccagacacgtggccgtcgaacctgaggttgctaacctggatattatcggacagcggattgaaaatatcaagcatgagcacaaatccacatggcattacgacgaggataacccctataagacctgggcctaccacggcagctatgaagtgaaaccctctgggtccgctagctccatggtgaatggagtcgtgaaacttctgacaaagccttgggacgttattcccatggtgacccaaatcgccatgacagataccacgccttttggccagcagcgcgtcttcaaagagaaggtggacacaagaaccccgaaagcgaagcggggcaccgcccaaatcatggaagttacagctaaatggctctgggggtttctgagcagaaacaagaagccccggatttgtacgcgcgaggagttcaccagaaaagtgcggtctaatgccgctatcggagccgtctttgtggacgagaaccagtggaatagcgccaaggaggcggttgaagatgagcgcttctgggaccttgtgcatagagaacgggagctgcacaaacagggcaagtgcgctacatgcgtctacaacatgatggggaaacgcgaaaagaagctcggagagtttggcaaagccaaggggtccagagccatttggtacatgtggctgggcgctcggttcctggagttcgaagccctcggatttatgaatgaggatcactggttctctcgcgaaaacagcctgtccggcgtggagggggagggacttcataaactgggctatatcctcagagacatttctaagatccctgggggaaatatgtacgctgatgacaccgccggctgggatacacggatcaccgaagacgatctgcagaacgaggcgcgcattacagacatcatggaacccgagcacgcccttctggctagaagcatttttaaactcacctatcaaaataaggtcgtgcgggttcagcgccctgccaaaaacgggacggtgatggatgtcatctccagacgggaccagagaggctctggacaggtgggcacctacgggctgaatacattcaccaacatggaagctcaactgattcgccagatggagagcgagggaatcttttcccccagcgaactcgagacaccgaacctggccgaacgggtgcttgattggctggagaagtatggcgttgaaagactcaagcgcatggcgatctctggggacgactgtgtggtcaaacctattgatgaccggttcgccaccgctctgacggcccttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagctcgcgtctctcagggagccggctggtccctgcgggagacagcttgcctgggaaagagctacgcccaaatgtggcagctcatgtattttcatagacgcgacctgcggcttgcggccaacgctatttgttccgccgtgcccgttgattggatcccgacctctagaacaacctggagcattcacgcccatcaccagtggatgacgaccgaagacatgctgtccgtgtggaatcgggtctggatcgaggaaaacccttggatggaggataagacacatatcagctcttggggagacgtgccctacctcggcaaaagagaggaccaatggtgcgggtccctgattggacttaccgctcgcgccacatgggcgaccaatatccaggttgctattaaccaggtgcggagactgatcggcaatgaaaactacctcgattatatgacaagcatgaagcgcttcaaaaatgagtctgaccccgaaggggccctgtggtga

SEQ ID NO: 19363 - RNA, 9879 nt, synthetic construct
  misc_feature 1..9879: note = derived and/or modified CDS sequence (opt5) from DENV-1__JQ045648__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaagtctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttgcgcagaacggacggcttatcacggctaatcccattgtgaccgacaaagagaagcctgtcaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgttggcaaactcgtccatcagattttcgggaccgcttacggagtgctgttttccggcgtgagctggacgatgaagatcgggattggcgtccttctgacctggctcggactcaattctagatccacaagcctgtctatgacctgtatcgccgtgggccttgttacactctacctgggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctctctgcggccattggcaaggcttgggaggagggggtctgcggcatcagaagcgccacgcgcctggaaaacatcatgtggaaacagatttccaacgagcttaatcatatcctgctcgaaaacgacatgaagttcacagtggttgtgggagatgtcgctggcattctggcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatatctgggaggtggaggactacggattcggcatttttaccacgaacatctggctgaaacttcgcgattcctatacacaggtctgcgaccaccggctcatgagcgccgctattaaagattctaaggccgttcacgccgacatgggctactggatcgaatccgagaaaaatgaaacctggaagctggctagagccagcttcatcgaggtgaagacatgtatttggcccaaatctcataccctgtggtccaacggggtgctcgaaagcgagatgatcattccgaagatctatggaggccctatttctcaacacaattaccgccccgggtacttcacacagaccgcgggaccttggcatctgggcaaacttgagctggattttgacctctgcgaagggacgaccgtcgtggttgatgagcactgcggaaaccggggccccagcctgagaacaaccacagtgaccggcaagatcatccacgaatggtgttgccggtcctgtacgctgcctccccttcgcttcagaggggaggacggatgctggtatggcatggagattcggccggtcaaagaaaaggaggaaaatctcgtcaagagcatggtttctgctgggtccggagaggtggacagcttttccctgggcctgctctgtatctctattatgatcgaagaggtcatgagaagccgctggtcccggaaaatgctgatgacagggacccttgccgtgttctttctgctcattatgggacagctgacatggaacgatctgatcagactttgcattatggttggcgccaatgcttctgaccgcatgggcatggggaccacctacctggccctcatggcgacattcaagatgagacctatgtttgctgtgggactgctgttccggcgcctgacgagcagagaggtccttctgctcaccatcggcctgtccctggtggcctctgtggaacttcccaacagcctggaggaactcggggatggactggccatgggcatcatgattctcaaactgcttacagactttcaatcccatcagctgtgggctaccctcctgagcctgacattcatcaagaccacgctttctctgcactatgcctggaaaacaatggctatggtcctctccattgttagcctgtttcccctctgtctgtctaccacctcccagaagacaacctggcttcctgtgctgctggggagcctcggatgcaagccgctgacaatgttccttatcgccgagaataaaatttggggccggcgctcttggcccctgaacgaaggcatcatggcggtggggatcgtctccattctcctgagctccctcctgaagaacgatgtgcctcttgccggacccctgatcgctggcgggatgctgattgcctgttacgttatcagcggatctagcgctgacctctccctggagaaagccgccgaggtgtcttgggaagaggaagctgagcatagcggcgcgtcccacaatattcttgtcgaagtgcaggatgacgggacgatgaagatcaaagatgaggagagagacgataccctgacaatcctcctgaaggccaccctcctggctgtttctggagtgtatcctcttagcattcccgccacactgtttgtctggtacttctggcagaagaagaagcagcggtccggcgtgctgtgggacaccccttctcccccggaagtcgagcgcgccgtgctcgatgacggcatctatagaattatgcagcgggggctgcttggacgcagccaggttggcgtgggggtcttccaagaaaacgtgtttcatacgatgtggcacgttaccagaggagctgtgctgatgtaccagggcaaacggctcgagccttcctgggccagcgtcaagaaagacctgatctcttacgggggaggctggagactccagggctcctggaatacaggggaggaagtccaggtgattgcggttgagcccggaaagaaccctaaaaatgtccaaaccgctcccggcacattcaagaccccggaaggggaggtgggagccatcgccctggattttaagcctggcacaagcgggtctcccattgtgaaccgcgaaggaaaaatcgtcggcctttatggcaatggggtggttacgacctccggaacatacgtgagcgctatcgcccaggcgaaggcttcccaggagggccctctgcccgagattgaagacgaggtcttccggaaaagaaacctgaccatcatggatctccaccccgggtctggaaagacccgccggtatctgcctgccattgtgagagaagccatcaaacgcaaacttcggacactgattctcgctccgacgagagttgtggccagcgagatggctgaagccctgaagggcatgcccatccgctaccaaaccacagcggtcaaatccgagcataccgggaaggagatcgtggacctgatgtgccacacaacctttacgatgcggctccttagccctgttagagtgcccaattataacatgattatcatggatgaagcccatttcacagacccttcttccattgctgcccggggctacatcagcacccgcgtcggaatgggcgaggctgccgccatttttatgaccgctacaccccctgggtctgtggaagcgttcccgcagagcaatgccgtgatccaggatgaggaaagagacatccccgagcggtcctggaactctggatatgagtggattaccgattttcctggcaaaacagtctggttcgttcccagcatcaagtccgggaatgacattgctaactgtctgcgcaaaaatggaaagagagtgatccagctgtctcggaagacctttgatacggaataccagaagaccaagaacaacgactgggactacgtggtcaccacagatattagcgagatgggcgccaatttcagagccgaccgcgtgatcgatcctcggagatgcctcaaacccgttattctgaaggacgggccggaacgcgtgatccttgctggccctatgcccgtcaccgtggcctccgcggctcagcggagaggacgcatcggccggaaccacaataaagagggggatcagtatatttacatgggacagcccctgaacaatgacgaggatcatgcccactggacggaagccaagatgctcctggacaacatcaatacccctgagggcattatccccgctctgttcgaacctgagagagaaaagagcgccgcgattgatggggagtatcgcctcagaggagaggcccggaaaacatttgttgaacttatgcgcagaggcgacctgccggtgtggctgtcttacaaggtcgcttccgaggggttccaatatagcgatcggcgctggtgctttgacggcgaaagaaacaatcaggtgctcgaggaaaacatggatgtcgagatctggaccaaagagggagaacggaagaaactgagaccccgctggcttgacgcccggacatactccgaccctctggctctcagagagttcaaggaatttgccgctggccgccggtctgtgagcggggatctgatcctggagattggaaaactcccccagcaccttacccagagagcccaaaatgcgctggacaacctggttatgctccataattccgaacagggcgggcgggcctatcgccacgctatggaggagctgcctgatacaatcgaaacccttatgctgctcgccctgattgctgtgctgacgggaggcgtgacactcttctttctttctggcagagggctgggaaagaccagcatcggcctgctctgtgtcatggcctccagcgttctgctttggatggcctctgtggagccccattggattgctgcgtccatcatcctggagttctttctcatggtgctgctgattccggagcctgaccggcagcgcacaccccaggataaccaactcgcctacgtcgtgatcgggcttctgttcatgattctgacagttgctgccaatgagatgggactcctggaaaccacaaagaaagaccttggcatcgggcacgtggccgtcgagaaccaccatcacgctgccatgctggatgtggacctccatcctgcgagcgcctggacgctgtacgctgtcgccaccacaattatcacccccatgatgagacacacaattgaaaacaccacggctaatatctctctgaccgccatcgcgaaccaggccgctattctcatgggacttgataagggctggcctatctccaaaatggacattggcgtgcccctgctggccctcgggtgctatagccaggttaatccgctgacacttaccgctgccgtgctgatgctcgtcgctcattacgccatcattggacctggcctgcaagcgaaggccacacgggaggctcagaaacgcaccgccgctgggatcatgaagaaccccacggtggatggaatcgttgccattgacctggatcccgtggtctatgacgccaagtttgaaaaacagctcggccagatcatgcttctgattctgtgtacatctcaaatcctcctgatgagaaccacatgggcgctttgcgagagcattaccctggctaccgggcctctcacaacgctgtgggagggatccccgggcaagttctggaataccacaatcgccgtgtctatggctaacatctttcggggcagctacctggccggggccggactcgctttctcccttatgaaaagcctgggcgggggacgcagaggcaccggggcccagggagaaacactgggcgagaagtggaaacggcagctcaatcagctgtccaagtctgagttcaacacctataagagaagcggcattatggaggtggaccgctccgaagcgaaagaggggcttaagcggggagagacgacaaaacacgccgtttctagaggcaccgctaagctgcgctggtttgtcgaacggaatctcgtgaaacccgaggggaaggtgatcgatctgggatgtggcagagggggatggagctactattgcgccggcctgaagaaagtcaccgaagttaagggctacacaaaagggggacctggccacgaggaacccattcctatggctacctacgggtggaacctcgtgaaacttcattccggaaaagacgtgttctttattccccctgagaagtgtgatacactgctgtgcgacatcggcgagtctagcccgaatcccacgatcgaagaggggcgcaccctccgggtcctgaaaatggtggaaccttggcttagaggaaaccaattctgtattaagatcctgaatccctatatgccttccgttgtggagacactcgagcagatgcagcgcaagcacggcggcatgctggtccggaaccccctgagcagaaattctacccatgaaatgtactgggtgtcctgcgggacaggaaacatcgttagcgccgtgaatatgacctctcgcatgctcctgaaccggtttacgatggcgcacagaaaaccgacctatgagcgcgatgtcgaccttggcgccgggacaagacacgtggctgtggaacctgaggtcgccaacctggatattatcggacagcggattgaaaatatcaagcatgagcacaaatccacctggcattacgacgaggataacccctataagacatgggcttaccacggcagctatgaagttaaaccctctgggtccgccagctccatggtgaatggagtggtcaagctcctgaccaagccttgggacgtgattcccatggttacacaaatcgctatgaccgatacgacacctttcggccagcagcgcgtgtttaaagagaaggtcgacaccagaaccccgaaagccaagcggggcacagcgcaaatcatggaagtgacggccaaatggctttgggggttcctgagcagaaacaagaagccccggatttgtacccgcgaggaatttacaagaaaagttcggtctaatgctgccatcggagctgtgttcgtcgacgagaaccagtggaatagcgccaaggaggccgtggaagatgagcgcttttgggacctcgttcatagagaacgggagctgcacaaacagggcaagtgcgcgacctgcgtgtacaacatgatggggaaacgcgaaaagaagctgggagagttcggcaaagctaaggggtccagagccatttggtacatgtggctcggcgcccggtttctggagttcgaagctcttggattcatgaatgaggatcactggttttctcgcgaaaacagcctgtccggcgtcgagggggagggactccataaactgggctatatccttagagacatttctaagatccctgggggaaatatgtacgccgatgacacagctggctgggatacccggatcacagaagacgatctgcagaacgaggcccgcattaccgacatcatggaacccgagcacgcgctcctggccaaaagcattttcaagctgacgtatcaaaataaagtggtcagagtgcagcggcctgctaagaacgggaccgttatggatgtgatctcccgcagagaccagcggggctctggacaggtcggcacatacgggctcaatacctttacaaacatggaagcccaactgattagacagatggagagcgagggaatcttctcccccagcgaacttgagaccccgaacctggctgaacgcgtgctcgattggctggagaagtatggcgtggaacggcttaaaagaatggccatctctggggacgactgtgttgtgaagcctattgatgaccgctttgcgacggccctgacagctctcaatgatatgggaaaagtccggaaggacatcccccagtgggagccttccaaaggctggaacgattggcagcaagtgcccttctgcagccatcactttcaccagctgattatgaaggacgggagagagatcgttgtgccttgtcgcaatcaggatgaactggtcggccgggccagagtgtctcagggagctggctggtccctccgcgagaccgcctgcctgggaaagagctacgctcaaatgtggcagcttatgtatttccatcggagagacctgcgcctcgccgcgaacgccatttgttccgctgtccccgtggattggatcccgacaacctgcacgacctggtctattcacgcccatcaccagtggatgacaaccgaagacatgctgagcgtttggaatcgggtgtggatcgaggaaaacccttggatggaggataaaacacatatctccagctggggagacgtcccctaccttggcaagagagaggaccaatggtgtgggtctctgattggactcaccgcccgggctacatgggccaccaatatccaggtggcgattaaccaggttagacgcctgatcggcaatgaaaactacctggattatatgacgtccatgaaacggtttaagaatgagagcgaccccgaaggggctctctggtga

SEQ ID NO: 19364 - RNA, 9879 nt, synthetic construct
  misc_feature 1..9879: note = derived and/or modified CDS sequence (opt5) from DENV-1__JQ045649__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagataccatgacctacaaatgcccgcgcatcacagagaccgaacccgacgatgtggactgttggtgcaatgctacggatacctgggtgacatatggaacctgttcccaaacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtcgaggactatggattcggcatttttacgacaaacatctggctgaagctgcgcgattcctacacccaggtttgcgaccaccggcttatgagcgcggccattaaagattctaaggctgtgcatgccgacatgggctattggatcgaatccgagaaaaatgaaacatggaagctcgccagagctagcttcatcgaggtgaagacctgtatttggcccaaatctcacacactgtggtccaacggggtcctggaaagcgagatgatcattccgaagatctacggaggccctatttctcaacataattatcgccccgggtacttcacccagacggccggaccttggcacctcggcaaactggagcttgattttgacctgtgcgaagggaccacagtggttgtggatgagcactgcggaaaccggggccccagcctcagaaccacaaccgtcacgggcaagatcatccatgaatggtgttgccggtcctgtacactgcctcccctgcgcttcagaggggaggacggatgctggtacggcatggagattcggccggtgagagaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattgtgggacagctcacctggaacgatctgatccgcctgtgcattatggtcggcgccaatgcctctgacagaatgggcatggggaccacatatcttgctctgatggccacgttcaaaatgcggcctatgtttgcggtgggactcctgttccgcagactcaccagccgggaggtgctgcttctgacaatcggcctctccctggtcgcttctgttgaactgcccaacagccttgaggaactgggggatggactcgccatgggcatcatgattctgaagctcctgaccgactttcaatcccaccagctttgggccagcctgctctctctgacattcatcaaaaccacgttttccctgcattacgcttggaagacaatggccatggtgcttagcgtggtctctctgttccccctctgtctgtccaccaccagccagaaaacaacctggctccctgtgctgcttgggtctctgggatgcaagccgctgacaatgtttctcattgctgagaataagatctggggccgcagatcctggcccctgaacgaaggcattatggccgttgggatcgtgagcatccttctgtccagcctcctgaaaaacgatgtccctctcgcgggacccctgattgccggcgggatgcttatcgcttgttatgtgatttctggaagctccgccgacctgtctctggagaaggctgccgaggttagctgggaagaggaagccgagcactccggcgcttctcataatatcctcgtggaagtccaggatgacgggacgatgaaaattaaggatgaggagcgggacgataccctgacaatccttctgaaagcgaccctcctggccgtgagcggagtctaccctctctccatccccgctacactgttcgtgtggtatttctggcaaaagaaaaagcagcgctctggcgttctttgggacacccctagccctcccgaagtggagagagccgtcctggatgacggcatttaccggatcatgcagcgcgggctgctcggaagatcccaggtgggcgttggggtgtttcaagaaaacgtcttccacacgatgtggcacgtgacccggggagccgtgctgatgtatcagggcaagagacttgagcccagctgggcttctgttaaaaaggacctgatttcctacgggggaggctggcgcctccagggcagctggaatacaggggaggaagtccaggtgatcgccgtggagcccggcaagaatcctaagaatgtccaaaccgcgcccggcacatttaaaaccccggaaggggaggtgggagctattgccctggatttcaagcctggcacatctgggtcccccatcgttaaccgggaaggaaagattgtgggcctctacggcaatggggtcgtgacgaccagcggaacatatgtttccgccatcgctcaggccaaagcgtctcaggagggccctctgcccgagatcgaagacgaggtgtttagaaagcgcaaccttaccattatggatctgcatcccgggagcggaaaaacccggagatacctgcctgctatcgtccgcgaagccattaagcggaaactcagaacactgatccttgccccgacgcgcgtggttgcttccgagatggccgaagctctgaagggcatgcccattcggtatcaaaccacagccgtcaagagcgagcacaccgggaaagagatcgtcgacctcatgtgccatgcgacattcaccatgagactgctgtctcctgtgcgggtgcccaattacaacatgatcattatggatgaagcccactttacggacccttccagcatcgctgcccgcggctatatttctacaagagtcggaatgggcgaggctgccgccatcttcatgaccgctacaccccctgggagcgttgaagcgtttccgcagtccaatgccgtgattcaggatgaggaacgggacatccccgagcgctcttggaacagcggatacgagtggatcacagatttccctggcaagaccgtgtggtttgtcccctccattaaatctgggaatgacatcgctaactgtctcagaaagaatggaaaacgggtgattcagcttagcagaaagacattcgataccgaatatcaaaagacgaaaaacaacgactgggactacgttgtgacaaccgatatctccgagatgggcgccaatttccgcgccgaccgggtcattgatcctagacgctgcctgaagcccgtgatcctgaaagacgggccggaacgggttattctcgctggccctatgcccgtgacagtcgccagcgcggctcagagacgcggacggatcggcagaaaccataataaggagggggatcagtacatctatatgggacagcccctgaacaatgacgaggatcacgcccactggaccgaagccaaaatgcttctggacaacattaatacgcctgagggcatcattcccgctctctttgaacctgagcgcgaaaagtctgccgcgatcgatggggagtacagactgcggggagaggcccgcaagaccttcgtggaactgatgagacggggcgacctcccggtctggctttcctataaagtggctagcgaggggtttcaatactccgatcgcagatggtgcttcgacggcgaacggaacaatcaggttctggaggaaaacatggatgtggagatttggacaaaggagggagaacgcaaaaagctgcgcccccggtggctcgacgccagaacctattctgaccctctggctcttagagagtttaaagagttcgccgctggccggagaagcgtgtccggggatctgatcctcgagatcggaaagctgccccagcatctgacacagcgggcccaaaatgcgctcgacaaccttgtcatgctgcacaattctgaacagggcgggcgcgcctacagacatgctatggaggagctgcctgataccattgaaacactcatgctgcttgccctgatcgctgttctcaccggaggcgtgacgctgtttttcctgagcggccgggggctcggaaaaacatccattggccttctgtgtgtgatggccagctctgtcctgctctggatggcctccgtggagccccactggatcgctgcgagcattatcctggaatttttccttatggttctgctcatcccggagcctgaccgccagagaacaccccaggataaccaactggcctatgtggtcattgggctgctctttatgatccttaccgtggctgccaatgagatgggactgctggaaacaaccaagaaggacctcggcattgggcacgtcgccgtggagaaccatcaccatgctgccatgctggatgttgaccttcaccctgcgtctgcctggacactgtacgctgtggccacgaccatcattacacccatgatgcggcataccatcgaaaacacaaccgctaatatttccctcacggccatcgcgaaccaggccgctatcctgatgggactggataaaggctggcctattagcaagatggacatcggcgtccccctccttgccctggggtgctactctcaggtgaatccgctgaccctcacagctgccgttctgatgcttgtggctcactatgccattatcggacctggcctgcaagcgaaagccacccgcgaggctcagaagagaacagccgctgggattatgaaaaaccccaccgtcgatggaatcgtggccatcgacctcgatcccgtggtttacgacgccaagttcgaaaagcagctgggccagattatgctgctcatcctttgtacgagccaaattctgctgatgcggacaacctgggcgctctgcgagtccatcacactggctaccgggcctcttaccacactgtgggagggatctccgggcaaattttggaatacgaccattgccgtcagcatggctaacatcttccgcggctcctatctcgccggggccggactggctttcagcctgatgaagtccctcggcgggggaagacggggcacaggggcccagggagaaacccttggcgagaaatggaagagacagctgaatcagctgtctaaaagcgaatttaacacatacaagcgctccggcatcatggaggtggaccggtctgaagcgaaggaggggctcaaaagaggagagaccacgaagcacgccgtgagccgcggcacagctaaactgcggtggttcgtcgaaagaaatcttgttaagcccgaggggaaagtgattgatctgggatgtggccgcgggggatggtcctattactgcgccggcctcaagaaggtgaccgaagtcaaaggctataccaaagggggacctggccatgaggaacccatccctatggctacatacgggtggaacctggtgaaactgcactctggaaaggacgtctttttcattccccctgagaaatgtgataccctcctttgcgacatcggcgagagctccccgaatcccacaattgaagaggggcggacgctgagagtgctgaagatggtcgaaccttggctccgcggaaaccaattttgtatcaaaattctgaatccctacatgcctagcgtggttgagacccttgagcagatgcagcggaagcatggcggcatgctggtgagaaaccccctctctcgcaattccacacacgaaatgtattgggtcagctgcgggaccggaaacatcgtgtctgccgtgaatatgacatcccggatgctgctgaacagattcaccatggcgcaccgcaagccgacgtacgagagagatgtcgacctcggcgccgggacccggcatgttgctgtggaacctgaggtggccaacctggatatcattggacagcgcatcgaaaatattaaacacgagcataagagcacatggcactatgacgaggataacccctacaaaacctgggcttatcatggctcttacgaagtcaagccctccgggagcgcctccagcatggtgaatggagttgtgaaacttctgacaaagccttgggacgtcatccccatggtgacccaaattgctatgacagataccacgccttttggccagcagagagttttcaaggagaaagtggacacacggaccccgaaggccaaaagaggcaccgcgcaaatcatggaagtcacagccaagtggctctgggggtttctgtctcggaacaaaaagccccgcatctgtacgagagaggagttcacccggaaggtgcgcagcaatgctgccattggagctgtttttgtggacgagaaccagtggaactccgccaaagaggccgtcgaagatgagagattctgggaccttgtgcaccgggaacgcgagctgcacaagcagggcaaatgcgcgacatgcgtctataacatgatggggaagagagagaaaaagctcggagagtttggcaaggctaaagggtctcgggccatctggtacatgtggctgggcgcccgcttcctggagttcgaagctctcggatttatgaatgaggatcattggttcagcagagaaaactccctgtctggcgtggagggggagggacttcacaagctgggctacattctccgggacatcagcaaaattcctgggggaaatatgtatgccgatgacaccgctggctgggatacacgcatcaccgaagacgatctgaagaacgaggccagaatcacagacattatggaacccgagcatgcgcttctggccaaatccatctttaagctcacctaccagaataaagttgtgcgggtccaacgccctgctaagaacgggacggtgatggatgtgatttctagacgggaccagagaggcagcggacaggttggcacctatgggctgaatacattcaccaacatggaagcccagctgatccgccaaatggagtccgagggaatttttagcccctctgaactcgagacaccgaacctggctgaacgggtgcttcactggctggagaagtacggcgtcgaaagactcaaacgcatggccatctccggggatgactgtgtggttaagcctatcgacgatcggttcgcgaccgccctgacggctcttaatgacatgggaaaagtgagaaaggatattccccagtgggagcctagcaaaggctggaacgactggcagcaggtccccttttgctctcaccatttccaccaactgatcatgaaggatgggcgcgagattgtggtcccttgtcggaatcaggacgaactcgtgggcagagcccgcgtttcccagggagctggctggagcctgcgggagacagcctgcctggggaagtcctatgctcagatgtggcaactcatgtactttcatagacgcgatctgcggcttgccgcgaacgccatctgttctgctgtgcccgtcgactggattccgaccagcagaacaacctggtccatccacgcccatcaccagtggatgacgaccgaagatatgctgagcgtgtggaatcgggtttggattgaggaaaacccttggatggaggacaaaacacacatctcttcctggggagatgtgccctatctcggcaagagagaggaccagtggtgcgggagcctgatcggacttaccgcccgcgctacatgggccaccaatattcaagtcgcgatcaaccaggtgcggagactgattggcaatgaaaactacctcgactacatgacatctatgaaacgcttcaagaatgagagcgatcccgaaggggctctgtggtga

SEQ ID NO: 19365 - RNA, 9879 nt, synthetic construct
  misc_feature 1..9879: note = derived and/or modified CDS sequence (opt5) from DENV-1__JQ045650__SS-prME
  source 1..9879: mol_type = other RNA
agcgtgaccatgctgctcatgctgatgcccaccgcccttgctttccacctgacgaccagaggaggggaacctcatatgattgtgtccaagcaggaacggggaaaatctctcctgtttaagaccagcgccggcgttaacatgtgcacccttattgcgatggacctgggggaactctgtgaagataccatgacctacaaatgcccgagaatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtggaggactatggattcggcatttttacgacaaacatctggctgaaacttcgcgattcctacacccaggtctgcgaccaccggctcatgagcgcggccattaaagattctaaggctgttcatgccgacatgggctattggatcgaatccgagaaaaatgaaacatggaagctggccagagctagcttcatcgaggtgaagacctgtatttggcccaaatctcacacactgtggtccaacggggtgctcgaaagcgagatgatcattccgaagatctacggaggccctatttctcaacataattatcgccccgggtacttcacccagacggccggaccttggcacctgggcaaacttgagctggattttgacctctgcgaagggaccacagtcgtggttgatgagcactgcggaaaccggggccccagcctgagaaccacaaccgtgacgggcaagatcatccatgaatggtgttgccggtcctgtacactgcctccccttcgcttcagaggggaggacggatgctggtacggcatggagattcggccggtcagagaaaaagaggaaaatctcgtcaagagcatggtttctgcggggtccggagaggtggacagcttttccctgggcctgctctgtatctctattatgatcgaagaggtcatgcgcagccggtggtccagaaagatgctgatgaccgggacacttgctgtgttctttctgctcattgttggacagctgacctggaacgatctgatccgcctttgcattatggtgggcgccaatgcctctgacagaatgggcatggggaccacatatctggctctcatggccacgttcaaaatgcggcctatgtttgcggtcggactgctgttccgcagactgaccagccgggaggtgcttctgctcacaatcggcctgtccctggtggcttctgtcgaacttcccaacagcctggaggaactcggggatggactggccatgggcatcatgattctcaagctgcttaccgactttcaatcccaccagctgtgggccagcctcctgtctctgacattcatcaaaaccacgttttcccttcattacgcttggaagacaatggccatggttctgagcgtggtgtctctcttccccctgtgtctctccaccaccagccagaaaacaacctggctgcctgtccttctggggtctctgggatgcaagccgctcacaatgtttctgattgctgagaataagatctggggccgcagatcctggccccttaacgaaggcattatggccgtggggatcgttagcatcctgctctccagcctgctcaaaaacgatgtgcctctggcgggaccccttattgccggcgggatgctgatcgcttgttatgtcatttctggaagctccgccgacctgtctctcgagaaggctgccgaggtgagctgggaagaggaagccgagcactccggcgcttctcataatatcctggttgaagtgcaggatgacgggacgatgaaaattaaggatgaggagcgggacgatacccttacaatcctgctcaaagcgaccctgctcgccgtcagcggagtgtaccctctgtccatccccgctacacttttcgtctggtatttctggcaaaagaaaaagcagcgctctggcgtgctgtgggacacccctagccctcccgaagttgagagagccgtgctggatgacggcatttaccggatcatgcagcgcgggctcctgggaagatcccaggtcggcgtgggggtttttcaagaaaacgtgttccacacgatgtggcacgtcacccggggagccgtgcttatgtatcagggcaagagactggagcccagctgggcttctgtgaaaaaggacctcatttcctacgggggaggctggcgcctgcagggcagctggaatacaggggaggaagttcaggtcatcgccgtggagcccggcaagaaccctaagaatgtgcaaaccgcgcccggcacatttaaaaccccggaaggggaggtcggagctattgccctcgatttcaagcctggcacatctgggtcccccatcgtgaaccgggaaggaaagattgttggcctgtacggcaatggggtggtcacgaccagcggaacatatgtgtccgccatcgctcaggccaaagcgtctcaggagggccctcttcccgagatcgaagacgaggtttttagaaagcgcaacctgaccattatggatctgcatcccgggagcggaaaaacccggagatacctccctgctatcgtgcgcgaagccattaagcggaaactgagaacacttatcctggccccgacgcgcgtcgtggcttccgagatggccgaagctctcaagggcatgcccattcggtatcaaaccacagccgttaagagcgagcacaccgggaaagagatcgtggacctgatgtgccatgcgacattcaccatgagactgctctctcctgtccgggtgcccaattacaacatgatcattatggatgaagcccactttacggacccttccagcatcgctgcccgcggctatatttctacaagagtgggaatgggcgaggctgccgccatcttcatgaccgctacaccccctgggagcgtcgaagcgtttccgcagtccaatgccgttattcaggatgaggaacgggacatccccgagcgctcttggaacagcggatacgagtggatcacagatttccctggcaagaccgtgtggtttgtgccctccattaaatctgggaatgacatcgctaactgtcttagaaagaatggaaaacgggtcattcagctgagcagaaagacattcgataccgaatatcaaaagacgaaaaacaacgactgggactacgtggttacaaccgatatctccgagatgggcgccaatttccgcgccgaccgggtgattgatcctagacgctgcctgaagcccgtcatcctcaaagacgggccggaacgggtgattctggctggccctatgcccgttacagtggccagcgcggctcagagacgcggacggatcggcagaaaccataataaggagggggatcagtacatctatatgggacagccccttaacaatgacgaggatcacgcccactggaccgaagccaaaatgctgctcgacaacattaatacgcctgagggcatcattcccgctctgtttgaacctgagcgcgaaaagtctgccgcgatcgatggggagtacagactgcggggagaggcccgcaagaccttcgtcgaactcatgagacggggcgaccttccggtgtggctgtcctataaagtcgctagcgaggggtttcaatactccgatcgcagatggtgcttcgacggcgaacggaacaatcaggtgctggaggaaaacatggatgttgagatttggacaaaggagggagaacgcaagaagctccgcccccggtggctggacgccagaacctattctgaccctcttgctctgcgcgagtttaaagagttcgccgctggccggagaagcgtgtccggggatctcatcctggagatcggaaagctgccccagcatctcacacagcgggcccaaaatgcgcttgacaacctggtgatgctgcacaattctgaacagggcgggcgcgcctacagacatgctatggaggagctccctgataccattgaaacactgatgcttctggccctcatcgctgtcctgaccggaggcgttacgctgtttttcctcagcggccgggggcttggaaaaacatccattggcctgctgtgtgtgatggccagctctgtgctcctgtggatggcctccgtcgagccccactggatcgctgcgagcattatccttgaatttttcctgatggtgctcctgatcccggagcctgaccgccagagaacaccccaggataaccaactggcctatgttgtgattgggctcctttttatgatcctgaccgtcgctgccaatgagatgggactgctcgaaacaaccaagaaggacctgggcattgggcacgtggccgtcgagaaccatcaccatgctgccatgcttgatgtggacctgcaccctgcgtctgcctggacactctacgctgttgccacgaccatcattacacccatgatgcggcataccatcgaaaacacaaccgctaatatttccctgacggccatcgcgaaccaggccgctatcctgatgggactcgataaaggctggcctattagcaagatggacatcggcgtgccccttctggccctggggtgctactctcaggtcaatccgctcaccctgacagctgccgtgcttatgctggttgctcactatgccattatcggacctggcctccaagcgaaagccacccgcgaggctcagaagagaacagccgctgggattatgaaaaaccccaccgtggatggaatcgtcgccatcgacctggatcccgtggtgtacgacgccaagttcgaaaagcagctgggccagattatgctccttatcctgtgtacgagccaaattctgctcatgcggacaacctgggcgctgtgcgagtccatcacacttgctaccgggcctctgaccacactctgggagggatctccgggcaaattttggaatacgaccattgccgttagcatggctaacatcttccgcggctcctatctggccggggccggactggctttcagcctcatgaagtcccttggcgggggaagacggggcacaggggcccagggagaaaccctgggcgagaaatggaagagacagctgaatcagctctctaaaagcgaatttaacacatacaagcgctccggcatcatggaggtcgaccggtctgaagcgaaggaggggctgaaaagaggagagaccacgaagcacgccgtgagccgcggcacagctaaacttcggtggttcgtggaaagaaatctggtcaagcccgaggggaaagttattgatctcggatgtggccgcgggggatgggcctattactgcgctggcctgaagaaggtgaccgaagtgaaaggctataccaaaggcgggcctgggcatgaggaacccatccctatggccacatacgggtggaacctggtcaaactccactccggaaaggacgtgtttttcattccccctgagaaatgtgatacccttctgtgcgacatcggcgagtctagcccgaatcccacaattgaagaggggcggacgctgagagttctcaagatggtggaaccttggctgcgcggaaaccaattttgtatcaaaattcttaatccctacatgccttccgtcgtggagaccctggagcagatgcagcggaagcatggcggcatgctcgttagaaaccccctgagccgcaattctacacacgaaatgtattgggtgtcctgcgggaccggaaacatcgtcagcgcggtgaatatgacatctcggatgctgctcaacagattcaccatggcccaccgcaagccgacgtacgagagagatgtggacctgggcgctgggacccggcatgtcgccgttgaacctgaggtggctaaccttgatatcattggacagcgcatcgaaaatattaaacacgagcataagtccacatggcactatgacgaggataacccctacaaaacctgggcctatcatggcagctacgaagtgaagccctctgggtccgctagctccatggtcaatggagtggttaaactgctcacaaagccttgggacgtgatccccatggtcacccaaattgccatgacagataccacgccttttggccagcagagagtgttcaaggagaaagttgacacacggaccccgaaggcgaaaagaggcaccgcccaaatcatggaagtgacagctaagtggctgtgggggtttcttagccggaacaaaaagccccgcatctgtacgagagaggagttcacccggaaggtccgctctaatgccgctattggagccgtgtttgttgacgagaaccagtggaatagcgccaaagaggcggtggaagatgagagattctgggacctggtccaccgggaacgcgagctccacaagcagggcaaatgcgctacatgcgtgtataacatgatggggaagagagagaaaaagctgggagagtttggcaaggccaaagggtcccgggccatctggtacatgtggctgggcgctcgcttcctcgagttcgaagccctgggatttatgaatgaggatcattggttctctagagaaaacagcctttccggcgtcgagggggagggactgcacaagctcggctacattctgcgggacatctctaaaattcctgggggaaatatgtatgctgatgacaccgccggctgggatacacgcatcaccgaagacgatcttaagaacgaggcgagaatcacagacattatggaacccgagcatgccctgctcgctaaaagcatctttaagctgacctaccagaataaagtggttcgggtgcaacgccctgccaagaacgggacggtcatggatgtgatttccagacgggaccagagaggctctggacaggtgggcacctatgggctgaatacattcaccaacatggaagctcagctcatccgccaaatggagagcgagggaatcttttcccccagcgaactggagacaccgaaccttgccgaacgggttctgcactggctcgagaagtacggcgtggaaagactgaaacgcatggcgatctctggggatgactgtgtcgtgaagcctatcgacgatcggttcgccaccgctcttacggccctgaatgacatgggaaaagttagaaaggatattccccagtgggagccttccaaaggctggaacgactggcaacaggtgcccttttgcagccaccatttccaccaactcatcatgaaggatgggcgcgagattgtcgtgccttgtcggaatcaggacgaactggtcggcagagctcgcgtgtctcagggagccggctggtccctgcgggagacagcttgcctcggaaagagctatgcccagatgtggcaactgatgtactttcatagacgcgatcttcggctggcggccaacgctatctgttccgccgttcccgtggactggattccgacctctagaacaacctggagcatccacgcccatcaccagtggatgacgaccgaagatatgctctccgtctggaatcgggtgtggattgaggaaaacccttggatggaggacaaaacacacatcagctcttggggagatgttccctatctgggcaagagagaggaccagtggtgcgggtcccttatcggactgaccgctcgcgccacatgggcgaccaatattcaagtggctatcaaccaggtccggagactcattggcaatgaaaactacctggactacatgacaagcatgaaacgcttcaagaatgagtctgatcccgaaggggccctgtggtga

SEQ ID NO: 19366 - RNA, 9879 nt, synthetic construct
  misc_feature 1..9879: note = derived and/or modified CDS sequence (opt5) from DENV-1__JQ045651__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcctgtgcttctggggagcctgggatgcaagccgctcacgatgtttctgatcgctgagaataaaatttggggccggcgctcttggccccttaacgaaggcatcatggccgtggggatcgtctccattctgctcagctccctgctcaagaacgatgtgcctctggcgggaccccttatcgccggcgggatgctgattgcttgttacgttatcagcggatctagcgccgacctgtccctcgagaaagctgccgaggtgtcttgggaagaggaagccgagcatagcggcgcttcccacaatattctggtcgaagtgcaggatgacgggaccatgaagatcaaagatgaggagagagacgatacacttaccatcctgctcaaggcgacactgctcgccgtttctggagtgtatcctctgagcattcccgctacccttttcgtctggtacttctggcagaagaagaagcagcggtccggcgtgctgtgggacacgccttctcccccggaagtcgagcgcgccgtgctggatgacggcatctatagaattatgcagcgggggctcctgggacgcagccaggttggcgtgggggtctttcaagaaaacgtgttccataccatgtggcacgttacaagaggagccgtgcttatgtaccagggcaaacggctggagccttcctgggctagcgtcaagaaagacctcatctcttacgggggaggctggagactgcagggctcctggaataccggggaggaagtccaggtgattgccgttgagcccggaaagaaccctaaaaatgtccaaacagcgcccggcacctttaagacaccggaaggggaggtgggagctatcgccctcgatttcaagcctggcacgagcgggtctcccattgtgaaccgcgaaggaaaaatcgtcggcctgtatggcaatggggtggttaccacatccggaacctacgtgagcgccatcgctcaggccaaggcgtcccaggagggccctcttcccgagattgaagacgaggtctttcggaaaagaaacctgaccatcatggatctgcaccccgggtctggaaagacacgccggtatctccctgctattgtgagagaagccatcaaacgcaagctgcggacgcttattctggccccgaccagagttgtggctagcgagatggccgaagctctcaagggcatgcccatccgctaccaaacaaccgccgtcaaatccgagcatacagggaaggagatcgtggacctgatgtgccacgcgaccttcacgatgcggctgctcagccctgttagagtgcccaattataacatgattatcatggatgaagcccattttacagacccttcttccattgctgcccggggctacatcagcacccgcgtcggaatgggcgaggctgccgccattttcatgaccgctacaccccctgggtctgtggaagcgtttccgcagagcaatgccgtgatccaggatgaggaaagagacatccccgagcggtcctggaactctggatatgagtggattaccgatttccctggcaaaacagtctggtttgttcccagcatcaagtccgggaatgacattgctaactgtcttcgcaaaaatggaaagagagtgatccagctgtctcggaagaccttcgatacggaataccagaagaccaagaacaacgactgggactacgtggtcaccacagatattagcgagatgggcgccaatttcagagccgaccgcgtgatcgatcctcggagatgcctgaaacccgttattctcaaggacgggccggaacgcgtgatcctggctggccctatgcccgtcaccgtggcctccgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagagcgccgcgattgatggggagtatcgcctgagaggagaggcccggaaaacattcgttgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgtcgagatctggaccaaagagggagaacggaagaaactcagaccccgctggctggacgcccggacatactccgaccctcttgctctgagagagtttaaggagttcgccgctggccgccggtctgtgagcggggatctcatcctggagattggaaaactgccccagcacctcacccagagagcccaaaatgcgcttgacaacctggttatgctgcataattccgaacagggcgggcgggcctatcgccacgctatggaggagctccctgatacaatcgaaaccctgatgcttctggccctcattgctgtgctgacgggaggcgtgacactgtttttcctctctggcagagggcttggaaagaccagcatcggcctgctgtgtgtcatggcctccagcgttctcctgtggatggcctctgtggagccccattggattgctgcgtccatcatccttgaatttttcctgatggtgctcctgattccggagcctgaccggcagcgcacaccccaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcctgcgagcgcctggacgctctacgctgtcgccaccacaattatcacccccatgatgagacacacaattgaaaacaccacggctaatatctctctgaccgccatcgcgaaccaggccgctattctgatgggactcgataagggctggcctatctccaaaatggacattggcgtgccccttctggccctggggtgctatagccaggttaatccgctcacactgaccgctgccgtgcttatgctggtcgctcattacgccatcattggacctggcctccaagcgaaggccacacgggaggctcagaaacgcaccgccgctgggatcatgaagaaccccacggtggatggaatcgttgccattgacctggatcccgtggtctatgacgccaagttcgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttttggaataccacaatcgccgtgtctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcattatggaggtggaccgctccgaagcgaaagaggggctgaagcggggagagacgacaaaatacgccgtttctagaggcaccgctaaacttcgctggttcgtcgaacggaatctggtgaaacccgaggggaaggtgatcgatctcggatgtggcagagggggatggagctattactgcgccggcctgaagaaagtcaccgaagttaagggctacacaaaagggggacctggccacgaggaacccattcctatggctacctatgggtggaacctggtgaagctccactccggaaaagacgtgtttttcgtgccccctgagaagtgtgatacacttctgtgcgacatcggcgagtctagcccgaatcccacgattgaagaggggcgcaccctgcgggtcctcaaaatggttgaaccttggctgagaggaaaccaattttgtatcaagattcttaatccctacatgccttccgtggtcgagacactggagcagatgcagcgcaagcatggcggcatgctcgtgcggaaccccctgagcagaaattctacccacgaaatgtattgggtttcctgcgggacaggaaacatcgtgagcgccgtcaatatgacctctcgcatgctgctcaaccggttcacgatggcgcatagaaaaccgacctacgagcgcgatgtggacctgggcgccgggacaagacacgtggctgtcgaacctgaggttgccaaccttgatatcattggacagcggatcgaaaatattaagcacgagcataaatccacctggcactatgacgaggataacccctacaagacatgggcttatcatggcagctacgaagtgaaaccctctgggtccgccagctccatggtgaatggagtcgtgaagctgctcaccaagccttgggacgttatccccatggtgacacaaattgctatgaccgatacgacaccttttggccagcagcgcgtcttcaaagagaaggtggacaccagaaccccgaaagccaagcggggcacagcgcaaatcatggaagttacggccaaatggctgtgggggtttcttagcagaaacaagaagccccggatctgtacccgcgaggagttcacaagaaaagtgcggtctaatgctgccattggagctgtctttgtggacgagaaccagtggaatagcgccaaggaggccgttgaagatgagcgcttctgggacctggtgcacagagaacgggagctccataaacagggcaagtgcgcgacctgcgtctacaacatgatggggaaacgcgaaaagaagctgggagagtttggcaaagctaaggggtccagagccatctggtatatgtggctgggcgcccggttcctcgagttcgaagctctgggatttatgaatgaggatcactggttctctcgcgaaaacagcctttccggcgtggagggggagggactgcacaaactcggctacattctgagagacatctctaagattcctgggggaaatatgtatgccgatgacacagctggctgggatacccggatcacagaagacgatcttcagaacgaggcccgcatcaccgacattatggaacccgagcatgcgctgctcgccaaaagcatctttaagctgacgtaccaaaataaagtcgtgagagttcagcggcctgctaagaacgggaccgtgatggatgtcatttcccgcagagaccagcggggctctggacaggtgggcacatatgggctgaataccttcacaaacatggaagcccaactcatcagacagatggagagcgagggaatcttttcccccagcgaactggagaccccgaaccttgctgaacgcgtgctggattggctcgagaagtacggcgttgaacggctgaaaagaatggccatctctggggacgactgtgtggtcaagcctatcgatgaccgcttcgcgacggcccttacagctctgaatgatatgggaaaagtgcggaaggacattccccagtgggagccttccaaaggctggaacgattggcagcaagttcccttttgcagccaccatttccaccagctcatcatgaaggacgggagagagattgtggtcccttgtcgcaatcaggatgaactggtgggccgggccagagtctctcagggagctggctggtccctgcgcgagaccgcctgcctcggaaagagctatgctcaaatgtggcagctgatgtactttcaccggagagaccttcgcctggccgcgaacgccatctgttccgctgtgcccgttgattggattccgacatctcggaccacgtggagcatccatgcccaccatcagtggatgaccacagaagacatgctctccgtgtggaatagagtctggattgaggaaaacccttggatggaggataaaacccacatcagctcttgggaggacgtgccctacctgggaaagcgggaagaccaatggtgcggctcccttatcgggctgacagccagagctacctgggccacaaatattcaggttgcgatcaaccaggtgcgccggctcattggaaatgagaactatctggattacatgaccagcatgaaaagattcaagaatgaatctgaccccgagggcgctctgtggtga

SEQ ID NO: 19367 - RNA, 9879 nt, synthetic construct
  misc_feature 1..9879: note = derived and/or modified CDS sequence (opt5) from DENV-1__JQ045652__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcctgtgcttctggggagcctgggatgcaagccgctcacgatgtttctgatcgctgagaataaaatttggggccggcgctcttggccccttaacgaaggcatcatggccgtggggatcgtctccattctgctcagctccctgctcaagaacgatgtgcctctggcgggaccccttatcgccggcgggatgctgattgcttgttacgttatcagcggatctagcgccgacctgtccctcgagaaagctgccgaggtgtcttgggaagaggaagccgagcatagcggcgcttcccacaatattctggtcgaagtgcaggatgacgggaccatgaagatcaaagatgaggagagagacgatacacttaccatcctgctcaaggcgacactgctcgccgtttctggagtgtatcctctgagcattcccgctacccttttcgtctggtacttctggcagaagaagaagcagcggtccggcgtgctgtgggacacgccttctcccccggaagtcgagcgcgccgtgctggatgacggcatctatagaattatgcagcgggggctcctgggacgcagccaggttggcgtgggggtctttcaagaaaacgtgttccataccatgtggcacgttacaagaggagccgtgcttatgtaccagggcaaacggctggagccttcctgggctagcgtcaagaaagacctcatctcttacgggggaggctggagactgcagggctcctggaataccggggaggaagtccaggtgattgccgttgagcccggaaagaaccctaaaaatgtccaaacagcgcccggcacctttaagacaccggaaggggaggtgggagctatcgccctcgatttcaagcctggcacgagcgggtctcccattgtgaaccgcgaaggaaaaatcgtcggcctgtatggcaatggggtggttaccacatccggaacctacgtgagcgccatcgctcaggccaaggcgtcccaggagggccctcttcccgagattgaagacgaggtctttcggaaaagaaacctgaccatcatggatctgcaccccgggtctggaaagacacgccggtatctccctgctattgtgagagaagccatcaaacgcaagctgcggacgcttattctggccccgaccagagttgtggctagcgagatggccgaagctctcaagggcatgcccatccgctaccaaacaaccgccgtcaaatccgagcatacagggaaggagatcgtggacctgatgtgccacgcgaccttcacgatgcggctgctcagccctgttagagtgcccaattataacatgattatcatggatgaagcccattttacagacccttcttccattgctgcccggggctacatcagcacccgcgtcggaatgggcgaggctgccgccattttcatgaccgctacaccccctgggtctgtggaagcgtttccgcagagcaatgccgtgatccaggatgaggaaagagacatccccgagcggtcctggaactctggatatgagtggattaccgatttccctggcaaaacagtctggtttgttcccagcatcaagtccgggaatgacattgctaactgtcttcgcaaaaatggaaagagagtgatccagctgtctcggaagaccttcgatacggaataccagaagaccaagaacaacgactgggactacgtggtcaccacagatattagcgagatgggcgccaatttcagagccgaccgcgtgatcgatcctcggagatgcctgaaacccgttattctcaaggacgggccggaacgcgtgatcctggctggccctatgcccgtcaccgtggcctccgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagagcgccgcgattgatggggagtatcgcctgagaggagaggcccggaaaacattcgttgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgtcgagatctggaccaaagagggagaacggaagaaactcagaccccgctggctggacgcccggacatactccgaccctcttgctctgagagagtttaaggagttcgccgctggccgccggtctgtgagcggggatctcatcctggagattggaaaactgccccagcacctcacccagagagcccaaaatgcgcttgacaacctggttatgctgcataattccgaacagggcgggcgggcctatcgccacgctatggaggagctccctgatacaatcgaaaccctgatgcttctggccctcattgctgtgctgacgggaggcgtgacactgtttttcctctctggcagagggcttggaaagaccagcatcggcctgctgtgtgtcatggcctccagcgttctcctgtggatggcctctgtggagccccattggattgctgcgtccatcatccttgaatttttcctgatggtgctcctgattccggagcctgaccggcagcgcacaccccaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcctgcgagcgcctggacgctctacgctgtcgccaccacaattatcacccccatgatgagacacacaattgaaaacaccacggctaatatctctctgaccgccatcgcgaaccaggccgctattctgatgggactcgataagggctggcctatctccaaaatggacattggcgtgccccttctggccctggggtgctatagccaggttaatccgctcacactgaccgctgccgtgcttatgctggtcgctcattacgccatcattggacctggcctccaagcgaaggccacacgggaggctcagaaacgcaccgccgctgggatcatgaagaaccccacggtggatggaatcgttgccattgacctggatcccgtggtctatgacgccaagttcgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttttggaataccacaatcgccgtgtctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcattatggaggtggaccgctccgaagcgaaagaggggctgaagcggggagagacgacaaaatacgccgtttctagaggcaccgctaaacttcgctggttcgtcgaacggaatctggtgaaacccgaggggaaggtgatcgatctcggatgtggcagagggggatggagctattactgcgccggcctgaagaaagtcaccgaagttaagggctacacaaaagggggacctggccacgaggaacccattcctatggctacctatgggtggaacctggtgaagctccactccggaaaagacgtgtttttcgtgccccctgagaagtgtgatacacttctgtgcgacatcggcgagtctagcccgaatcccacgattgaagaggggcgcaccctgcgggtcctcaaaatggttgaaccttggctgagaggaaaccaattttgtatcaagattcttaatccctacatgccttccgtggtcgagacactggagcagatgcagcgcaagcatggcggcatgctcgtgcggaaccccctgagcagaaattctacccacgaaatgtattgggtttcctgcgggacaggaaacatcgtgagcgccgtcaatatgacctctcgcatgctgctcaaccggttcacgatggcgcatagaaaaccgacctacgagcgcgatgtggacctgggcgccgggacaagacacgtggctgtcgaacctgaggttgccaaccttgatatcattggacagcggatcgaaaatattaagcacgagcataaatccacctggcactatgacgaggataacccctacaagacatgggcttatcatggcagctacgaagtgaaaccctctgggtccgccagctccatggtgaatggagtcgtgaagctgctcaccaagccttgggacgttatccccatggtgacacaaattgctatgaccgatacgacaccttttggccagcagcgcgtcttcaaagagaaggtggacaccagaaccccgaaagccaagcggggcacagcgcaaatcatggaagttacggccaaatggctgtgggggtttcttagcagaaacaagaagccccggatctgtacccgcgaggagttcacaagaaaagtgcggtctaatgctgccattggagctgtctttgtggacgagaaccagtggaatagcgccaaggaggccgttgaagatgagcgcttctgggacctggtgcacagagaacgggagctccataaacagggcaagtgcgcgacctgcgtctacaacatgatggggaaacgcgaaaagaagctgggagagtttggcaaagctaaggggtccagagccatctggtatatgtggctgggcgcccggttcctcgagttcgaagctctgggatttatgaatgaggatcactggttctctcgcgaaaacagcctttccggcgtggagggggagggactgcacaaactcggctacattctgagagacatctctaagattcctgggggaaatatgtatgccgatgacacagctggctgggatacccggatcacagaagacgatcttcagaacgaggcccgcatcaccgacattatggaacccgagcatgcgctgctcgccaaaagcatctttaagctgacgtaccaaaataaagtcgtgagagttcagcggcctgctaagaacgggaccgtgatggatgtcatttcccgcagagaccagcggggctctggacaggtgggcacatatgggctgaataccttcacaaacatggaagcccaactcatcagacagatggagagcgagggaatcttttcccccagcgaactggagaccccgaaccttgctgaacgcgtgctggattggctcgagaagtacggcgttgaacggctgaaaagaatggccatctctggggacgactgtgtggtcaagcctatcgatgaccgcttcgcgacggcccttacagctctgaatgatatgggaaaagtgcggaaggacattccccagtgggagccttccaaaggctggaacgattggcagcaagttcccttttgcagccaccatttccaccagctcatcatgaaggacgggagagagattgtggtcccttgtcgcaatcaggatgaactggtgggccgggccagagtctctcagggagctggctggtccctgcgcgagaccgcctgcctcggaaagagctatgctcaaatgtggcagctgatgtactttcaccggagagaccttcgcctggccgcgaacgccatctgttccgctgtgcccgttgattggattccgacatctcggaccacgtggagcatccatgcccaccatcagtggatgaccacagaagacatgctctccgtgtggaatagagtctggattgaggaaaacccttggatggaggataaaacccacatcagctcttggggagacgtgccctacctgggcaagcgggaggaccaatggtgcgggtcccttatcggactgacagccagagctacctgggccacaaatattcaggttgcgatcaaccaggtgcgccggctcattggcaatgaaaactatctggattacatgaccagcatgaaaagattcaagaatgagtctgaccccgaaggggctctgtggtga

SEQ ID NO: 19368 - RNA, 9879 nt, synthetic construct
  misc_feature 1..9879: note = derived and/or modified CDS sequence (opt5) from DENV-1__JQ045653__SS-prME
  source 1..9879: mol_type = other RNA
agcgtgaccatgctgctgatgctgatgcccacagcccttgctttccacctgacgacccggggcggggagcctcatatgatcgtgtccaagcaggaacgggggaaatctctcctgtttaagacaagcgccggcgttaatatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcaccctcgtcgatagaggctggggcaatgggtgtggactgtttggcaaagggtctcttattacatgcgctaagttcaagtgcgtgacgaaactggagggaaagatcgttcagtacgaaaacctcaaatattccgtgatcgtcaccgtgcacacaggcgaccagcatcaagttgggaatgagagcaccgaacacggaacaaccgccacgattacaccccaagctcctaccaccgagatccagctgacagactacggcgccctgaccctcgattgttctccccggacgggcctggactttaacgaaatggtgcttctgacaatgaaggagaaatcctggctcgtccataagcagtggttcctggatcttcctctgccctggaccagcggggcctccacatctcaagagacctggaatcgccaggacctcctggtgacctttaaaacagctcacgcgaagaagcaggaagtcgtggttctgggaagccaagagggcgccatgcacacggctctcaccggggccacagaaattcagacctccggaacaaccacgatcttcgccggccatctgaaatgcagacttaagatggataaactgacactcaaggggatgagctatgtgatgtgtaccggctcttttaaactggagaaggaactggctgagacccagcacggaacagtccttgtgcagattaagtacgagggcaccgacgccccgtgcaaaatccctttctccacacaagatgaaaagggggttacgcagaacggacggctcatcaccgcgaatcccattgtgacagacaaagagaagcctgtcaacatcgaagctgagccgcccttcggcgagagctatattgtgatcggggccggagaaaaagccctgaagctgtcttggtttaagaaaggcagctccattgggaagatgttcgaggctaccgccagaggcgctcgccggatggccatcctcggagatacagcgtgggactttggctctatcgggggagtgttcaccagcgttggcaaactggtccatcagatttttgggacggcctacggagtgcttttctccggcgtgagctggaccatgaagatcgggattggcgtcctgctcacatggctgggactcaattctagatccaccagcctttctatgacatgtatcgctgtgggcctcgttaccctgtacctgggggtgatggtccaggccgattccggatgcgtgattaactggaaaggccgcgaactcaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgccttgaaaacatcatgtggaaacagatttccaacgagctgaatcatatcctcctggaaaacgacatgaagtttaccgtggttgtgggagatgtcgccggcattctggctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggcttaagctccgcgattcctatacccaggtctgcgaccaccggctgatgagcgcggccattaaagattctaaggctgttcacgccgacatgggctactggatcgaatccgagaaaaatgaaacatggaagctggccagagctagctttatcgaggtgaagacctgtatttggccccgctctcatacactctggtccaacggggtgctggaaagcgagatgatcattccgaaaatctatggaggccctatttctcaacacaattaccggcccgggtacttcacccagacggccggaccttggcatcttggcaagctggagctcgatttcgacctgtgcgaagggaccacagtcgtggttgatgagcactgcggaaacagaggccccagcctgcggaccacaaccgtgacgggcaaaatcatccacgaatggtgttgccgctcctgtacacttcctcccctcagatttagaggggaagacggatgctggtatggcatggagattagaccggtcaaggaaaaagaggaaaatctggtcaagagcatggtttctgcggggtccggagaggtggacagcttctccctgggcctcctgtgtatctctattatgatcgaagaggtcatgcgcagccggtggtccaagaaaatgcttatgaccgggacactggctgtgtttttcctcctgattatgggacagctgacctggaacgatcttatcagactgtgcattatggttggcgccaatgcctctgaccgcatgggcatggggaccacatacctcgctctgatggccacgtttaagatgagacctatgttcgcggtgggactcctgtttcggcgccttaccagcagagaggtcctgctcctgacaatcggcctgtcccttgtggcttctgtggaactgcccaacagcctcgaggaactgggggatggactcgccatgggcatcatgattctgaaacttctgaccgacttccaatcccatcagctctgggccacactgctgagccttacctttatcaagacgacattctctctgcactgtgcttggaaaaccatggccatgattctctccatcgtcagcctgtttcccctctgcctgtctaccacatcccagaagaccacatggcttcctgttctgctggggagcctcggatgtaagccgctgacgatgttccttattgctgagaataaaatctggggccggcgctcttggcccctgaacgaaggcatcatggccgtggggattgtgtccatcctcctgagctccctcctgaagaacgatgtccctcttgcgggacccctgattgccggcgggatgctgatcgcttgctatgtgattagcggatctagcgccgacctctccctggagaaagctgccgaggtttcttgggaagaggaagccgagcatagcggcgcttcccacaatatccttgtggaagtccaggatgacgggaccatgaagatcaaagatgaggagagagacgatacactgaccattctcctgaaggcgacactcctggccgtgtctggagtttaccctcttagcatccccgctaccctgtttgtgtggtatttctggcagaagaagaagcagcggtccggcgtcctgtgggacacgccttctcccccggaagtggagcgcgccgtcctcgatgacggcatttacagaatcatgcagcgggggctgcttggacgcagccaggtgggcgttggggtgttccaagaagacgtctttcataccatgtggcacgtgacaagaggagccgttctgatgtatcagggcaaacggctcgagccttcctgggctagcgtgaagaaagatctgatttcttacgggggaggctggagactccagggctcctggaacaccggggaggaagtccaggtgatcgccgtggagcccggaaagaatcctaaaaacgttcaaacagcgcccggcaccttcaagacaccggaaggggaggtcggagctattgccctggactttaagcctggcacgagcgggtctcccatcgtgaatcgcgaaggaaaaatcgtgggcctttacggcaacggggtcgtgaccacatccggaacctatgttagcgccattgctcaggccaaggcgtcccaggagggccctctgcccgagatcgaagatgaggtgttccggaaaagaaatctgaccattatggacctccaccccgggtctggaaagacacgccggtacctgcctgctatcgtcagagaagccattaaacgcaaacttcggacgctgatcctcgccccgaccagagtggttgctagcgagatggccgaagctctgaagggcatgcccatccgctatcaaacaaccgccgtgaaatccgagcatacagggaaggagattgtcgatctgatgtgtcacgcgacctttacgatgcggctccttagccctgtgagagttcccaactacaatatgatcattatggacgaagcccatttcacagatccttcttccatcgctgcccggggctatattagcacccgcgtgggaatgggcgaggctgccgccatctttatgaccgctacaccccctgggtctgtcgaagcgttcccgcagagcaacgccgtgatccaggacgaggaaagagatattcccgagcggtcctggaactctggatacgagtggatcaccgactttcctggcaaaacagtgtggttcgtccccagcattaagtccgggaacgatatcgctaattgcctgcgcaaaaacggaaagagagttattcagctgtctcggaagacctttgacacggaatatcagaagaccaagaataacgactgggattacgtggtgaccacagacatcagcgagatgggcgccaacttcagagccgatcgcgtcattgaccctcggagatgcctcaaacccgtgatcctgaaggatgggccggaacgcgttatccttgctggccctatgcccgtgaccgtcgcctccgcggctcagcggagaggacgcattggccggaatcacaacaaagagggggaccagtacatctatatgggacagcccctgaataacgatgaggaccatgcccactggacggaagccaagatgctcctggataatattaacacccctgagggcatcattcccgctctgttcgaacctgagagagaaaagagcgccgcgatcgacggggagtaccgcctcagaggagaggcccggaaaacatttgtggaacttatgcgcagaggcgatctgccggtttggctgtcttataaggtggcttccgaggggttccaatacagcgaccggcgctggtgttttgatggcgaaagaaataaccaggtcctcgaggaaaatatggacgtggagatctggaccaaagagggagaacggaagaaactgagaccccgctggcttgacgcccggacatattccgatcctctggctctcagagagttcaaggaatttgccgctggccgccggtctgtcagcggggacctgattctggagatcggaaaactcccccagcaccttacccagagagcccaaaacgcgctggataatctggtgatgctccataactccgaacagggcgggcgggcctaccgccacgctatggaggagctgcctgacacaattgaaacccttatgctgctcgccctgatcgctgttctgacgggaggcgtgacactcttctttctttctggcagagggctgggaaagaccagcattggcctgctctgcgtgatggcctccagcgtcctgctttggatggcctctgttgagccccattggatcgctgcgtccatcattctggagttctttctcatggtgctgctgatcccggagcctgatcggcagcgcacaccccaggacaatcaactcgcctatgtggtcattgggcttctgttcatgatcctgacagtggctgccaacgagatgggactcctggaaaccacaaagaaagatcttggcattgggcacgttgccgtggagaatcaccatcacgctgccatgctggacgtcgatctccatcctgcgagcgcctggacgctgtacgctgtggccaccacaatcattacccccatgatgagacacacaatcgaaaacaccacggctaacatctctctgaccgccattgcgaatcaggccgctatcctcatgggacttgacaagggctggcctatttccaaaatggatatcggcgtccccctgctggccctcgggtgttacagccaggtgaacccgctgacacttaccgctgccgttctgatgctcgtggctcattatgccattatcggacctggcctgcaagcgaaggccacacgggaggctcagaaacgcaccgccgctgggatcatgaagaatcccacggtcgacggaattgtggccatcgatctggaccccgttgtgtacgacgccaagtttgaaaaacagctcggccagattatgcttctgatcctgtgcacatctcaaattctcctgatgagaaccacatgggcgctttgtgagagcatcaccctggctaccgggcctctcacaacgctgtgggagggatccccgggcaagttctggaacaccacaatcgccgtctctatggctaatatttttcggggcagctatctggccggggccggactcgctttctcccttatgaaaagcctgggcgggggacgcagaggcaccggggcccagggagaaacactgggcgagaagtggaaacggcagctcaaccagctgtccaagtctgagttcaatacctacaagagaagcggcatcatggaggtggatcgctccgaagcgaaagaggggcttaagcggggagagacgacaaaacacgccgtgtctagaggcaccgctaagctgcgctggtttgttgaacggaacctcgtcaaacccgaggggaaggtgattgacctgggatgcggcagagggggatggagctattactgtgccggcctgaagaaagtgaccgaagtcaagggctatacaaaagggggacctggccacgaggaacccatccctatggctacctacgggtggaatctcgttaaacttcattccggaaaagatgtgttctttattccccctgagaagtgcgacacactgctgtgtgatatcggcgagtctagcccgaaccccacgattgaagaggggcgcaccctccgggtgctgaaaatggtcgaaccttggcttagaggaaatcaattctgcatcaagatcctgaacccctacatgccttccgtggttgagacactcgagcagatgcagcgcaagcacggcggcatgctggtgcggaatcccctgagcagaaactctacccatgaaatgtattgggtctcctgtgggacaggaaatattgtgagcgccgttaacatgacctctcgcatgctcctgaatcggtttacgatggcgcacagaaaaccgacctacgagcgcgacgtggatcttggcgccgggacaagacacgtcgctgtggaacctgaggtggccaacctggacatcattggacagcggatcgaaaacattaagcatgagcacaaatccacctggcattatgatgaggacaatccctacaagacatgggcttatcacggcagctacgaagtcaaaccctctgggtccgccagctccatggttaacggagtggtgaagctcctgaccaagccttgggatgtcatccccatggtgacacaaatcgctatgaccgacacgacacctttcggccagcagcgcgtttttaaagagaaggtggacaccagaaccccgaaagccaagcggggcacagcgcaaattatggaagtcacggccaaatggctttgggggttcctgagcagaaataagaagccccggatctgcacccgcgaggaatttacaagaaaagtgcggtctaacgctgccattggagctgttttcgtggatgagaatcagtggaacagcgccaaggaggccgtcgaagacgagcgcttttgggatctcgtgcatagagaacgggagctgcacaaacagggcaagtgcgcgacctgtgtttataatatgatggggaaacgcgaaaagaagctgggagagttcggcaaagctaaggggtccagagccatctggtacatgtggctcggcgcccggtttctggagttcgaagctcttggattcatgaacgaggaccactggttttctcgcgaaaatagcctgtccggcgtggagggggagggactccataaactgggctacattcttagagatatctctaagatccctgggggaaacatgtatgccgacgatacagctggctgggacacccggattacagaagatgacctgcagaatgaggcccgcatcaccgatattatggaacccgagcacgcgctcctggccaaaagcatcttcaagctgacgtaccaaaacaaagtcgtgagagtccagcggcctgctaagaatgggaccgtgatggacgttatttcccgcagagatcagcggggctctggacaggtgggcacatatgggctcaacacctttacaaatatggaagcccaactgatcagacagatggagagcgagggaatcttctcccccagcgaacttgagaccccgaacctggctgaacgcgtcctcgactggctggagaagtacggcgtggaacggcttaaaagaatggccatttctggggacgattgcgtggttaagcctatcgacgatcgctttgcgacggccctgacagctctcaacgacatgggaaaagtgcggaaggatattccccagtgggagccttccaaaggctggaatgactggcagcaagtccccttctgtagccatcactttcaccagctgatcatgaaggatgggagagagattgtggttccttgccgcaaccaggacgaactggtgggccgggccagagtctctcagggagctggctggtccctccgcgagaccgcctgtctgggaaagagctatgctcaaatgtggcagcttatgtacttccatcggagagatctgcgcctcgccgcgaatgccatctgctccgctgtgcccgtcgactggattccgacatctcggaccacgtggagcatccacgcccatcaccagtggatgaccacagaagatatgctgtccgtgtggaacagagtttggatcgaggaaaatccttggatggaggacaaaacccatattagctcttggggagacgtgccctatcttggcaagcgggaggatcaatggtgtgggtccctgatcggactcacagccagagctacctgggccacaaacattcaggtcgcgatcaatcaggtgcgccggctgattggcaacgaaaattacctggactacatgaccagcatgaaaagatttaagaacgagtctgatcccgaaggggctctctggtga

SEQ ID NO: 19369 - RNA, 9879 nt, synthetic construct
  misc_feature 1..9879: note = derived and/or modified CDS sequence (opt5) from DENV-1__JQ045657__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccaccacgcgcctggaaaacatcatgtggaagcagatttctaacgagctcaatcatatcctgcttgaaaacgacatgaaatttacagttgtggtcggagatgtggccggcattctggctcaggggaagaaaatgatccggccgcagcccatggagtacaagtatagctggaagtcctggggaaaagccaagattatcggcgccgacgtgcaaaataccaccttcatcattgatgggcctaacacacccgaatgtcctgacgatcagagagcttggaatatctgggaggtcgaggactacggatttggcattttcaccacgaacatctggctcaaactgcgcgatagctatacacaggtttgcgaccaccggctgatgtctgcggccattaaggattccaaagctgtgcacgccgacatgggctactggatcgaaagcgagaagaatgaaacctggaaacttgccagagcttctttcatcgaggtgaaaacatgtatttggcccaagtcccataccctctggagcaacggggtcctggaatctgagatgatcattccgaaaatctatggaggccctattagccagcacaattaccgccccgggtactttacacaaaccgccggaccttggcatctgggcaagctcgagctggatttcgacctttgcgaagggacgaccgtggttgtggatgagcactgcggaaaccggggcccctccctgagaacaaccacagtcaccggcaaaatcatccacgaatggtgttgccggagctgtacgctccctcccctgcgctttaagggggaggacggatgctggtatggcatggagattagaccggtgaaggaaaaagaggaaaatctggttaagtctatggtgtccgcggggagcggagaggtcgactccttctctcttggcctcctgtgtatcagcattatgatcgaagaggtgatgcggtccagatggtctcgcaaaatgctgatgacagggaccctcgctgtctttttcctgcttattatgggacagctgacatggaacgatctcatccggctgtgcattatggtgggcgccaatgccagcgacagaatgggcatggggaccacctacctggctcttatggccacatttaagatgcgccctatgttcgcggtcggactgctctttagacggctgacgtcccgcgaggtgctcctgcttaccatcggcctgtctctcgtggctagcgtcgaactgcccaactccctggaggaacttggggatggactggccatgggcatcatgattctcaaactgctcacagacttccagagccatcaactgtgggccacccttctgtctctcacatttatcaagaccacgttctccctgcactatgcttggaagacaatggccatggttctgagcattgtgtctctttttcccctgtgtctctccaccaccagccagaaaacaacctggctgcctgtgctcctggggtctcttggatgcaagccgctgacaatgttcctgatcgctgagaataaaatttggggcagaaagtcctggcccctcaacgaaggcatcatggccgtcgggatcgtgagcattctgctttccagcctgctcaaaaacgatgttcctctggcgggacccctcatcgccggcgggatgctgattgcttgttacgtgatctctggaagctccgccgacctttctctggagaaggctgccgaggtcagctgggaagaggaagccgagcattccggcgcttctcacaatattctggtggaagttcaggatgacgggacgatgaaaatcaaggatgaggagcgggacgataccctcacaatcctgcttaaggcgaccctgctcgccgtgagcggagtctatcctctgtccattcccgctacactcttcgtgtggtacttttggcagaaaaagaaacaacgctctggcgtcctgtgggacaccccttcccctcccgaagtggagagagccgttcttgatgacggcatctatcggattatgcagcgcgggctgctgggaagatcccaggtgggcgtcggggtgttccaggaaaacgtttttcatacgatgtggcacgtgacccggggagccgtcctcatgtaccaaggcaagcgcctggagcccagctgggcttctgtgaaaaaggaccttatctcctacgggggaggctggagactgcagggcagctggaatacaggggaggaagtgcaggttattgccgtcgagcccggaaagaaccctaaaaatgtgcagaccgcgcccggcacattcaagacctctgaaggggaggtgggagctatcgccctcgattttaaaccgggcacatccgggagccctattgtcaaccgggaaggaaagatcgtgggcctgtatggcaatggggttgtgacgacctccggaacatacgtctctgccatcgctcaagccaaagcgagccaggagggccccctccctgagattgaagacgaggtgttcagaaagcgcaacctgaccatcatggatcttcaccccgggtccggaaagacccggagatatctgcccgctattgttcgcgaagccatcaaacggaagctgagaacactcattctggcccctacgcgcgtggtcgctagcgagatggccgaagctcttaaaggcatgccgatccggtaccagaccacagccgtgaagtctgagcataccgggaaagagatcgttgacctgatgtgccacgcgacatttaccatgagactcctgtcccccgtgcgcgtccctaattataacatgattatcatggatgaagcccatttcacggaccccagctctattgctgcccggggctacatcagcacaagagtgggaatgggcgaggctgccgccatttttatgaccgctacccctcccgggtccgtggaagcgttccctcaatctaatgccgtcatccaggatgaggaacgggacatcccggagcgcagctggaactccggatatgagtggattacagattttcccggcaagaccgtttggttcgtgccttctatcaagagcgggaatgacattgctaactgtctgcgcaagaatggaaagcgggtgatccagctctcccgcaaaacattcgataccgaataccagaagacgaaaaacaacgactgggactacgtcgtgacaaccgatattagcgagatgggcgccaattttagagccgaccgggttatcgatcccagacgctgccttaagcctgtgattctgaaggacgggcccgaacgggtcatcctggctggcccgatgcctgtgacagttgcctctgcggctcaaagacgcggacggatcggcagaaaccacaataaagagggggatcagtatatttacatgggacagcccctcaacaatgacgaggatcatgcccactggaccgaagccaagatgctgcttgacaacatcaatacgcccgagggcattatccctgctctgttcgaacccgagcgcgaaaaatccgccgcgattgatggggagtatcggctcagaggagaggcccgcaagacctttgtggaactgatgagacggggcgacctgcctgtctggctcagctacaaagtggcttccgaggggttccagtattctgatcgcagatggtgctttgacggcgaacggaacaatcaagtccttgaggaaaacatggatgtggagatctggacaaaggagggagaacgcaaaaagctgagaccgcggtggctggacgccagaacctacagcgaccccctcgctctgcgcgagttcaaggaatttgccgctggccggagatccgtttctggggatcttatcctggagattggaaaactccctcagcacctgacacagcgcgcccagaatgcgctggacaacctcgtgatgcttcataatagcgaacaaggcgggcgggcctatagacacgctatggaggagctgcccgataccatcgaaacactgatgctcctggcccttattgctgtgctgaccggaggcgtcacgctgttctttctgtccggccgggggctgggaaagacaagcatcggcctcctttgtgttatggcctcttccgtgctgctgtggatggccagcgtggagcctcattggattgctgcgtctatcatcctcgagttctttctgatggtccttctgattcccgagccggaccgccagagaacccctcaggataaccagctcgcctacgtggttatcgggctgctgttcatgattctcaccgtggctgccaatgagatgggacttctggaaacaaccaaaaaggacctgggcatcgggcacgtcgccgctgagaaccaccatcacgccgcgatgctcgatgtggacctgcatcccgcctccgcttggacactttacgccgtcgctacgaccattatcacacctatgatgcggcacaccattgaaaacacaaccgccaatatcagcctgacggcgatcgccaaccaagctgccattctcatgggactggataaaggctggcccatctctaagatggacattggcgtgcctctgctcgctcttgggtgctatagccaggttaatcccctgaccctgacagccgctgtgctcatgctggtcgcccattacgcgatcattggaccgggccttcaggccaaggctacccgcgaggcccagaagagaacagctgccgggatcatgaagaaccctaccgtggatggaatcgttgccattgacctggatcccgtggtctatgacgcgaaatttgaaaagcagctcggccagatcatgctgctgattctctgtacgtcccagatccttctgatgcggacaacctgggctctgtgcgagtctattacactcgccaccgggcccctgaccacactttgggagggaagccctggcaaattctggaatacgaccatcgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcattatggaggtggaccggagcgaagccaaggaggggctgaaaagaggagagaccacgaagcacgctgtttcccgcggcacagccaagctccggtggtttgtcgaaagaaatctggtgaaaccggaggggaaggtgatcgatcttggatgtggccgcgggggatggtcttactattgcgctggcctgaaaaaggtcaccgaagttaaaggctacaccaaagggggacccggccacgaggaacctattcccatggccacatacgggtggaacctcgtgaaactgcatagcggaaaggacgtgttctttgtccctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttatatgccctctgtggtcgagaccctggagcaaatgcagcggaaacacggcggcatgcttgtgagaaaccctctgtcccgcaatagcacacatgaaatgtactgggtttcttgcgggaccggaaacatcgtgtccgcggtcaatatgacaagccggatgctcctgaacagatttaccatggcccaccgcaagcccacgtatgagcgggatgtggacctgggcgctgggaccagacacgtggccgtcgaaccggaggttgctaacctcgatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacatgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacaccgccggctgggatacacgcatcaccgaagacgatctccagaacgaggcgagaatcacagacattatggaacctgagcacgccctgcttgctaagtctatcttcaagctgacctatcagaataaagtcgtgcgggttcaacgccccgccaagaacgggacggtgatggatgtcattagcagacgggaccagcgcggctccggacaggtgggcacctacgggctcaatacatttaccaacatggaagctcagctgatcagacaaatggagagcgaggaaattttctctccttccgagctggaaacacccaacctcgccggacgggtgctggattggcttgagaaacatggcgttgaaagactgaagcgcatggcgatcagcggggacgactgtgtggtcaaaccgatcgatgaccggtttgccaccgctctcacggccctgaatgatatgggaaaggtgagaaaggacattcctcagtgggagccctctaaaggctggaacgattggcagcaggttcctttctgctcccaccactttcatcaacttatcatgaaggacgggcgcgagattgtggtcccctgtcggaatcaggatgaactggtgggcagagctcgcgtcagccagggagccggctggtccctccgggagacagcttgcctggggaaatcttatgcccagatgtggcaactgatgtacttccacagacgcgacctccggctggcggccaacgctatctgtagcgccgtgcctgttgattgggtgcccacctccagaacaacctggagcattcatgcccaccatcagtggatgacgaccgaagacatgctttctgtctggaatcgcgtgtggatcgaggaaaacccgtggatggaggataagacacacatttccagctggggagacgttccttatctgggcaaacgggaggaccagtggtgcgggtctctcatcggactgaccgctagagccacatgggcgaccaatatccaagtggctattaaccaggtccggagacttatcggcaatgaaaactacctggattacatgacaagcatgaagcgctttaagaatgagtccgaccccgaaggggccctctggtga

SEQ ID NO: 19370 - RNA, 9879 nt, synthetic construct
  misc_feature 1..9879: note = derived and/or modified CDS sequence (opt5) from DENV-1__JQ045659__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttatcgcgatggacctgggggaactctgtgaagataccatgacctacaaatgcccccgcatcacagaaaccgaacccgacgatgtggactgttggtgcaatgctacggatacctgggtgacatatggaacctgttcccagacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggcgacgcagaacggacggctgatcaccgctaatcccattgtgacagacaaagagaagcctgtcaacatcgaagccgagccgccctttggcgagagctatattgtgatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtgtttaccagcgttggcaaactggtccatcagattttcgggacggcttacggagtgctcttttccggcgtgagctggaccatgaagatcgggattggcgtcctgcttacatggctgggactcaattctagatccaccagcctgtctatgacatgtatcgccgtgggcctggttaccctttacctcggggtgatggtccaggctgattccggatgcgtgattaactggaaaggccgcgaactgaagtgtgggagcggaatcttcgttacaaatgaggtgcacacctggacggaacaatataagtttcaggccgactcccctaaacggctgtctgcggccattggcaaggcttgggaggagggggtctgcggcatcagaagcgccacacgcctcgaaaacatcatgtggaaacagatttccaacgagctgaatcatatccttctggaaaacgacatgaagttcaccgtggttgtgggagatgtcaccggcattctcgctcaggggaaaaagatgatccggccgcaacccatggagtacaaatattcttggaaaagctggggaaaggccaagattatcggcgccgacgtgcagaatacaacctttatcattgatgggcctaacacgcccgaatgtcctgacgatcagagagcttggaatatctgggaggtggaggactacggattcggcatttttacaaccaacatctggctgaagctgcgcgattcccacacacaggtctgcgaccaccggcttatgagcgcggccattaaagattctaaggctgttcatgccgacatgggctattggatcgaatccgagaaaaatgaaacctggaagctcgccagagctagcttcatcgaggtgaagacatgtatttggcccaaatctcacaccctgtggtccaacggggtgctggaaagcgagatgatcattccgaagatctacggaggccctatttctcaacataattatcgccccgggtacttcacgcagaccgccggaccttggcacctcggcaaactggagcttgattttgacctgtgcgaagggacaaccgtcgcggtggatgagcactgcggaaaccggggccccagcctcagaacaaccacggttacaggcaagatcatccatgaatggtgttgccggtcctgtaccctgcctcccctgcgcttcagaggggaggacggatgctggtacggcatggagattcggccggtgaaagaaaaggaggaaaatcttgtcaagagcatggtgtctgctgggtccggagaggttgacagcttttccctcggcctgctgtgtatctctattatgatcgaagaggtgatgagaagccgctggtcccggaaaatgctcatgacagggaccctggccgtcttctttcttctgattatgggacagctcacctggaacgatctgatcagactgtgcattatggtgggcgccaatgcttctgaccgcatgggcatggggacaacgtatcttgccctgatggcgaccttcaagatgagacctatgtttgctgttggactcctgttccggcgcctcacaagcagagaggtgctgcttctgaccatcggcctctccctggtcgcctctatggaactgcccaacagccttgaggaactgggggatggactcgccatgggcatcatgattctgaaactcctgacagactttcaatcccaccagctttgggctaccctgctcagcctgacgttcatcaagacaaccttttctctgcattacgcctggaaaaccatggctatggtgctttccattgtgagcctgttccccctctgtctgtctacaacctcccagaagacaacgtggctccctgtcctgcttgggagcctgggatgcaagccgctgaccatgtttctcatcgccgagaataaaatttggggccggcgctcttggcccctgaacgaaggcatcatggcggttgggatcgtgtccattcttctgagctccctcctgaagaacgatgtgcctctcgccggacccctgatcgctggcgggatgcttattgcctgttatgtcatcagcggatctagcgctgacctgtccctggagaaagccgccgaggtgtcttgggaaaaggaggctgaacacagcggcgcgtcccataatattctcgttgaggtgcaggatgacgggacaatgaaaatcaaggatgaagagagagacgataccctgacaatccttctgaaagccaccctcctggctgtctctggagtgtaccctctcagcattcccgccacgctgttcgtttggtatttctggcaaaagaagaaacagcggtccggcgtgctttgggacaccccttctcccccggaggtcggccgcgccgtgctggatgacgggatctacagaattatgcagcggggactgctcggccgcagccaggtcggggtgggagtttttcaagaaaacgtgttccacacaatgtggcacgtcaccagaggcgctgtgctgatgtatcaggggaagcggcttgagccttcctgggccagcgttaaaaaggacctgatctcttacggaggcggctggagactccaggggtcctggaatacaggagaagaggtgcaggtcattgcggtggagcccggcaaaaaccctaagaatgtgcaaaccgctcccgggacatttaagacgccggaaggagaggttggcgccatcgccctggatttcaaacctgggaccagcggatctcccattgtcaaccgcgaaggcaagatcgtgggcctctacgggaatggagtggtcacaacctccggcacctatgtgagcgctatcgcccaggcgaaggcttcccaggaggggcctctgcccgaaattgaggacgaggtttttcggaagagaaaccttacaatcatggatctgcatcccggatctggcaaaacgcgccggtacctgcctgccattgtgagagaagccatcaagcgcaagctccggaccctgattcttgctccgacaagagtcgtggccagcgagatggctgaagccctgaaagggatgcccatccgctatcaaaccacagcggttaagtccgagcacaccggcaaagaaatcgtggacctcatgtgccatgccacgttcacaatgcggctgctgagccctgtcagagtgcccaattacaacatgattatcatggatgaggctcactttaccgacccttcttccattgccgctcggggatatatcagcacccgcgttggcatgggggaggccgccgctattttcatgacagcgacaccccctggatctgtggaagcctttccgcagagcaatgctgtcatccaggatgaggaaagagacatccccgagcggtcctggaactctggctacgaatggattacagatttccctgggaagaccgtgtggtttgtgcccagcatcaaatccggaaatgacattgccaactgtctccgcaagaatggcaagagagtcatccagctttctcggaaaacgttcgatacagagtatcaaaagaccaaaaacaacgactgggactacgttgtgacaaccgatattagcgagatgggggccaatttcagagctgaccgcgtgatcgatcctcggagatgcctgaagcccgtcattctgaaagacggcccggaacgcgtgatcctcgccggacctatgcccgttacggtggcgtccgctgcccagcggagaggccgcatcgggcggaaccataataaggagggagatcagtacatttatatgggccagcccctgaacaatgacgaagatcacgcccactggaccgaggctaagatgcttctggacaacatcaatacacctgaggggattatccccgccctctttgaacctgagagagaaaagagcgcggccattgatggagagtaccgcctgagaggcgaggctcggaagaccttcgtcgagctgatgcgcagaggggacctcccggtgtggctttcttataaagttgcctccgagggctttcaatacagcgatcggcgctggtgcttcgacggagaaagaaacaatcaggtgctggaggaaaacatggatgtcgagatctggacaaaggaaggcgagcggaaaaagctgagaccccgctggctcgacgctcggacctattccgaccctctggcccttagagagtttaaagagttcgctgccgggcgccggtctgtgagcggagatctgatcctcgagattggcaagctgccccagcatctgacacagagagcgcaaaatgccctcgacaaccttgtcatgctgcacaattccgaacaagggggacgggcttaccgccatgccatggaggaactgcctgataccatcgagacgctcatgctgcttgctctgattgccgtgctcacaggcggcgttaccctgtttttcctgtctgggagaggactcggcaagaccagcatcgggcttctgtgtgtgatggcctccagcgtgctgctctggatggcttctgtcgagccccactggattgcggcctccatcatcctggaatttttccttatggttctgctcattccggagcctgaccggcagcgcacaccccaggataaccaactggcttatgtggtgatcggactgctctttatgattcttaccgtcgccgccaatgaaatgggcctgctggagacaacgaaaaaggacctcgggatcggacacgtggctgttgagaaccatcaccatgccgcgatgctggatgtggaccttcaccctgccagcgcttggaccctgtacgccgtcgctacaaccattatcacacccatgatgagacataccattgaaaacacgaccgccaatatctctctcacagcgatcgccaaccaggctgccattctgatgggcctggataaaggctggcctatctccaagatggacattggggtgcccctccttgctctgggatgctacagccaggtcaatccgctgaccctcacagccgctgtgctgatgcttgttgcccactatgcgatcattggccctgggctgcaagccaaagctacccgggaggcccagaagcgcacggctgccggaatcatgaagaaccccacagtggatggcatcgtcgccattgacctcgatcccgtggtttacgacgcgaaattcgaaaagcagctggggcagatcatgctgctcattctttgtacctctcaaatcctgctgatgagaacaacctgggctctctgcgagagcattaccctggccacaggacctcttacgaccctgtgggaaggctccccgggcaaattttggaatacaaccatcgctgtgtctatggccaacatcttccgggggagctatctcgccggagctggcctggccttctccctgatgaaaagcctcgggggaggccgcagagggacaggagcgcagggcgagacccttggcgagaaatggaagcggcagctgaatcagctgtccaagtctgaatttaacacgtacaaaagaagcgggattatggaggtcgaccgctccgaagccaaggagggactcaaacggggcgaaacaaccaagcacgctgtgtctagagggaccgccaaactgcgctggttcgtggagcggaatcttgttaagcccgagggaaaggtcatcgatctgggctgtgggagaggaggctggagctattactgcgctggcctcaaaaaggtgacagaagtgaaagggtataccaagggaggccctgggcatgaggaacccattcctatggccacatacggatggaacctggtcaaactgcactccggcaaggacgtctttttcattccccctgagaaatgtgatacgctcctttgcgacattggggaatctagcccgaatcccaccatcgaggagggacgcacactgcgggtgctgaagatggtggaaccttggctcagaggcaaccaattttgtattaagatcctgaatccctacatgccttccgtcgtggagacccttgaacagatgcagcgcaaacatggcgggatgctggttcggaaccccctcagcagaaattctacacacgagatgtattgggtgtcctgcggaaccggcaacatcgtcagcgcggtgaatatgacgtctcgcatgctgctgaaccggttcaccatggcccacagaaagccgacatacgagcgcgatgttgacctcggggctggaaccagacatgtggccgtcgaacctgaggtggctaacctggatattatcggccagcggattgaaaatatcaaacacgagcataagtccacatggcactatgacgaagataacccctacaaaacctgggcctatcatgggagctacgaggtgaagccctctggatccgctagctccatggtcaatggcgttgtgaaacttctgacaaaaccttgggacgtgattcccatggtcacccaaatcgccatgacggatacaaccccttttggccagcagcgcgtgttcaaggagaaagttgacaccagaacaccgaaggcgaaacgggggacggcccaaatcatggaagtgaccgctaagtggctctggggatttctgagcagaaacaagcggccccgcatttgtacaagagaggagttcacccggaaagtccgctctaatgccgctatcggcgccgtgtttgttgacgagaaccagtggaatagcgccaaggaagcggtggaggatgagagattctgggaccttgtccaccgggaacgcgagctgcacaaacaggggaagtgcgctacatgcgtgtataacatgatgggaaaaagagaaaagaagctcggcgagtttgggaaagccaagggctcccgggccatttggtacatgtggctgggagctcgcttcctggagttcgaggccctcggctttatgaatgaggatcattggttctctagagaaaacagcctgtccggggttgagggagaaggccttcacaaactggggtacatcctccgggacatttctaagatccctggaggcaatatgtatgctgatgacaccgccgggtgggatacacgcatcaccgaggacgatctgcagaacgaggcgagaattacggacatcatggaacccgagcatgcccttctggctaaaagcatttttaagctcacctaccaaaataaagtggtccgggtgcagcgccctgccaagaacggcacagtcatggatgtgatctccagacgggaccagagaggatctggccaggttgggacctatggactgaatacattcaccaacatggaagctcaactgattcgccagatggagagcgaaggcatcttttcccccagcgagctcgagacgccgaacctggccgaacgggtgcttgattggctggagaagtacggggtcgaaagactcaaacgcatggcgatctctggagacgactgtgtggtgaagcctattgatgaccggttcgccacagctctgaccgcccttaatgatatgggcaaagttagaaaggacatcccccagtgggagccttccaaagggtggaacgattggcagcaagtgcccttttgcagccaccacttccatcagctgattatgaaggacggccgcgaaatcgtcgtgccttgtcggaatcaggatgagctcgttggcagagctcgcgtgtctcagggcgccgggtggtccctgcgggagacagcttgcctgggaaagagctatgcccaaatgtggcagctcatgtactttcacagacgcgacctgcggcttgcggccaacgctatttgttccgccgtccccgtggattggatcccgacctctagaacgacctggagcattcatgcccaccatcagtggatgacaaccgaagacatgctgtccgtctggaatcgggtgtggatcgaggaaaacccttggatggaggataaaacacacatcagctcttggggcgacgttccctatctcgggaagagagaagaccaatggtgcggatccctgattggccttaccgctcgcgccacatgggcgaccaatatccaggtggctattaaccaggtccggagactgatcgggaatgagaactacctcgattacatgacgagcatgaaacgcttcaagaatgagtctgaccccgaaggcgccctgtggtga

SEQ ID NO: 19371 - RNA, 9879 nt, synthetic construct
  misc_feature 1..9879: note = derived and/or modified CDS sequence (opt5) from DENV-1__JQ045661__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtggaggactatggattcggcatttttacgacaaacatctggctgaaacttcgcgattcctacacccaggtctgcgaccaccggctcatgagcgcggccattaaagattctaaggctgttcatgccgacatgggctattggatcgaatccgagaaaaatgaaacatggaagctggccagagctagcttcatcgaggtgaagacctgtacatggcccaaatctcacaccctgtggtccaacggggtgctcgaaagcgagatgattatcccgaagatttacggaggccctatctctcaacataattatcgccccgggtacttcacgcagaccgccggaccttggcacctgggcaaacttgagctggattttgacctctgcgaagggacaaccgtcgtggttgatgagcactgcggaaaccggggccccagcctgagaacaaccacggtgacaggcaagattatccatgaatggtgttgccggtcctgtaccctgcctccccttcgcttcagaggggaggacggatgctggtacggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgacagggacccttgctgtgttctttctgctcatcgttggacagctgacctggaacgatctgattagactttgcatcatgattggcgccaatgcctctgaccgcatgggcatggggacaacgtatctggctctcatggccaccttcaagatgagacctatgtttgcggtgggactgctgttccggcgcctgacaagcagagaggtccttctgctcaccatcggcctgtccctggtggcttctgtggaacttcccaacagcctggaggaactcggggatggactggccatgggcatcatgattctcaaactgcttacagactttcaatcccaccagctgtgggccaccctcctgagcctgacgttcatcaagacaaccttttctcttcattacgcttggaaaaccatggccatggtcctgtccgttgtgagcctcttccccctgtgtctctctacaacctcccagaagacaacgtggctgcctgtgcttctggggagcctgggatgcaagccgctcaccatgtttctgattgctgagaataaaatctggggccggcgctcttggccccttaacgaaggcattatggccgtcgggatcgtgtccatcctgctcagctccctgctcaagaacgatgttcctctggcgggaccccttattgccggcgggatgctgatcgcttgttatgtgattagcggatctagcgccgacctgtccctcgagaaagctgccgaggtctcttgggaagaggaagccgagcacagcggcgcttcccataatatcctggtggaagttcaggatgacgggacaatgaagattaaagatgaggagagagacgatacccttacaatcctgctcaaggcgaccctgctcgccgtgtctggagtctaccctctgagcatccccgctacgcttttcgtgtggtatttctggcagaagaagaagcagcggtccggcgtcctgtgggacaccccttctcccccggaagtggagcgcgccgttctggatgacggcatttacagaatcatgcagcgggggctcctgggacgcagccaggtgggcgtcggggtgtttcaagaaaacgttttccacacaatgtggcacgtgaccagaggagccgtccttatgtatcagggcaaacggctggagccttcctgggctagcgtgaagaaagacctcatttcttacgggggaggctggagactgcagggctcctggaatacaggggaggaagtgcaggttatcgccgtcgagcccggaaagaaccctaaaaatgtgcaaaccgcgcccggcacatttaagacgccggaaggggaggtgggagctattgccctcgatttcaagcctggcaccagcgggtctcccatcgtcaaccgcgaaggaaaaattgtgggcctgtacggcaatggggttgtgacaacctccggaacctatgtcagcgccatcgctcaggccaaggcgtcccaggagggccctcttcccgagatcgaagacgaggtgtttcggaaaagaaacctgacaattatggatctgcatcccgggtctggaaagacgcgccggtacctccctgctatcgttagagaagccattaaacgcaagctgcggacccttatcctggccccgacaagagtggtcgctagcgagatggccgaagctctcaagggcatgcccattcgctatcaaaccacagccgtgaaatccgagcacaccgggaaggagatcgttgacctgatgtgccatgcgacgttcacaatgcggctgctcagccctgtgagagtccccaattacaacatgatcattatggatgaagcccactttaccgacccttcttccatcgctgcccggggctatattagcacccgcgtgggaatgggcgaggctgccgccatcttcatgacagctacaccccctgggtctgtggaagcgtttccgcagagcaatgccgtcattcaggatgaggaaagagacatccccgagcggtcctggaactctggatacgagtggatcacagatttccctggcaaaaccgtttggtttgtgcccagcattaagtccgggaatgacatcgctaactgtcttcgcaaaaatggaaagagagtgattcagctgtctcggaagacgttcgatacagaatatcagaagaccaagaacaacgactgggactacgtcgtgacaaccgatatcagcgagatgggcgccaatttcagagccgaccgcgttattgatcctcggagatgcctgaaacccgtgatcctcaaggacgggccggaacgcgtcattctggctggccctatgcccgtgacggttgcctccgcggctcagcggagaggacgcatcggccggaaccataataaagagggggatcagtacatctatatgggacagccccttaacaatgacgaggatcacgcccactggaccgaagccaagatgctgctcgacaacattaatacacctgagggcatcattcccgctctgtttgaacctgagagagaaaagagcgccgcgatcgatggggagtaccgcctgagaggagaggcccggaaaaccttcgtggaactcatgcgcagaggcgaccttccggtctggctgtcttataaggtggcttccgaggggtttcaatacagcgatcggcgctggtgcttcgacggcgaaagaaacaatcaggtcctggaggaaaacatggatgtggagatttggacaaaagagggagaacggaagaaactcagaccccgctggctggacgcccggacctattccgaccctcttgctctgagagagtttaaggagttcgccgctggccgccggtctgttagcggggatctcatcctggagatcggaaaactgccccagcatctcacacagagagcccaaaatgcgcttgacaacctggtgatgctgcacaattccgaacagggcgggcgggcctaccgccatgctatggaggagctccctgataccattgaaacgctgatgcttctggccctcatcgctgtgctgacaggaggcgtcaccctgtttttcctctctggcagagggcttggaaagaccagcattggcctgctgtgtgttatggcctccagcgtgctcctgtggatggcctctgtggagccccactggatcgctgcgtccattatccttgaatttttcctgatggtcctcctgatcccggagcctgaccggcagcgcacaccccaggataaccaactggcctatgtggttattgggctcctttttatgatcctgaccgtggctgccaatgagatgggactgctcgaaacaacgaagaaagacctgggcattgggcacgtcgccgtggagaaccatcaccatgctgccatgcttgatgtcgacctgcaccctgcgagcgcctggaccctctacgctgtggccacaaccatcattacacccatgatgagacataccatcgaaaacacgaccgctaatatttctctgacagccatcgcgaaccaggccgctatcctgatgggactcgataagggctggcctatttccaaaatggacatcggcgttccccttctggccctggggtgctacagccaggtgaatccgctcaccctgacagctgccgtccttatgctggtggctcactatgccattatcggacctggcctccaagcgaaggccacccgggaggctcagaaacgcacggccgctgggattatgaagaaccccacagttgatggaatcgtggccatcgacctggatcccgtcgtgtacgacgccaagttcgaaaaacagctgggccagattatgctccttatcctgtgtacctctcaaattctgctcatgagaacaacctgggcgctgtgcgagagcatcacccttgctacagggcctctgacgaccctctgggagggatccccgggcaagttttggaatacaaccattgccgtgtctatggctaacatcttccggggcagctatctggccggggccggactggctttctccctcatgaaaagccttggcgggggacgcagaggcacaggggcccagggagaaaccctgggcgagaagtggaaacggcagctgaatcagctctccaagtctgaatttaacacgtacaagagaagcggcatcatggaggttgaccgctccgaagcgaaagaggggctgaagcggggagagacaaccaaatatgccgtctctagaggcaccgctaaacttcgctggttcgtggaacggaatctggtgaaacccgaggggaaggtcattgatctcggatgtggcagagggggatggagctactattgcgccggcctgaagaaagttacagaagtgaagggctacaccaaagggggacctggccacgaggaacccatccctatggctacatacgggtggaacctggtgaagctccattccggaaaagacgtctttttcattccccctgagaagtgtgatacgcttctgtgcgacatcggcgagtctagcccgaatcccaccattgaagaggggcgcacactgcgggtgctcaaaatggttgaaccttggctgagaggaaaccaattttgtatcaagattcttaatccctatatgccttccgtggtcgagaccctggagcagatgcagcgcaagcacggcggcatgctcgtgcggaaccccctgagcagaaattctacacatgaaatgtactgggtttcctgcgggaccggaaacatcgtgagcgccgtcaatatgacgtctcgcatgctgctcaaccggttcaccatggcgcacagaaaaccgacatatgagcgcgatgtggacctgggcgccgggaccagacacgtggctgtcgaacctgaggttgccaaccttgatatcattggacagcggatcgaaaatattaagcatgagcacaaatccacatggcattacgacgaggataacccctataagacctgggcttaccacggcagctatgaagtgaaaccctctgggtccgccagctccatggtgaatggagtcgtgaagctgctcacaaagccttgggacgttatccccatggtgacccaaattgctatgacggatacaaccccttttggccagcagcgcgtcttcaaagagaaggtggacaccagaacaccgaaagccaagcggggcacggcgcaaatcatggaagttaccgccaaatggctgtgggggtttcttagcagaaacaagaagccccggatctgtacacgcgaggagttcaccagaaaagtgcggtctaatgctgccattggagctgtctttgtggacgagaaccagtggaatagcgccaaggaggccgttgaagatgagcgcttctgggacctggtgcatagagaacgggagctccacaaacagggcaagtgcgcgacatgcgtctacaacatgatggggaaacgcgaaaagaagctgggagagtttggcaaagctaaggggtccagagccatctggtacatgtggctgggcgcccggttcctcgagttcgaagctctgggatttatgaatgaggatcactggttctctcgcgaaaacagcctttccggcgtggagggggagggactgcataaactcggctatattctgagagacatctctaagattcctgggggaaatatgtacgccgatgacaccgctggctgggatacacggatcaccgaagacgatcttcagaacgaggcccgcatcacggacattatggaacccgagcacgcgctgctcgccaaaagcatctttaagctgacctatcaaaataaagtcgtgagagttcagcggcctgctaagaacgggacagtgatggatgtcatttcccgcagagaccagcggggctctggacaggtgggcacctacgggctgaatacattcaccaacatggaagcccaactcatcagacagatggagagcgagggaatcttttcccccagcgaactggagacgccgaaccttgctgaacgcgtgctggattggctcgagaagtatggcgttgaacggctgaaaagaatggccatctctggggacgactgtgtggtcaagcctatcgatgaccgcttcgcgacagcccttaccgctctgaatgatatgggaaaagtgcggaaggacattccccagtgggagccttccaaaggctggaacgattggcagcaagttcccttttgcagccatcacttccaccagctcatcatgaaggacgggagagagattgtggtcccttgtcgcaatcaggatgaactggtgggccgggccagagtctctcagggagctggctggtccctgcgcgagacagcctgcctcggaaagagctacgctcaaatgtggcagctgatgtattttcatcggagagaccttcgcctggccgcgaacgccatctgttccgctgtgcccgttgattggattccgacctctcggacgacctggagcatccacgcccatcaccagtggatgacaaccgaagacatgctctccgtgtggaatagagtctggattgaggaaaacccttggatggaggataaaacacatatcagctcttggggagacgtgccctacctgggcaagcgggaggaccaatggtgcgggtcccttatcggactgaccgccagagctacatgggccaccaatattcaggttgcgatcaaccaggtgcgccggctcattggcaatgaaaactacctggattatatgacgagcatgaaaagattcaagaatgagtctgaccccgaaggggctctgtggtga

SEQ ID NO: 19372 - RNA, 9879 nt, synthetic construct
  misc_feature 1..9879: note = derived and/or modified CDS sequence (opt5) from DENV-1__JQ045663__SS-prME
  source 1..9879: mol_type = other RNA
agcgtgaccatgctgctgatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagctgaccgtggttgtgggagatgtcgccggcattctggctcaggggaaaaagatgatccggccgcaacccatggagtacaaatattcttggaaaagctggggaaaggccaagattatcggcgccgacgtgcagaataccacattcatcattgatgggccttccacccccgaatgtcctgacgatcagagagcttggaacatctgggaggtggaggactacggatttggcattttcacgacaaatatctggcttaagctccgcgatagccacacccaggtctgcgaccaccggctgatgtctgcggccattaaagattccaaggctgttcatgccgacatgggctattggatcgaaagcgagaaaaacgaaacatggaagctggccagagcttcttttatcgaggtgaagacctgtatttggcccaaatcccacacactctggagcaatggggtgctggaatctgagatgatcattccgaagatctacggaggccctattagccaacataactatcgccccgggtacttcacccagacggccggaccttggcaccttggcaaactggagctcgatttcgacctgtgcgaagggaccacagtcgtggttgatgagcactgcggaaatcggggcccctccctgagaaccacaaccgtgacgggcaagatcatccatgaatggtgttgccggagctgtacacttcctcccctccgctttagaggggaggacggatgctggtacggcatggagattcggccggtcaaagaaaaggaggaaaacctggtgaagtctatggtttccgcggggagcggagaggtggactccttctctctgggcctcctgtgtatcagcattatgatcgaagaggtcatgagatcccgctggtctcggaaaatgcttatgaccgggacactggctgtgtttttcctcctgattatgggacagctgacctggaatgatcttatcagactgtgcattatggttggcgccaacgccagcgaccgcatgggcatggggaccacatatctcgctctgatggccacgtttaagatgagacctatgttcgcggtgggactcctgtttcggcgccttacctccagagaggtcctgctcctgacaatcggcctgtctcttgtggctagcgtggaactgcccaattccctcgaggaactgggggatggactcgccatgggcatcatgattctgaaacttctgaccgacttccaaagccaccagctctgggccacactgctgtctcttacctttatcaagacgacattctccctgcattacgcttggaaaaccatggccatggtcctcagcattgtttctctgtttcccctctgtctgtccaccacaagccagaagaccacatggcttcctgtgctgctggggtctctcggatgcaagccgctgacgatgttccttatcgctgagaacaaaatttggggccggcgctcctggcccctgaatgaaggcatcatggccgtggggatcgtcagcattctcctgtccagcctcctgaagaacgatgtgcctcttgcgggacccctgatcgccggcgggatgctgattgcttgttatgttatctctggaagctccgccgacctctctctggagaaagctgccgaggtgagctgggaagaggaagccgagcactccggcgcttctcataacattcttgtcgaagtgcaggatgacgggaccatgaagatcaaagatgaggagagagacgatacactgaccatcctcctgaaggcgacactcctggccgttagcggagtgtaccctctttccattcccgctaccctgtttgtctggtatttctggcagaagaagaagcagcggtctggcgtgctgtgggacacgcctagccctcccgaagtcgagcgcgccgtgctcgatgacggcatctacagaattatgcagcgggggctgcttggacgctcccaggttggcgtgggggtcttccaagaaaatgtgtttcacaccatgtggcacgttacaagaggagccgtgctgatgtatcagggcaaacggctcgagcccagctgggcttctgtcaagaaagacctgatctcctacgggggaggctggagactccagggcagctggaacaccggggaggaagtccaggtgattgccgttgagcccggcaaaaattctaaaaacgtccaaacagcgcctggaaccttcaagacacccgaaggggaggtgggagctatcgccctggattttaagccgggcacgtccgggagccctattgtgaatcgcgaaggaaaaatcgtcggcctttacggcaacggggtggttaccacatccggaacctatgtgtctgccatcgctcaggccaaggcgagccaggagggccccctgcctgagattgaagacgaggtcttccggaaaagaaatctgaccatcatggatctccatcccgggtccggaaagacacgccggtacctgcccgctattgtgagagaagccatcaaacgcaaacttcggacgctgattctcgcccctaccagagttgtggctagcgagatggccgaagctctgaagggcatgccgatccgctatcaaacaaccgccgtcaaatctgagcacacagggaaggagatcgtggacctgatgtgccatgcgacctttacgatgcggctcctttcccccgttagagtgcctaactacaatatgattatcatggatgaagcccacttcacagaccccagctctattgctgcccggggctatatcagcacccgcgtcggaatgggcgaggctgccgccatttttatgaccgctacacctcccgggtccgtggaagcgttccctcagtctaacgccgtgatccaggatgaggaaagagacatcccggagcggagctggaactccggatacgagtggattaccgattttcccggcaaaacagtctggttcgttccttctatcaagagcgggaacgacattgctaattgtctgcgcaaaaacggaaagagagtgatccagctgtcccggaagacctttgatacggaatatcagaagacaaagaataacgactgggactacgtggtcaccacagatattagcgagatgggcgccaacttcagagccgaccgcgtgatcgatccccggagatgcctcaaacctgttattctgaaggacgggcccgaacgcgtgatccttgctggcccgatgcctgtcaccgtggcctctgcggctcagcggagaggacgcatcggccggaatcataacaaagagggggatcagtacatttatatgggacagcccctgaataacgacgaggatcacgcccactggacggaagccaagatgctcctggacaatatcaacacccccgagggcattatccctgctctgttcgaacccgagagagaaaagtccgccgcgattgatggggagtaccgcctcagaggagaggcccggaaaacatttgttgaacttatgcgcagaggcgacctgcctgtgtggctgagctataaggtcgcttccgaggggttccaatactctgatcggcgctggtgctttgacggcgaaagaaataaccaggtgctcgaggaaaatatggatgtcgagatctggaccaaagagggagaacggaagaaactgagaccgcgctggcttgacgcccggacatatagcgaccccctggctctcagagagttcaaggaatttgccgctggccgccggtccgtgtctggggatctgatcctggagattggaaaactccctcagcatcttacccagagagcccaaaacgcgctggacaatctggttatgctccacaacagcgaacagggcgggcgggcctaccgccatgctatggaggagctgcccgatacaatcgaaacccttatgctgctcgccctgattgctgtgctgacgggaggcgtgacactcttccttctgtccggcagagggctgggaaagaccagcatcggcctcctgtgtgtcatggcctcttccgttcttctgtggatggccagcgtggagcctcactggattgctgcgtctatcatcctcgaatttttcctgatggtgctgctcattcccgagccggaccggcagcgcacccctcaggataatcaacttgcctatgtcgtgatcgggctgctgtttatgattctcacagttgctgccaacgagatgggactgcttgaaaccacaaagaaagacctgggcatcgggcacgtggccgtcgagaatcatcaccatgctgccatgctcgatgtggacctgcaccccgcgtccgcctggacgctgtacgctgtcgccaccacaattatcacccctatgatgagacatacaattgaaaacaccacggctaacatcagcctcaccgccatcgcgaatcaggccgctattcttatgggactggataagggctggcccatctctaaaatggacattggcgtgcctctgctcgccctggggtgctacagccaggttaacccccttacactgaccgctgccgtgctcatgctggtcgctcactatgccatcattggaccgggcctgcaagcgaaggccacacgggaggctcagaaacgcaccgccgctgggatcatgaagaatcctacggtggatggaatcgttgccattgacctcgatcccgtggtctacgacgccaagttcgaaaaacagcttggccagatcatgctgctgattctctgtacatcccaaatcctgcttatgagaaccacatgggcgctgtgcgagtctattaccctcgctaccgggcccctgacaacgctgtgggagggaagccctggcaagttttggaacaccacaatcgccgtgtccatggctaatatcttccggggcagctatctcgccggggccggacttgctttttccctgatgaaatctctgggcgggggacgcagaggcaccggggcccagggagaaacactcggcgagaagtggaaacggcagctgaaccagcttagcaagtccgagttcaatacctacaagagatctggcattatggaggtggaccgcagcgaagcgaaagaggggctgaagcggggagagacgacaaaacacgccgtttccagaggcaccgctaagctccgctggttcgtcgaacggaacctggtgaaaccggaggggaaggtgatcgatctgggatgtggcagagggggatggtcttattactgcgccggcctcaagaaagtcaccgaagttaagggctatacaaaagggggacccggccatgaggaacctattcccatggctacctacgggtggaatcttgtgaagctgcacagcggaaaagacgtgtttttcatccctcccgagaagtgtgatacactgctctgcgacattggcgagtccagccctaacccgacgatcgaagaggggcgcaccctgcgggtccttaaaatggtggaaccctggctgagaggaaatcaattttgtattaagatcctcaacccttacatgccctctgttgtggagacactggagcagatgcagcgcaagcatggcggcatgctggtccggaatcctctctccagaaacagcacccacgaaatgtattgggtgtcttgcgggacaggaaatatcgtttccgccgtgaacatgaccagccgcatgctgcttaatcggttcacgatggcgcacagaaaacccacctacgagcgcgatgtcgacctgggcgccgggacaagacatgtggctgtggaaccggaggtcgccaacctcgatattatcggacagcggattgaaaacatcaagcacgagcataaatctacctggcactatgacgaggataatccttacaagacatgggcttatcatggctcctacgaagttaaacccagcgggtccgccagctctatggtgaacggagtggtcaagctgcttaccaagccctgggacgtgattcctatggttacacaaatcgctatgaccgatacgacaccctttggccagcagcgcgtgttcaaagagaaggtcgacaccagaacccctaaagccaagcggggcacagcgcaaatcatggaagtgacggccaaatggctgtgggggtttctcagcagaaataagaagccgcggatttgtacccgcgaggagttcacaagaaaagttcggtccaacgctgccatcggagctgtgtttgtcgacgagaatcagtggaactctgccaaggaggccgtggaagatgagcgcttctgggacctggttcacagagaacgggagctgcacaaacagggcaagtgcgcgacctgcgtgtataatatgatggggaaacgcgaaaagaagctcggagagtttggcaaagctaaggggagcagagccatttggtacatgtggctgggcgcccggttccttgagtttgaagctctgggattcatgaacgaggatcattggttctcccgcgaaaattctctcagcggcgtcgagggggagggactgcacaaacttggctacatcctgagagacatttccaagatccccgggggaaacatgtatgccgatgacacagctggctgggatacccggatcacagaagacgatctccagaatgaggcccgcattaccgacatcatggaacctgagcatgcgctgctggccaaatctatttttaagctcacgtaccaaaacaaagtggtcagagtgcagcggcccgctaagaatgggaccgttatggatgtgatcagccgcagagaccagcggggctccggacaggtcggcacatatgggctgaacaccttcacaaatatggaagcccaacttattagacagatggagagcgagggaatcttttctccttccgaactggagacccccaacctcgctgaacgcgtgctggattggcttgagaagtacggcgtggaacggctgaaaagaatggccatcagcggggacgactgtgttgtgaagccgattgatgaccgcttcgcgacggccctcacagctctgaacgatatgggaaaagtccggaaggacatccctcagtgggagccctctaaaggctggaatgattggcagcaagtgcctttttgctcccaccacttccatcagctgattatgaaggacgggagagagatcgttgtgccctgtcgcaaccaggatgaactcgtcggccgggccagagtgagccagggagctggctggtccctgcgcgagaccgcctgccttgggaagtcttatgctcaaatgtggcagctgatgtactttcaccggagagacctccgcctggccgcgaatgccatttgtagcgctgtccctgtggattggatccccacatcccggaccacgtggagcattcatgcccaccatcagtggatgaccacagaagacatgctttctgtttggaacagagtgtggatcgaggaaaatccgtggatggaggataaaacccacatctccagctggggagacgtcccttatctgggcaagcgggaggaccaatggtgcgggtctctcattggactgacagccagagctacctgggccacaaacatccaggtggcgattaatcaggttcgccggctgatcggcaacgaaaattacctcgattacatgaccagcatgaaaagattcaagaacgagtccgaccccgaaggggctctgtggtga

SEQ ID NO: 19373 - RNA, 9879 nt, synthetic construct
  misc_feature 1..9879: note = derived and/or modified CDS sequence (opt5) from DENV-1__JQ045665__SS-prME
  source 1..9879: mol_type = other RNA
agcgtgaccatgctgctgatgctgatgcccacagcccttgctttccacctgacggccagaggcggggaacctcatatgatcgtctccaagcaagaacggggaaaatctctcctgtttaagaccagcgccggcgttaatatgtgcacccttattgctatggacctgggggaactctgtgaagataccatgacatacaaatgcccccgcatcaccgaaacagaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaactggccgagacccagcacggaaccgtcctggtgcagattaagtacgagggcacagacgcgccgtgcaaaatccctttctccacccaagatgaaaagggggctacacagaacggacggcttatcacggccaatcccattgttaccgacaaagagaagcctgtgaacatcgaagccgagccgccctttggcgagagctatattgtcatcggggctggagaaaaagccctcaagctgtcttggttcaagaaaggcagctccattgggaagatgtttgaggctacagccagaggcgcgcgccggatggccatcctgggagataccgcttgggacttcggctctatcgggggagtgtttacaagcgtgggcaaactcgttcatcagattttcgggaccgcctacggagtcctgttttccggcgtgagctggacgatgaagatcgggattggcgtgcttctgacctggctcggactcaattctagatccacaagcctgtctatgacctgtatcgctgtcggccttgtgacactctacctgggggttatggtgcaggccgattccggatgcgtcattaactggaaaggccgcgaactgaagtgtgggagcggaatcttcgtgaccaatgaggttcacacatggaccgaacaatataagtttcaggcggactcccctaaacggctctctgccgctattggcaaggcctgggaggagggggtgtgcggcatcagaagcgctacgcgcctggaaaacatcatgtggaaacagatttccaacgagcttaatcatatcctgctcgaaaacgacatgaagttcacagtcgtggttggagatgtggccggcattctggcccaggggaaaaagatgatccggccgcaacccatggagtacaaatattcttggaaaagctggggaaaggctaagattatcggcgcggacgtccagaataccacctttatcattgatgggcctaacacacccgaatgtcctgacgatcagagagcctggaatatctgggaggtggaggactacggattcggcatttttaccacgaacatctggctgaaacttcgcgattcctatacacaggtgtgcgaccaccggctcatgagcgctgccattaaagattctaaggccgtccacgctgacatgggctactggatcgaatccgagaaaaatgaaacctggaagctggccagagcgagcttcatcgaggttaagacatgtatttggcccaaatctcataccctgtggtccaacggggtgctcgaaagcgagatgatcattccgaagatctatggaggccctatttctcaacacaattaccgccccgggtacttcacacagaccgctggaccttggcatctgggcaaacttgagctggattttgacctctgcgaagggacgaccgtggtcgtgaacgagcactgcggaaatcggggccccagcctgagaacaaccacagttaccggcaagatcatccacgaatggtgttgccggtcctgtacgctgcctccccttcgcttcagaggggaggatggatgctggtatggcatggagattcggccggtgaaagaaaaggaggaaaacctcgtcaagagcatggtgtctgccgggtccggagaggttgacagcttttccctgggcctgctctgtatctctattatgatcgaagaggtgatgagaagccgcctgtcccggaaaatgcttatgacagggaccctggccgtcttctttctcctgattatgggacagctgacatggaatgaccttatcagactgtgcattatggtgggcgctaacgcctctgatcgcatgggcatggggaccacctacctcgcgctgatggctacattcaagatgagacctatgtttgccgttggactcctgttccggcgccttacgagcagagaggtgctgctcctgaccatcggcctgtcccttgtcgcctctgtggaactgcccaatagcctcgaggaactgggggacggactcgctatgggcatcatgattctgaaacttctgacagattttcaatcccatcagctctgggccaccctgctgagccttacattcatcaagaccacgttttctctgcaccatgcttggaaaacaatggccatgattctctccatcgtgagcctgttccccctctgtctgtctaccacctcccagaagacaacctggcttcctgtcctgctggggagcctcggatgcaagccgctgacaatgtttcttattgcggagaacaaaatctggggccggcgctcttggcccctgaacgaaggcatcatggccgttgggattgtgtccatcctcctgagctccctcctgaagaatgacgtgcctcttgctggacccctgattgccggcgggatgctgatcgcttgttatgtcattagcggatctagcgccgatctctccctggagaaagccgctgaggtgtcttgggaagaggaagcggagcacagcggcgcctcccataacatccttgttgaagtgcaggacgatgggacgatgaagatcaaagacgaggagagagatgacaccctgacaattctcctgaaggctaccctcctggccgtctctggagtgtaccctcttagcatccccgccacactgttcgtttggtatttctggcagaagaagaagcagcggtccggcgtgctgtgggataccccttctcccccggaagtcgagcgcgctgtgctcgacgatggcatttacagaatcatgcagcgggggctgcttggacgcagccaggtcggcgtgggggtttttcaagaaaatgtgttccacacgatgtggcacgtcaccagaggagccgtgctgatgtatcagggcaaacggctcgagccttcctgggcgagcgttaagaaagacctgatttcttacgggggaggctggagactccagggctcctggaacacaggggaggaagtgcaggtcatcgctgtggagcccggaaagaatcctaaaaacgtgcaaaccgcccccggcacatttaagaccccggaaggggaggttggagccattgctctggacttcaagcctggcacaagcgggtctcccatcgtcaatcgcgaaggaaaaatcgtgggcctttacggcaacggggtggtcacgacctccggaacatatgtgagcgccattgcgcaggctaaggcctcccaggagggccctctgcccgagatcgaagatgaggtttttcggaaaagaaatctgaccattatggacctccatcccgggtctggaaagacccgccggtacctgcctgccatcgtgagagaagctattaaacgcaaacttcggacactgatcctcgccccgacgagagtcgtggctagcgagatggccgaagcgctgaagggcatgcccatccgctatcaaaccacagccgttaaatccgagcacaccgggaaggagattgtggatctgatgtgccatgctacattcaccatgcggctccttagccctgtcagagtgcccaactacaatatgatcattatggacgaagcccactttacggatccttcttccatcgctgcccggggctatattagcacacgcgttggaatgggcgaggccgctgcgatcttcatgaccgccacaccccctgggtctgtggaggcttttccgcagagcaacgccgtcatccaggacgaggaaagagatattcccgagcggtcctggaactctggatacgagtggatcacagacttccctggcaaaaccgtgtggtttgtgcccagcattaagtccgggaacgatatcgccaattgtctgcgcaaaaacggaaagagagtcattcagctgtctcggaagacattcgacaccgaatatcagaagacgaagaacaatgattgggactacgttgtgacaaccgacatcagcgagatgggcgctaacttcagagccgatcgcgtgattgaccctcggagatgcctcaaacccgtcatcctgaaggatgggccggaacgcgtgatccttgcgggccctatgcccgttacagtggcttccgccgcccagcggagaggacgcattggccggaatcataacaaagagggggaccagtacatctatatgggacagcccctgaataacgatgaggaccacgctcactggaccgaagccaagatgctcctggataatattaacacgcctgagggcatcattcccgcgctgtttgaacctgagagagaaaagagcgccgctatcgacggggagtaccgcctcagaggagaggcccggaaatctttcgtcgaacttatgcgcagaggcgatctgccggtgtggctgtcctataaggttgctagcgaggggtttcaatactccgaccggcgctggtgcttcgatggcgaaagaaataaccaggtgctcgaggaaaatatggacgtcgagatctggaccaaagagggagaacggaagaaactgagaccccgctggcttgatgcccggacatattctgaccctctggctctcagagagtttaaggagttcgccgcgggccgccggagcgtgtccggggacctgattctggagatcggaaaactcccccagcatcttacccagagagcccaaaacgctctggataatctggtcatgctccacaactctgaacagggcgggcgggcctaccgccatgctatggaggagctgcctgacacaattgaaacccttatgctgctcgccctgatcgccgtgctgacaggaggcgttaccctctttttccttagcggcagagggctgggaaagacgtccattggcctgctctgtgtgatggctagctctgtgctgctttggatggcgtccgtcgagccccactggatcgccgctagcatcattctggaatttttcctcatggttctgctgatcccggagcctgatcggcagcgcacaccccaggacaatcaactcgcctatgtggtgattgggcttctgtttatgatcctgaccgtcgccgctaacgagatgggactcctggaaaccacaaagaaagatcttggcattgggcacgtggccgttgagaaccatcaccatgcggccatgctggacgtggatctccaccctgcttctgcctggaccctgtacgctgtcgccacaacgatcattacccccatgatgagacatacaatcgaaaataccacagcgaacatctccctgaccgccattgctaatcaggccgctatcctcatgggacttgacaagggctggcctattagcaaaatggatatcggcgtgcccctgctggccctcgggtgctactctcaggtcaacccgctgacgcttaccgctgccgtgctgatgctcgttgcgcactatgccattatcggacctggcctgcaagctaaggccacacgggaggctcagaaacgcaccgccgccgggatcatgaagaatcccacagtggacggaattgtcgcgatcgatctggaccccgtggtttacgatgctaagttcgaaaaacagctcggccagattatgcttctgatcctgtgtaccagccaaattctcctgatgagaacgacatgggccctttgcgagtccatcaccctggctacagggcctctcaccaccctgtgggagggatctccgggcaagttttggaacacaacgatcgccgtgagcatggccaatattttccggggctcctatctggctggggccggactcgcgttcagccttatgaaatccctgggcgggggacgcagaggcaccggggcccagggagaaacactgggcgagaagtggaaacggcagctcaaccagctgtctaagagcgaatttaatacctacaagagatccggcatcatggaggtcgaccgctctgaagctaaagaggggcttaagcggggagagacaaccaaacacgccgtgagcagaggcacggctaagctgcgctggttcgtggaacggaacctcgttaaacccgaggggaaggtcattgacctgggatgtggcagagggggatggtcctattactgcgccggcctgaagaaagtgacagaagtgaagggctataccaaagggggacctggccatgaggaacccatccctatggcgacctacgggtggaatctcgtcaaacttcactctggaaaagatgtgtttttcattccccctgagaagtgtgacacactgctgtgcgatatcggcgagagctccccgaaccccaccattgaagaggggcgcacactccgggttctgaaaatggtggaaccttggcttagaggaaatcaattttgtatcaagatcctgaacccctacatgcctagcgtcgtggagacgctcgagcagatgcagcgccggcatggcggcatgctggttagaaatcccctgtctcgcaactccacccacgaaatgtattgggtgagctgcgggacaggaaatattgtctctgccgtgaacatgacctcccggatgctcctgaacagattcacaatggctcaccgcaagccgacctacgagagagacgttgatcttggcgccgggacgcggcatgtggctgtcgaacctgaggtggccaatctggacatcattggacagcgcatcgaaaacattaaacacgagcataagagcacctggcactatgatgaggacaatccctacaaaacatgggcttatcatggctcttacgaagtgaagccctccgggagcgcctccagcatggtcaacggagttgtgaaactcctgaccaagccttgggatgtgatccccatggtcacacaaatcgcgatgaccgacacaaccccttttggccagcagagagtgttcaaggagaaagttgatacgcggacaccgaaggccaaaagaggcaccgctcaaattatggaagtgaccgccaagtggctttgggggtttctgtctcggaataaaaagccccgcatctgtacaagagaggagttcacgcggaaggtccgcagcaacgctgccattggagccgtgtttgttgacgagaatcagtggaactccgcgaaagaggctgtggaagacgagagattctgggatctcgtccaccgggaacgcgagctgcacaagcagggcaaatgcgcgacctgcgtgtataatatgatggggaagagagagaagaagctgggagagtttggcaaggccaaagggtctcgggctatctggtacatgtggctcggcgcccgcttcctggagttcgaagctcttggatttatgaacgaggaccattggttcagcagagaaaattccctgtctggcgttgagggggagggactccacaagctgggctacattcttcgggatatcagcaaaatccctgggggaaacatgtatgccgacgatacagcgggctgggacacccgcattacagaagatgacctgcagaatgaggccagaatcaccgatattatggaacccgagcatgctctcctggccaagtccatctttaaactgacataccaaaacaaggtggtccgggtgcagcgccctgctaaaaatgggaccgtcatggacgtgatttctagacgggatcagagaggcagcggacaggttggcacgtatgggctcaacaccttcacaaacatggaagcccaactgatccgccagatggagtccgagggaatctttagcccctctgaacttgagaccccgaatctggcggaacgggtgctcgactggctggagaagtacggcgtcgaaagacttaagcgcatggccatttccggggatgactgtgtggtgaaacctatcgacgatcggttcgctacagccctgaccgctctcaacgacatgggaaaggttagaaaagatattccccagtgggagcctagcaagggctggaatgactggcagcaagtgcccttttgctctcaccacttccatcagctgatcatgaaagatgggcgcgagattgtcgtgccttgtcggaaccaggacgaactggttggcagagcccgcgtgtcccagggagctggctggagcctccgggagacggcctgcctggggaagtcctatgcgcaaatgtggcagcttatgtactttcacagacgcgatctgcggctcgccgctaatgccatctgttctgccgtccccgtggactggattccgacaacctgcacaacctggagcatccatgctcaccatcagtggatgacgaccgaagatatgctgtccgtctggaacagagtgtggatcgaggaaaatccttggatggaggacaagacacacattagctcttggggagatgttccctatcttggcaaacgggaggaccaatggtgtgggtccctgatcggactcaccgccagagcgacatgggctaccaacattcaggtggccatcaatcaggtccgccggctgattggcaacgaaaattacctggactacatgacaagcatgaagagattcaaaaacgagtctgatcccgaaggggccctctggtga

SEQ ID NO: 19374 - RNA, 9879 nt, synthetic construct
  misc_feature 1..9879: note = derived and/or modified CDS sequence (opt5) from DENV-1__JQ045666__SS-prME
  source 1..9879: mol_type = other RNA
agcgtgaccatgctgctgatgctgatgcccacagcccttgctttccacctgacggccagaggcggggaacctcatatgatcgtctccaagcaagaacggggaaaatctctcctgtttaagaccagcgccggcgttaatatgtgcacccttattgctatggacctgggggaactctgtgaagataccatgacatacaaatgcccccgcatcaccgaaacagaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaactggccgagacccagcacggaaccgtcctggtgcagattaagtacgagggcacagacgcgccgtgcaaaatccctttctccacccaagatgaaaagggggctacacagaacggacggcttatcacggccaatcccattgttaccgacaaagagaagcctgtgaacatcgaagccgagccgccctttggcgagagctatattgtcatcggggctggagaaaaagccctcaagctgtcttggttcaagaaaggcagctccattgggaagatgtttgaggctacagccagaggcgcgcgccggatggccatcctgggagataccgcttgggacttcggctctatcgggggagtgtttacaagcgtgggcaaactcgttcatcagattttcgggaccgcctacggagtcctgttttccggcgtgagctggacgatgaagatcgggattggcgtgcttctgacctggctcggactcaattctagatccacaagcctgtctatgacctgtatcgctgtcggccttgtgacactctacctgggggttatggtgcaggccgattccggatgcgtcattaactggaaaggccgcgaactgaagtgtgggagcggaatcttcgtgaccaatgaggttcacacatggaccgaacaatataagtttcaggcggactcccctaaacggctctctgccgctattggcaaggcctgggaggagggggtgtgcggcatcagaagcgctacgcgcctggaaaacatcatgtggaaacagatttccaacgagcttaatcatatcctgctcgaaaacgacatgaagttcacagtcgtggttggagatgtggccggcattctggcccaggggaaaaagatgatccggccgcaacccatggagtacaaatattcttggaaaagctggggaaaggctaagattatcggcgcggacgtccagaataccacctttatcattgatgggcctaacacacccgaatgtcctgacgatcagagagcctggaatatctgggaggtggaggactacggattcggcatttttaccacgaacatctggctgaaacttcgcgattcctatacacaggtgtgcgaccaccggctcatgagcgctgccattaaagattctaaggccgtccacgctgacatgggctactggatcgaatccgagaaaaatgaaacctggaagctggccagagcgagcttcatcgaggttaagacatgtatttggcccaaatctcataccctgtggtccaacggggtgctcgaaagcgagatgatcattccgaagatctatggaggccctatttctcaacacaattaccgccccgggtacttcacacagaccgctggaccttggcatctgggcaaacttgagctggattttgacctctgcgaagggacgaccgtggtcgtgaacgagcactgcggaaatcggggccccagcctgagaacaaccacagttaccggcaagatcatccacgaatggtgttgccggtcctgtacgctgcctccccttcgcttcagaggggaggatggatgctggtatggcatggagattcggccggtgaaagaaaaggaggaaaacctcgtcaagagcatggtgtctgccgggtccggagaggttgacagcttttccctgggcctgctctgtatctctattatgatcgaagaggtgatgagaagccgcctgtcccggaaaatgcttatgacagggaccctggccgtcttctttctcctgattatgggacagctgacatggaatgaccttatcagactgtgcattatggtgggcgctaacgcctctgatcgcatgggcatggggaccacctacctcgcgctgatggctacattcaagatgagacctatgtttgccgttggactcctgttccggcgccttacgagcagagaggtgctgctcctgaccatcggcctgtcccttgtcgcctctgtggaactgcccaatagcctcgaggaactgggggacggactcgctatgggcatcatgattctgaaacttctgacagattttcaatcccatcagctctgggccaccctgctgagccttacattcatcaagaccacgttttctctgcaccatgcttggaaaacaatggccatgattctctccatcgtgagcctgttccccctctgtctgtctaccacctcccagaagacaacctggcttcctgtcctgctggggagcctcggatgcaagccgctgacaatgtttcttattgcggagaacaaaatctggggccggcgctcttggcccctgaacgaaggcatcatggccgttgggattgtgtccatcctcctgagctccctcctgaagaatgacgtgcctcttgctggacccctgattgccggcgggatgctgatcgcttgttatgtcattagcggatctagcgccgatctctccctggagaaagccgctgaggtgtcttgggaagaggaagcggagcacagcggcgcctcccataacatccttgttgaagtgcaggacgatgggacgatgaagatcaaagacgaggagagagatgacaccctgacaattctcctgaaggctaccctcctggccgtctctggagtgtaccctcttagcatccccgccacactgttcgtttggtatttctggcagaagaagaagcagcggtccggcgtgctgtgggataccccttctcccccggaagtcgagcgcgctgtgctcgacgatggcatttacagaatcatgcagcgggggctgcttggacgcagccaggtcggcgtgggggtttttcaagaaaatgtgttccacacgatgtggcacgtcaccagaggagccgtgctgatgtatcagggcaaacggctcgagccttcctgggcgagcgttaagaaagacctgatttcttacgggggaggctggagactccagggctcctggaacacaggggaggaagtgcaggtcatcgctgtggagcccggaaagaatcctaaaaacgtgcaaaccgcccccggcacatttaagaccccggaaggggaggttggagccattgctctggacttcaagcctggcacaagcgggtctcccatcgtcaatcgcgaaggaaaaatcgtgggcctttacggcaacggggtggtcacgacctccggaacatatgtgagcgccattgcgcaggctaaggcctcccaggagggccctctgcccgagatcgaagatgaggtttttcggaaaagaaatctgaccattatggacctccatcccgggtctggaaagacccgccggtacctgcctgccatcgtgagagaagctattaaacgcaaacttcggacactgatcctcgccccgacgagagtcgtggctagcgagatggccgaagcgctgaagggcatgcccatccgctatcaaaccacagccgttaaatccgagcacaccgggaaggagattgtggatctgatgtgccatgctacattcaccatgcggctccttagccctgtcagagtgcccaactacaatatgatcattatggacgaagcccactttacggatccttcttccatcgctgcccggggctatattagcacacgcgttggaatgggcgaggccgctgcgatcttcatgaccgccacaccccctgggtctgtggaggcttttccgcagagcaacgccgtcatccaggacgaggaaagagatattcccgagcggtcctggaactctggatacgagtggatcacagacttccctggcaaaaccgtgtggtttgtgcccagcattaagtccgggaacgatatcgccaattgtctgcgcaaaaacggaaagagagtcattcagctgtctcggaagacattcgacaccgaatatcagaagacgaagaacaatgattgggactacgttgtgacaaccgacatcagcgagatgggcgctaacttcagagccgatcgcgtgattgaccctcggagatgcctcaaacccgtcatcctgaaggatgggccggaacgcgtgatccttgcgggccctatgcccgttacagtggcttccgccgcccagcggagaggacgcattggccggaatcataacaaagagggggaccagtacatctatatgggacagcccctgaataacgatgaggaccacgctcactggaccgaagccaagatgctcctggataatattaacacgcctgagggcatcattcccgcgctgtttgaacctgagagagaaaagagcgccgctatcgacggggagtaccgcctcagaggagaggcccggaaatctttcgtcgaacttatgcgcagaggcgatctgccggtgtggctgtcctataaggttgctagcgaggggtttcaatactccgaccggcgctggtgcttcgatggcgaaagaaataaccaggtgctcgaggaaaatatggacgtcgagatctggaccaaagagggagaacggaagaaactgagaccccgctggcttgatgcccggacatattctgaccctctggctctcagagagtttaaggagttcgccgcgggccgccggagcgtgtccggggacctgattctggagatcggaaaactcccccagcatcttacccagagagcccaaaacgctctggataatctggtcatgctccacaactctgaacagggcgggcgggcctaccgccatgctatggaggagctgcctgacacaattgaaacccttatgctgctcgccctgatcgccgtgctgacaggaggcgttaccctctttttccttagcggcagagggctgggaaagacgtccattggcctgctctgtgtgatggctagctctgtgctgctttggatggcgtccgtcgagccccactggatcgccgctagcatcattctggaatttttcctcatggttctgctgatcccggagcctgatcggcagcgcacaccccaggacaatcaactcgcctatgtggtgattgggcttctgtttatgatcctgaccgtcgccgctaacgagatgggactcctggaaaccacaaagaaagatcttggcattgggcacgtggccgttgagaaccatcaccatgcggccatgctggacgtggatctccaccctgcttctgcctggaccctgtacgctgtcgccacaacgatcattacccccatgatgagacatacaatcgaaaataccacagcgaacatctccctgaccgccattgctaatcaggccgctatcctcatgggacttgacaagggctggcctattagcaaaatggatatcggcgtgcccctgctggccctcgggtgctactctcaggtcaacccgctgacgcttaccgctgccgtgctgatgctcgttgcgcactatgccattatcggacctggcctgcaagctaaggccacacgggaggctcagaaacgcaccgccgccgggatcatgaagaatcccacagtggacggaattgtcgcgatcgatctggaccccgtggtttacgatgctaagttcgaaaaacagctcggccagattatgcttctgatcctgtgtaccagccaaattctcctgatgagaacgacatgggccctttgcgagtccatcaccctggctacagggcctctcaccaccctgtgggagggatctccgggcaagttttggaacacaacgatcgccgtgagcatggccaatattttccggggctcctatctggctggggccggactcgcgttcagccttatgaaatccctgggcgggggacgcagaggcaccggggcccagggagaaacactgggcgagaagtggaaacggcagctcaaccagctgtctaagagcgaatttaatacctacaagagatccggcatcatggaggtcgaccgctctgaagctaaagaggggcttaagcggggagagacaaccaaacacgccgtgagcagaggcacggctaagctgcgctggttcgtggaacggaacctcgttaaacccgaggggaaggtcattgacctgggatgtggcagagggggatggtcctattactgcgccggcctgaagaaagtgacagaagtgaagggctataccaaagggggacctggccatgaggaacccatccctatggcgacctacgggtggaatctcgtcaaacttcactctggaaaagatgtgtttttcattccccctgagaagtgtgacacactgctgtgcgatatcggcgagagctccccgaaccccaccattgaagaggggcgcacactccgggttctgaaaatggtggaaccttggcttagaggaaatcaattttgtatcaagatcctgaacccctacatgcctagcgtcgtggagacgctcgagcagatgcagcgccggcatggcggcatgctggttagaaatcccctgtctcgcaactccacccacgaaatgtattgggtgagctgcgggacaggaaatattgtctctgccgtgaacatgacctcccggatgctcctgaacagattcacaatggctcaccgcaagccgacctacgagagagacgttgatcttggcgccgggacgcggcatgtggctgtcgaacctgaggtggccaatctggacatcattggacagcgcatcgaaaacattaaacacgagcataagagcacctggcactatgatgaggacaatccctacaaaacatgggcttatcatggctcttacgaagtgaagccctccgggagcgcctccagcatggtcaacggagttgtgaaactcctgaccaagccttgggatgtgatccccatggtcacacaaatcgcgatgaccgacacaaccccttttggccagcagagagtgttcaaggagaaagttgatacgcggacaccgaaggccaaaagaggcaccgctcaaattatggaagtgaccgccaagtggctttgggggtttctgtctcggaataaaaagccccgcatctgtacaagagaggagttcacgcggaaggtccgcagcaacgctgccattggagccgtgtttgttgacgagaatcagtggaactccgcgaaagaggctgtggaagacgagagattctgggatctcgtccaccgggaacgcgagctgcacaagcagggcaaatgcgcgacctgcgtgtataatatgatggggaagagagagaagaagctgggagagtttggcaaggccaaagggtctcgggctatctggtacatgtggctcggcgcccgcttcctggagttcgaagctcttggatttatgaacgaggaccattggttcagcagagaaaattccctgtctggcgttgagggggagggactccacaagctgggctacattcttcgggatatcagcaaaatccctgggggaaacatgtatgccgacgatacagcgggctgggacacccgcattacagaagatgacctgcagaatgaggccagaatcaccgatattatggaacccgagcatgctctcctggccaagtccatctttaaactgacataccaaaacaaggtggtccgggtgcagcgccctgctaaaaatgggaccgtcatggacgtgatttctagacgggatcagagaggcagcggacaggttggcacgtatgggctcaacaccttcacaaacatggaagcccaactgatccgccagatggagtccgagggaatctttagcccctctgaacttgagaccccgaatctggcggaacgggtgctcgactggctggagaagtacggcgtcgaaagacttaagcgcatggccatttccggggatgactgtgtggtgaaacctatcgacgatcggttcgctacagccctgaccgctctcaacgacatgggaaaggttagaaaagatattccccagtgggagcctagcaagggctggaatgactggcagcaagtgcccttttgctctcaccacttccatcagctgatcatgaaagatgggcgcgagattgtcgtgccttgtcggaaccaggacgaactggttggcagagcccgcgtgtcccagggagctggctggagcctccgggagacggcctgcctggggaagtcctatgcgcaaatgtggcagcttatgtactttcacagacgcgatctgcggctcgccgctaatgccatctgttctgccgtccccgtggactggattccgacaagcagaaccacatggtccatccatgctcaccatcagtggatgaccacggaagatatgctgagcgtctggaaccgggtgtggatcgaggaaaatccttggatggaggacaagacccacatttcttcctggggagatgttccctatcttggcaaaagagaggaccaatggtgcgggagcctgatcggactcacagcccgcgcgacctgggctacaaacattcaggtggccatcaatcaggtccggagactgattggcaacgaaaattacctggactacatgacctctatgaagcgcttcaaaaacgagagcgatcccgaaggggccctctggtga

SEQ ID NO: 19375 - RNA, 9879 nt, synthetic construct
  misc_feature 1..9879: note = derived and/or modified CDS sequence (opt5) from DENV-1__JQ045667__SS-prME
  source 1..9879: mol_type = other RNA
agcgtgaccatgctgctcatgctgatgcccacggcccttgctttccacctgacgaccagaggaggggaacctcatatgattgtgtccaagcaggaacggggaaaatctctcctgtttaagacaagcgccggcgttaacatgtgcacccttattgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccaacagcagatgtccgacccaaggagaggcgacactggttgaagaacaagatgccaatttcgtgtgccggcgcacctttgtggacagaggctggggcaacgggtgtggactcttcggcaaagggtctctgatcacatgcgctaagtttaagtgcgtcacgaaacttgagggaaagatcgtgcagtacgaaaatctgaaatattccgttattgtgaccgtccacacaggcgatcagcatcaagtggggaacgagagcaccgaacacggaacaaccgccacgatcacaccccaagctcctaccaccgagattcagctcacagactacggcgccctgaccctggactgttctccccggacgggcctcgatttcaatgaaatggttctgcttacaatgaaggggaaatcctggctggtgcataagcagtggtttctcgacctgcctcttccctggaccagcggagcctccacatctcaagagacctggaaccgccaggatctgctcgtcaccttcaaaacagctcacgcgaagaagcaggaggtggtcgtgctgggcagccaagaaggggccatgcacacggctctgaccggagccacagagatccagacctccggcacaaccacgatttttgccgggcatctcaaatgcagactgaagatggacaaacttacactgaagggcatgagctatgttatgtgtaccggatctttcaaactcgaaaaggaggtggctgaaacccagcacggcacagtcctggtgcagatcaagtacgaggggaccgatgccccgtgcaaaatccctttctccacacaagacgagaagggagttacgcagaatggccggctgattaccgcgaaccccatcgtgacagataaagaaaagcctgtcaatattgaggctgaaccgccctttggggagagctatatcgtgattggagccggcgagaaagcccttaagctctcttggttcaagaaagggagctccatcggcaagatgtttgaagctaccgccagaggagctcgccggatggccatcctgggcgacacagcgtgggatttcgggtctattggaggcgtgtttaccagcgttgggaaactggtccatcagatcttcggaacggcctacggcgtgctcttttccggggtgagctggaccatgaagattggcatcggagtcctgcttacatggctgggcctcaactctagatccaccagcctgtctatgacatgtattgctgtggggctggttaccctttacctcggagtgatggtccaggccgactccggctgcgtgatcaattggaaagggcgcgagctgaagtgtggaagcggcattttcgttacaaacgaagtgcacacctggacggagcaatataagtttcaggctgattcccctaaacggctgtctgccgcgatcgggaaggcctgggaagagggcgtctgcggaatcagaagcgctacacgcctcgagaacattatgtggaaacagatctccaatgaactgaaccatattcttctggagaatgacatgaagttcaccgtggttgtgggcgacgtcgccgggatcctcgctcagggcaagaagatgattcggccgcaacccatggaatacaaatattcttggaaaagctggggcaaggccaagatcatcggggccgatgtgcagaacaccacatttattatcgacggacctaatacccccgagtgtcctgatgaccagagagcttggaacatttgggaagtggaggattacggcttcggcatctttacgacaaatatttggctgaagctgcgcgactcctatacccaggtctgcgatcaccggcttatgagcgcggccatcaaagactctaaggctgttcacgccgatatggggtactggatcgagtccgagaaaaatgagacatggaagctcgccagagctagcttcattgaagtgaagacctgtatctggcccaaatctcatacactgtggtccaatggagtgctggagagcgaaatgattatcccgaagatttatggcgggcctatctctcaacacaactaccgccccggatacttcacccagacggccggcccttggcatctcgggaaactggagcttgactttgatctgtgcgagggaaccacagtcgtggttgacgaacactgcggcaatcggggccccagcctcagaaccacaaccgtgacggggaagatcattcacgagtggtgttgccggtcctgtacactgcctcccctgcgcttcagaggagaagatggctgctggtatgggatggagatccggccggtcaaagagaaggaagagaaccttgtcaagagcatggtttctgcgggatccggcgaagtggacagcttttccctcgggctgctgtgtatttctatcatgattgaggaagtcatgagaagccgctggtcccggaaaatgctcatgaccggaacactggctgtgttctttcttctgatcatgggccagctcacctggaatgacctgattagactgtgcatcatggttggcgccaacgcctctgatcgcatggggatgggaaccacataccttgctctgatggccacgttcaagatgagacctatgtttgcggtgggcctcctgttccggcgcctcaccagcagagaggtcctgcttctgacaatcgggctctccctggtggcttctgtggagctgcccaatagccttgaagaactgggagacggcctcgccatggggattatgatcctgaaactcctgaccgattttcaatcctatcagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttggaagcctgggctgcaagccgctgacgatgtttctcattgctgaaaacaaaatctggggccggcgctcttggcccctgaacgaggggatcatggccgtgggaattgtctccatccttctgagctccctcctgaagaatgacgtgcctctcgcgggccccctgattgccgggggaatgcttatggcttgttatgttatcagcggctctagcgccgatctgtccctggaaaaagctgccgaggtgtcttgggaggaagaggccgaacacagcggggcttcccataacattctcgtcgaggtgcagggagacggcaccatgaagatcaaagatgaagagagagacgatacactgaccatccttctgaaggcgacactcctggccgtttctggcgtgtaccctctcagcattcccgctaccctgttcgtctggtatttctggcagaaaaagaagcagcggtccggggtgctttgggacacgccttctcccccggaggtcggacgcgccgtgctggatgacggcatctacagaattatgcagcgggggctgctcggacgcagccaggttggcgtgggggtctttcaagaaaatgtgttccacaccatgtggcatgttacaagaggagccgtgctgatgtaccagggcaaacggcttgagccttcctgggctagcgtcaagaaagatctgatctcttatggcgggggatggagactccagggctcctggaacaccggggaagaggtccaggtgattgccgttgagcccggaaagaatcctaaaaacgtccaaacagcgcccggcacctttaagacaccggaaggggaggtgggagctatcgccctggacttcaagcctggcacgagcggctctcccattgtgaatcgcgaagggaaaatcgtcggactctacggcaacggggtggttaccacatccggaacctatgtgagcgccatcgctcaggccaaggcgtcccaggagggccctctgcccgaaattgaggacgaggtctttcggaaaagaaatcttaccatcatggatctgcaccccgggtctggcaagacacgccggtacctgcctgctattgtgagagaagccatcaaacgcaagctccggacgctgattcttgccccgaccagagttgtggctagcgagatggccgaagctctgaagggaatgcccatccgctatcaaacaaccgccgtcaaatccgagcacacaggcaaggaaatcgtggacctcatgtgccatgcgaccttcacgatgcggctgctgagccctgttagagtgcccaactacaatatgattatcatggatgaggcccactttacagacccttcttccattgctgcccgggggtatatcagcacccgcgtcggaatgggcgaggctgccgccattttcatgaccgctacaccccctgggtctgtggaagcgtttccgcagagcaacgccgtgatccaggatgaggaaagagacatccccgagcggtcctggaactctggatacgaatggattaccgatttccctggcaaaacagtctggtttgttcccagcatcaagtccgggaacgacattgctaattgtctccgcaaaaacggcaagagagtgatccagctttctcggaagaccttcgatacggagtaccagaaaaccaagaacaatgactgggattatgtggtcaccacagacattagcgagatgggagccaacttcagagccgaccgcgtgatcgatcctcggagatgcctgaaacccgttattctgaaggacggcccggaacgcgtgatcctcgctgggcctatgcccgtcaccgtggcctccgcggctcagcggagaggacgcatcggccggaatcataacaaagagggggatcagtacatttatatgggacagcccctgaataacgacgaagatcacgcccattggacggaggccaagatgcttctggacaatatcaacacccctgagggcattatccccgctctctttgaacctgagagagaaaagagcgccgcgattgatggggagtaccgcctgagaggcgaagcccggaaaacattcgttgagctgatgcgcagaggagacctcccggtgtggctttcttataaggtcgcttccgagggctttcaatacagcgatcggcgctggtgcttcgacggggaaagaaataaccaggtgctggaggaaaatatggatgtcgagatctggaccaaagaaggagagcggaagaaactgagaccccgctggctcgacgcccggacatattccgatcctctggctcttagagagtttaaggagttcgccgctggccgccggtctgtgagcggggacctgatcctcgagattggaaaactgccccagcacctgacccagagagcccaaaacgcgctcgacaatcttgttatgctgcacaactccgaacagggcggccgggcctaccgccatgctatggaggaactgcctgatacaatcgagaccctcatgctgcttgccctgattgctgtgctcacaggcggggtgacactgtttttcctgtctgggagagggctcggaaagaccagcatcggccttctgtgtgtcatggcctccagcgttctgctctggatggcctctgtggagccccactggattgctgcgtccatcatcctggaatttttccttatggtgctgctcattccggagcctgaccggcagcgcacaccccaggataatcaactggcctacgtcgtgatcgggctgctctttatgattcttacagttgctgccaacgaaatgggactgctggagaccacaaagaaagacctcggcatcggccatgtggccgtcgagaaccaccaccatgctgccatgctggatgtggaccttcaccctgcgagcgcctggacgctgtatgctgtcgccaccacaattatcacccccatgatgagacatacaattgaaaataccacggctaacatctctctcaccgccatcgcgaatcaggccgctattctgatggggctggataagggatggcctatctccaaaatggacattggcgtgcccctccttgccctggggtgctacagccaggttaacccgctgacactcaccgctgccgtgctgatgcttgtcgctcactatgccatcattggacctggcctgcaagcgaaggccacacgggaggctcagaaacgcaccgccgctgggatcatgaagaatcccacggtggatggaatcgttgccattgacctcgatcccgtggtctacgacgccaagttcgaaaaacagctgggccagatcatgctgctcattctttgtacatctcaaatcctgctgatgagaaccacatgggcgctctgcgagagcattaccctggctaccggccctcttacaacgctgtgggaagggtccccgggaaagttttggaacaccacaatcgccgtgtctatggctaatatcttccggggcagctatctcgccggggccggactggctttctccctgatgaaaagcctcggcgggggacgcagaggcaccggcgcccagggggagacacttggagagaagtggaaacggcagctgaaccagctgtccaagtctgaatttaatatttacaagagaagcggcatcatggaggtggatcgctccgaagcgaaagaggggctcaagcggggagaaaccacgaaacatgccgtttctagaggcacagctaagctgcgctggttcgtcgagcggaaccttgtgaaacccgaggggaaggtgattgacctgggatgtggcagaggcgggtggagctattactgcgccggactcaagaaagtcaccgaagttaagggctacaccaaagggggacctggccacgaggaacccatccctatggctacatatgggtggaatctggtgaagctgcactccggaaaagacgtgtttttcattccccctgagaagtgtgataccctcctttgcgacatcggcgaatctagcccgaaccccacaattgaggagggccgcacgctgcgggtcctgaaaatggtggaaccttggctcagagggaatcaattttgtatcaagatcctgaacccctacatgccttccgttgtggagacccttgaacagatgcagcgcaagcatggaggcatgctggtccggaatcccctcagcagaaactctacacacgagatgtattgggtgtcctgcgggaccggaaatattgttagcgccgtgaacatgacatctcgcatgctgctgaaccggttcaccatggcgcatagaaaaccgacgtacgagcgcgatgtcgacctcggcgccgggaccagacacgtggctgtggaacctgaggtcgccaatctggatatcattggacagcggatcgaaaacattaagcacgagcataaatccacatggcactatgacgaagataatccctacaagacctgggcttatcatggcagctacgaggttaaaccctctggctccgccagctccatggtgaacggggtggtcaaacttctgacaaagccttgggacgtgatccccatggttacccaaatcgctatgacagataccacgccttttggacagcagcgcgtgttcaaagagaaggtcgacacaagaaccccgaaagccaagcggggcaccattcaaatcatggaagtgacagcgaaatggctctgggggtttctgagcagaaataagaagccccggatttgtacgcgcgaggagttcaccagaaaagttcggtctaacgccgctatcggagccgtgtttgtcgatgagaatcagtggaacagcgctaaggaagccgtggaggacgagcgcttctgggaccttgttcacagagaacgggagctgcataaacagggcaagtgcgccacatgcgtgtacaatatgatggggaaacgcgaaaagaagctcggcgagtttggaaaagcgaagggctccagagctatttggtatatgtggctgggggcccggttcctggagttcgaggccctcggatttatgaacgaggatcactggttctctcgcgaaaatagcctgtccggcgtcgagggggaaggacttcacaaactgggctacatcctcagagacatctctaagattcctgggggcaacatgtatgctgatgacaccgccggatgggatacacggatcaccgaggacgatctgcagaatgaggctcgcattacagacatcatggaacccgagcatgcccttctggcgaaaagcatttttaagctcacctaccaaaacaaagtggtcagagtgcagcggcctgccaagaatggcacggttatggatgtgatctcccgcagagaccagcgggggtctggacaggtcggcacctatgggctgaacacattcaccaacatggaagctcaactgatcagacagatggagagcgaaggaatcttttcccccagcgagctcgagacaccgaatctggccgaacgcgtgcttgattggctggagaagtacggcgtggaacggctcaaaagaatggctatctctggggacgattgtgttgtgaagcctattgacgaccgcttcgccaccgcgctgacggcccttaacgatatgggcaaagtccggaaggacatcccccagtgggagccttccaaaggatggaatgattggcagcaagtgcccttttgcagccaccatttccaccagctgattatgaaggacggcagagaaatcgttgtgccttgtcgcaaccaggatgagctcgtcgggcgggctagagtgtctcagggagccggctggtccctgcgcgagacagcttgcctgggaaagagctatgcccaaatgtggcagctcatgtactttcaccggagagacctgcgccttgctgccaatgcgatttgttccgccgtccccgtggattggatcccgacctctcggacaacctggagcatccatgctcaccatcagtggatgacgaccgaagacatgctgtccgtttggaacagagtgtggattgaggaaaatccttggatggaggataaaacacacatcagctcttggggagacgtcccctacctcggcaagcgggaagatcaatggtgcgggtccctgattggccttaccgccagagccacatgggctaccaacatccaggtggccattaatcaggttcgccggctgatcggaaacgagaattatctcgactacatgacaagcatgaaaagattcaagaacgagtctgaccccgaaggcgcgctgtggtga

SEQ ID NO: 19376 - RNA, 9879 nt, synthetic construct
  misc_feature 1..9879: note = derived and/or modified CDS sequence (opt5) from DENV-1__KU094071__SS-prME
  source 1..9879: mol_type = other RNA
agcgtgaccatgctgctgatgctgcttcccaccgccctggctttccacctcacgacccggggaggggaacctcatatgattgtctccaagcaggaacggggaaagtctctgctttttaagaccagcgccggcgttaacatgtgcaccctgattgcgatggacctcggggaactgtgtgaagatacaatgacctacaagtgcccccgcatcacaaaggctgagcccgacgatgtggactgttggtgcaatgccaccgatacgtgggtgacctatggaacatgttcccaaaccggcgaacaccggcgggacaagcgctctgtcgccctggctcctcatgtggggctcggactggagacaagagccgagacctggatgagctccgaaggcgcttggaagcagattcagaaggttgagacgtgggcccttcggcaccccggcttcacagtgatcgcgctgtttctcgcccatgctattgggacctctatcacacagaagggaatcattttcatcctgcttatgctggtcacccctagcatggccatgcgctgcgtgggcattgggaacagagattttgttgaaggactctccggcgggacctgggtggacgtcgtgctggagcacggaagctgtgtgacaacgatggctaaggataagcccaccctggacatcgagctcctgaagacagaagtcaccaatcctgccgttcttcggaaactgtgcattgaggcgaagatctctaacacaaccacggattcccgctgtccgacacaaggcgaagccaccctcgtggaggaacaggacgctaatttcgtgtgcagacggacctttgtcgatcgcggctgggggaacggatgtggcctgttcgggaagggaagccttattacatgcgccaaatttaagtgcgtgaccaaactggagggcaagatcgttcagtacgagaatctcaaatattctgtgatcgtcacagtgcacacgggggaccagcatcaagttggaaacgaaaccacagagcacggcaccattgctacaatcacaccccaggcccctacgtccgaaattcagctgaccgactacggcgccctgacactcgattgtagccccagaaccgggctggacttcaatgagatggtgcttctgacaatgaagcggaaatcttggctcgtccataagcagtggtttctggatcttcctctgccctggacctccggagctagcacgccgcaagaaacatggaaccgcgaggacctcctggtgaccttcaagacagcgcacgccaaaaagcaggaggtcgtggttctgggctcccaggaaggggctatgcacaccgccctcaccggagccacagagatccaaacgtctggcaccacaaaaatttttgctgggcatctgaagtgcagacttaaaatggataagctgaccctcaagggcatgagctatgtgatgtgtacaggatccttcaaactggaaaaggaggtcgccgaaacccagcacggcacggtgctggttcaggtgaaatacgaggggacagacgcgccttgcaagatccccttcagcacccaggatgagaaaggagtcacccaaaatggccggcttatcacagctaaccctattgtgaccgacaaggaaaagcccgtgaatatcgaggccgaacccccttttggggagtcttatattgttgtcggagccggcgagaaagctctcaagctgtcctggttcaaaaaggggagctctatcggcaaaatgctggaagccacagctagaggagcccgccggatggcgattctcggcgatacggcctgggactttgggagcatcggaggcgtgttcacctccgtggggaagctggtccatcagatctttggaacagcttacggcgtgcttttctctggggttagctggaccatgaagattggcatcggcattctgctcacatggctgggcctgaactccagaagcgcctctctttccatgacctgtatcgctgtggggatggtcacgctctacctgggagtgatggttcaggccgatagcggctgcgtgattaattggaaagggcgcgagctgaagtgtggatctggcatctttgtcaccaacgaagtgcacacatggaccgagcagtataaattccgggcggactccccgaagagactcagcgccgctattgggaaagcctgggaagagggcgtttgcggaatccgctccgctacacggctggagaacatcatgtggaagcaaatttctaatgaacttaaccatatcctgctcgagaatgacatgaaatttaccgtggtcgtgggcgatgtgagcgggattctgacacagggaagaaagatgatcggcccccagcctatggaacacaagtactcctggaaatcttgggggaaggccaaaattatcggagccgacgtccagaacaccacgttcatcattgatggccccaatacacctgagtgtcccgacgatcaacgcgcttggaacatctgggaagttgaggactatggctttgggattttcaccaccaatatctggctgaaacttcgggatagctacacacaggtgtgcgacccgagactcatgtccgcggccattaaagatagcaaggctgtgcacgccgacatgggatattggatcgagtctgaaaagaacgagacctggcgcctggcccgggcttcctttatcgaagtcaaaacgtgtgtgtggcctaagagccatacactgtggtctaatggcgttctcgagtccgaaatgattatccccaaaatttacgggggacctatcagccagcacaactatagacccggctactctacccagacagccgggccttggcatctgggaaaacttgagctggatttcgacctctgcgagggcaccacagtggtcgtggatgaacactgcggcaatcgggggcccagcctgcgcaccacgaccgttacaggaaaaattatccacgagtggtgttgcagatcctgtaccctgccgcctcttcggttcaagggcgaagacgggtgctggtacggaatggagatcagacccgtgaaggacaaagaggaaaacctcgtcaagagcctggtgtctgcgggctccggggaggttgatagcttttccctgggactcctgtgtgtgtctattatgatcgaagaggtcatgcgcagccggtggtccagaaaaatgcttatgacaggcaccctggctgtgttcctcctgctgattatgggccaacttacgtggaatgacctgatccgcctctgcattatggtgggggccaacgcctctgatagaatgggaatgggcacaacctatctggctctcatcgccacatttaagatgcggcccatgttcgcggtcgggctgctttttcgcagactgaccagccgggaagttctcctgctgaccattggactttccctggtggcttctgtggagctccctaatagcctggaggaactcggcgacgggctggccatgggaatcatgatccttaaactgctcacagatttccagtcccatcagctgtgggccgctctgcttagcctgacgtttattaagaccacattctctctccactacgcctggaagaccatggctatggtcctgtccacagtgagcctctttccgctgtgtctttctaccacgtcccgcaaaacaacctggctgcccgttctgctcggcagcctgggctgcaagcctcttaccatgttcctgatcgccgagaacaaaatttgggggagaaagtcttggcccctcaacgaaggaatcatggcggtgggcattgtctccatcctgctcagctccctgcttaaaaatgacgtgcctctggccgggcccctgatcgctggaggcatgctcattgcctgttatgttatcagcgggtctagcgctgatctgtcccttgagaaggccgccgaagtgtcttgggaggaggaagctgagcatagcggagcgtcccacaacattctggtcgaagtgcaagacgatggcacaatgaaaatcaaggacgaggaacgggatgacaccctcacaattctgctcaaggccacgctgcttgctgtctctggcgtgtaccctatcagcatccccgccaccctgtttgtttggtatttccgccagaaaaagaaacagagatccggggtgctgtgggatacaccgtctcctcccgaggtcgagcgggccgtgctcgacgacggaatttaccgcatcctgcagagaggccttctggggcggagccaagttggagtgggcgtctttcaggaaggggtgttccataccatgtggcacgtgacaagaggagctgttctcatgtatcagggcaagcgcctggagccttcctgggccagcgtcaaaaaggatctcatttcttacggcgggggatggcggttccagggctcctggaataccggggaagaggtgcaagtgatcgcggtcgagcccggaaagaacccgaaaaatgtgcagacggctcctggcacctttaagacacccgaaggggaggttggagtgattgccctggacttcaaacctggcaccagcggctctcccatcgtcaacagagaagggaagattgtgggactttacggcaatggggttgtgacaacctccggaacatatgtcagcgccatcgctcaggccaaagcgtcccaggagggccccctgcctgaaatcgaggatgaggtgtttcgcaagcggaacctgacgattatggacctccacccggggtctggcaagaccagacgctacctgcccgctatcgttcgggaagccattaaaagaaaacttcgcacactgatcctcgcccctacccgggtggtcgctagcgagatggccgaagctctgaaaggaatgcccattagatatcaaaccacagccgtgaagtccgagcatacgggccgggaaatcgtggatctgatgtgccacgcgaccttcacaatgcgcctccttagccctgtcagagttcccaattacaacatgatcattatggacgaggcccattttaccgatcctgcttctatcgccgctcgggggtatatttccacacgcgtgggaatgggcgaggccgccgctatcttcatgaccgcgacgccgcccgggagcgtggaagcctttcctcagtctaatgctgtcattcaggacgaggaaagagatatccccgagcggagctggaactccggatacgactggatcacagatttccctggcaaaaccgtgtggtttgttccctctattaagagcgggaatgacatcgccaactgtctgagaaagaatggcaaacgcgtgattcaactgtcccggaagaccttcgacacagaatatcagaaaaccaagaacaacgattgggactacgtcgtgacaaccgatatctctgagatgggagccaattttagagctgaccgcgttattgatccgcggagatgcagcaaacctgtgatcctcaaggacggccccgagcgcgtcattctggccgggcccatgcctgtgacggtcgcgtccgctgcccagcggagaggacgcatcggcagaaaccagaataaggaaggggatcaatacatctatatgggacagccccttaacaatgacgaggatcacgcccattggacagaagctaaaatgctgctcgacaacattaatacccctgagggcatcattccggccctgttcgagcccgaacggggaaagagcgcggccatcgatggcgagtaccgcctgagaggagaagctcggaaaacattcgtggagctcatgcgcagaggcgaccttcctgtttggctgtcttataaggtggcctccgaagggtttcagtacagcgatcggaaatggtgcttcgacggagagagaaacaatcaggtgctggaggaaaacatggacgtcgagatttggaccaaggaaggcgagcgcaaaaagctccggcccagatggctggatgctcgcacgtattccgaccctcaagcccttcgggaatttaaggagttcgctgccgggagacggtctgttagcggagatctgatcctcgagatcggcaaactgccccagcacctgacccagcgcgcgcagaatgccctcgacaaccttgtgatgctgcacaattccgaacaaggcgggaaggcttacagacatgccatggaggaactgccggatacaattgagaccctcatgctgcttgctctgatcgccgtgctcacaggaggcgtcaccctgtttttcctgtctgggcggggactcggcaaaacaagcattgggcttctgtgtgtgatggcctccagcgttctgctctgggtggcttctgtcgaacctcactggatcgcggcctccattatcctggagtttttccttatggtgctgctcatccccgagcctgaccgccagagaacaccccaggataaccagctggcttatgtcgtgattggactgctctttatgatccttacggttgccgccaatgaaatgggcctgctggagacaaccaagaaagacctcggcattgggcatgtggctgtcgaaaaccaccaccatgccaccatgctggatgtggaccttcggcctgcgagcgcctggacactgtacgctgttgccaccacaatcattacgcccatgatgcgccacaccatcgagaacacaaccgctaatatttctctcacagccatcgcgaaccaagccgctatcctgatgggactggataagggctggccgatttccaagatggacatcggggtgcctctccttgccctgggatgctacagccaggtcaatccgcccaccctgattgctgccgtgctcatgctggtggctcattatgccatcattggccctgggcttcaggcgaaagccacgagagaggctcaaaagcggaccgccgctggaatcatgaaaaacccgacagttgatggcatcgtcgccattgacctggaccccgtggtgtacgatgccaagttcgaaaaacagctcggccagatcatgctgctgattctctgtacctctcagatccttagcatgcgcacaacctgggcgctgtgcgagtccattacgctggctacagggcctctcaccacactgtgggaaggatctcccggcaagttttggaataccaccatcgccgtcagcatggctaacatcttcagagggtcctatcttgccggagccggcctggcttttcctctcatgaaaagcctcgggggcgggcggagaggcacaggggcccaaggagagacgctgggcgaaaaatggaagcgccagctcaatcagctttccaaatctgagttcaacacctacaagcggagcgggattatggaggttgacagatccgaagcgaaagagggactgaagcgcggcgaaacaaccaagcacgccgtgtctcgggggacagctaaactgagatggttcgtggagcgcaatctcgtcaagcccgaaggaaaagtgatcgatctgggctgtggcagagggggatggagctattactgcgccggccttaagaaagttaccgaggtgaaggggtatacgaaaggaggccctgggcatgaggaaccgattcccatggctacatacggatggaacctggtcaagctccactccggcaaggacgtgtttttcacccctcccgagaaatgtgataccctgctgtgcgacatcggcgaatctagccctaatcccacaattgaggaagggagaaccctccgcgttcttaagatggtggagccgtggctgcggggaaaccagttttgtatcaaaattctgaatccttacatgccctccgtcgtggagacactcgaacaaatgcagagaaagcacggcgggatgctggtgcgcaacccccttagcagaaattctacgcatgagatgtattgggtctcctgcggaaccggcaacatcgttagcgccgtgaatatgacatctagaatgctgctcaaccgcttcaccatggcgcacagaaaacctacatacgaacgggatgtggacctgggggccggaacccgccatgtcgctgtggagcccgaggttgccaacctggatatcattggccagagaatcgaaaatattaagaacgagcacaagtccacgtggcactatgacgaagataatccttacaaaacctgggcttatcatggcagctacgaggtgaagccgtctgggtccgccagctccatggtcaacggagtggttcggctcctgacaaaaccctgggacgtgatccctatggtcacccagattgctatgacagacaccacaccctttggccaacagagagtgttcaaggaaaaagttgatacccggacgcctaaggccaagcgcgggacagcgcagatcatggaggtgaccgccagatggctttggggatttctgagccggaataaaaagccccgcatctgtaccagagaggagttcacacggaaagtccgctctaacgctgccattggcgctgtgtttgtcgacgagaatcaatggaacagcgccaaggaagccgtggaggatgaaagattctgggacctcgttcaccgggagcgcgagctgcataaacaggggaagtgcgcgacgtgcgtgtataatatgatgggcaagagagagaagaaacttggagagtttggcaaagctaaggggtcccgggccatctggtacatgtggctgggagcccgcttcctcgaatttgaggctctgggcttcatgaacgaagatcactggttctctagagagaatagcctgtccggggtcgagggagaaggcctccataaactggggtacattcttcgggacatctctaagattccgggcggaaacatgtatgccgatgacaccgctggctgggatacacgcatcaccgaggacgatctgcagaatgaagccaaaatcacagacattatggagcctgagcacgcgctcctggccaccagcatctttaaacttacataccagaacaaggtggtgagagttcaacggcccgctaaaaatgggaccgtgatggatgtcatttccagacgcgaccagcggggatctggccaggtggggacgtatggactgaacaccttcacaaacatggaagttcagctcatcagacaaatggagagcgaaggcatcttttcccctagcgagctggaaacccccaatctggccgagcgcgtgctcgactggctggagaagcacggggtcgaacggcttaaaagaatggctatctctggcgatgactgtgtggtcaagcctacagatgaccgcttcgccaccgcgctgacggccctcaacgatatgggaaaagtgcggaaggacatcccccagtgggagccgtccaagggctggaatgattggcagcaggttcctttttgcagccatcacttccatcaactgattatgaaagacgggagagaaatcgtggtcccctgtcgcaaccaggatgagcttgtgggacgggctagagtttctcagggcgccgggtggtccctgcgcgaaacagcttgcctcggaaagagctacgcccagatgtggcaactgatgtattttcaccggagagacctgcggctcgctgccaatgcgatttgttccgccgtgcccatcgattgggtccctacctctagaacaacctggagcattcacgctcatcaccagtggatgacgaccgaggacatgctgtccgtgtggaaccgcgtgtggatcgaggaaaatccgtggatggaggacaaaacacatgttagctcttgggaagatgtcccctaccttggcaagcgggaggaccagtggtgcgggtccctgattggcctcaccgccagagccacatgggctaccaacatccaagtggccatcaatcaggtgcgcagactgattggaaacgaaaattatcttgattacatgacaagcatgaaacggttcaaggacgagtctgatctggagggcgcgctctggtga

SEQ ID NO: 19377 - RNA, 9879 nt, synthetic construct
  misc_feature 1..9879: note = derived and/or modified CDS sequence (opt5) from DENV-1__HQ624983__SS-prME
  source 1..9879: mol_type = other RNA
tccgtgaccatgctgctcatgctggtccccaccgcccttgctttccacctgacgaccagaggcggggaacctcatatgatcgtttccaagcaggaacggggaaaatctctcctgtttaagacaagcgccggcgtgaacatgtgcacccttattgcgatggacctgggggagttctgtgaagatacaatgacctacaaatgcccgcgcatctccgaagctgaacccgacgatgtggactgttggtgcaatgccacagatacctgggtcacgtatggaacctgttctcaaacaggcgagcacagacgggacaagcgcagcgtggccctcgctcctcatgttgggctgggactggagaccagaacagaaacctggatgtcctctgagggcgcctggaaacagattcagcgggtggaaacgtgggctctccgccaccccggctttacagtcatcgccctgttccttgcgcatgccattgggaccagcatcacacagaagggaatcatttttatcctgctcatgctggtgaccccttccatggctatgagatgcgttggcattgggagccgggatttcgtggagggactttctggcgccacctgggtcgacgtggtgctggagcacgggtcctgtgtcacaacgatggctaaggataaacccaccctcgacatcgaactgctgaagacagaggttaccaaccctgccgtgctccgcaaactgtgcattgaagcgaagatcagcaatacaaccacggattctagatgtccgacacaaggagaggccacccttgtggaagaacaagacgctaactttgtctgccggcgcaccttcgtggatagaggctggggcaatgggtgtggactgtttggcaaagggtccctcattacatgcgccaagttcaagtgcgttaccaaactggagggaaagatcgtgcagtacgaaaaccttaaatatagcgtcatcgtgacagttcacacgggcgaccagcatcaagtggggaatgagtctaccgaacacggaacaaccgctacaattacaccccaggccccttccacggagatccagctgaccgactacggcgccctcacactggattgtagcccccggaccggcctggactttaacgaaatggtcctcctgacaatgaaggagaaatcctggcttgtgcataagcagtggttcctggatctccctctgccctggacctctggggctagcacgtcccaagagacatggaatcgccaggaccttctggtcacctttaaaacagcgcacgccaagaagcaggaagtggttgtgctcggaagccaagagggcgctatgcacaccgccctgaccggggccacagaaattcagacgtctggaaccacaaccatcttcgctggccatctgaaatgcagactcaagatggataaactgacacttaaggggatgtcctatgtcatgtgtaccggcagcttcaaactggagaaggaagtggccgagacgcagcacggaacagttctcgtgcagattaagtacgagggcaccgacgcgccgtgcaaaatccctttttctacccaagatgaaaagggggtcacacagaacggacggctgatcaccgctaatcccattgtgacagacaaagagaagcctgtgaacatcgaagccgagccgcccttcggcgagagctatattgttatcggggccggagaaaaagctctgaaactttcctggtttaagaaaggctctagcattgggaagatgttcgaggccacggctagaggcgcccgccggatggcgatcctcggagataccgcctgggactttggctccatcgggggagtcttcacaagcgtgggcaaactggtgcatcagatttttgggaccgcttacggagtcctgttctctggcgtgtcctggacaatgaagatcgggattggcgttctcctgacctggcttggactgaatagcagatctacgtccctcagcatgacctgtatcgccgtgggcctggtcacactgtaccttggggtgatggttcaggctgattccggatgcgtgattaactggaaaggccgcgaactcaagtgtgggtctggaatctttgtcaccaatgaggtgcacacatggaccgaacaatataagttccaggccgacagccctaaacggctgtccgcggccattggcaaggcttgggaggagggggtttgcggcatcagatctgccacacgcctggaaaacatcatgtggaaacagattagcaacgagctcaatcatatcctgcttgaaaacgacatgaagtttaccgtggtcgtgggagatgtggctggcattctggcccaggggaaaaagatgatccggccgcaacccatggagtacaaatattcctggaaaagctggggaaaggccaagattatcggcgctgacgtccagaatacgacattcatcattgatgggcctaacacccccgaatgtcctgacgatcagagagcgtggaatatctgggaggttgaggactacggatttggcattttcaccacaaacatctggctcaagctgcgcgattcttatacccaggtgtgcgaccaccggctgatgtccgccgctattaaagatagcaaggccgtgcacgccgacatgggctactggatcgaatctgagaaaaatgaaacgtggaaacttgctagagcctccttcatcgaggtcaagacatgtatttggcccaaaagccataccctctggtctaacggggtgctggaaagcgagatgatcattccgaagatctatggaggccctatttcccaacacaattaccgccccgggtactttacacagaccgcgggaccttggcatctgggcaaactcgagctggatttcgacctttgcgaagggacaaccgttgtggtcgatgagcactgcggaaaccggggccccagcctgagaacgaccacagtgaccggcaagatcatccacgaatggtgttgccggtcttgtacactccctcccctgcgctttaaaggggaggacggatgctggtatggcatggagattagaccggttaaggaaaaggaggaaaatctggtgaaatccatggtcagcgctgggtccggagaggtggactctttcagccttggcctcctgtgtatctccattatgatcgaagaggttatgcggtctagatggagccgcaagatgctgatgaccgggacgctcgccgtgtttttcctgcttattatgggacagctgacatggaacgatctcatccggctgtgcattatggtcggcgccaatgcttccgacagaatgggcatggggatgacctacctggcccttatggcgacatttaaaatgcgccctatgttcgctgtgggactgctctttagacggctgacctctcgcgaggtgctcctgcttaccatcggcctgagcctcgtcgcctccgttgaactgcccaacagcctggaggaacttggggatggactggccatgggcatcatgattctcaagctgctcacagacttccaatctcatcagctgtgggctacgcttctgtccctcacctttatcaaaacaaccttcagcctgcactatgcctggaagacaatggctatggtgctgtctattgtgtccctttttcccctgtgtctcagcaccacgtctcagaagacaacctggctgcctgtcctcctggggtcccttggatgcaaaccgctgaccatgttcctgatcgccgagaataagatttggggcagaaaaagctggcccctcaacgaaggcatcatggcggtggggatcgtttccattctgcttagctctctgctcaagaacgatgtgcctctggccggacccctcatcgctggcgggatgctgattgcctgttacgtcatcagcggatcctctgctgaccttagcctggagaaagccgccgaggtgtcctgggaagaggaagctgagcattctggcgcgagccacaatattctggttgaagtgcaggatgacgggacaatgaagatcaaagatgaggagcgggacgataccctcacaatcctgcttaaggccacgctgctcgctgtctccggagtgtatcctctgtctattcccgccaccctcttcgtctggtacttttggcaaaagaaaaagcagcgcagcggcgtgctgtgggacacacctagccctcccgaagttgagagagccgtgcttgatgacggcatctatcggattatgcagcgcgggctgctgggaagaagccaggtcggcgtgggggttttccaagaaaacgtgtttcataccatgtggcacgtcacacggggagctgtgctcatgtaccagggcaaacgcctggagccctcttgggcctccgtgaagaaagaccttatcagctacgggggaggctggagactgcagggctcttggaataccggggaggaagttcaggtcattgcggtggagcccggaaagaaccctaagaatgtgcaaacggctcccggcaccttcaaaacatccgaaggggaggtcggagccatcgccctcgattttaagccgggcaccagcgggtcccctattgtgaaccgggaaggaaaaatcgttggcctgtatggcaatggggtggtcacaacctctggaacatacgtgagcgctatcgcccaggcgaaggcttcccaggagggccccctccctgagattgaagacgaggttttcagaaaacgcaacctgacgatcatggatcttcaccccgggagcggaaagacccggagatatctgcccgccattgtgcgcgaagccatcaagcggaaactgagaacactcattctggctcctacccgcgtcgtggcctctgagatggctgaagcccttaagggcatgccgatccggtaccaaaccacagcggttaaatccgagcatacggggaaggagatcgtggacctgatgtgccacgccacctttacaatgagactcctgagccccgtccgcgtgcctaattataacatgattatcatggatgaagctcatttcaccgacccctctagcattgccgctcggggctacatctccacaagagtgggaatgggcgaggccgccgctatttttatgaccgcgacgcctcccgggtctgtcgaagccttccctcagagcaatgctgttatccaggatgaggaacgggacatcccggagcgctcctggaactctggatatgagtggattacagattttcccggcaaaaccgtgtggttcgtgcctagcatcaagtccgggaatgacattgccaactgtctgagaaagaatggaaaacgggtcatccagctcagccgcaagaccttcgatacagaataccagaagaccaagaacaacgactgggactacgtggttacaaccgatatttctgagatgggcgccaattttagagctgaccgggtgatcgatcccagacgctgccttaaacctgtcattctgaaggacgggcccgaacgggtgatcctggccggcccgatgcctgttacggtggcgtccgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagagcgcggccattgatggggagtatcggctcagaggagaggctcgcaaaacatttgtcgaactgatgagacggggcgacctgcctgtgtggctctcctacaaggtcgcctctgaggggttccaatatagcgatcgcagatggtgctttgacggcgaacggaacaatcaggtgcttgaggaaaacatggatgttgagatctggaccaaagagggagaacgcaagaaactgagaccgcggtggctggacgctagaacgtactccgaccccctcgccctgcgcgagttcaaggaatttgctgccggccggagatctgtgagcggggatcttatcctggagattggaaagctccctcagcacctgacccagcgcgcgcaaaatgccctggacaacctcgtgatgcttcataattccgaacagggcgggcgggcttatagacacgccatggaggagctgcccgatacaatcgaaaccctgatgctcctggctcttattgccgtcctgacaggaggcgttaccctcttctttctgagcggccgggggctgggaaaaacatctatcggcctcctttgtgtgatggcctccagcgtgctgctgtggatggcttctgtcgagcctcattggattgcggcctccatcatcctcgagttctttctgatggtgcttctgattcccgagccggaccgccagagaacccctcaggataaccaactcgcttacgttgtgatcgggctgctgttcatgattctcacggtcgccgccaatgagatgggacttctggaaacaaccaagaaagacctgggcatcgggcacgtggctgtcgagaaccaccatcacgccgcgatgctcgatgtggacctgcatcccgccagcgcttggaccctttacgccgttgctacaaccattatcacacctatgatgcggcacacgattgaaaacaccacagccaatatctctctgaccgcgatcgccaaccaggctgccattctcatgggactggataagggctggcccatcagcaaaatggacattggcgtgcctctgctcgctcttgggtgctattcccaggtcaatcccctgacactgaccgccgctgtgctcatgctggttgcccattacgcgatcattggaccgggccttcaagccaaggctacgcgcgaggcccagaagagaaccgctgccgggatcatgaaaaaccctacagtggatggaatcgtcgccattgacctggatcccgtggtgtatgacgcgaagtttgaaaaacagctcggccagatcatgctgctgattctctgtacctctcaaatccttctgatgcggacaacctgggctctgtgcgagagcattacgctcgccacagggcccctgaccacactttgggagggatcccctggcaagttctggaataccaccatcgctgttagcatggccaacatcttccgcggctcctacctggccggggctggactcgccttttctctgatgaaaagcctgggcgggggaagacggggcacaggggcgcagggagaaacgctcggcgagaagtggaagcgccagcttaatcacctgtccaaatctgagttcaacacctataagagaagcggcattatggaggtcgaccggtccgaagccaaagaggggctgaagagaggagagacaaccaaacacgctgtgtctcgcggcacagccaagctccggtggtttgtggaaagaaatctggtcaagccggaggggaaagttatcgatcttggatgtggccgcgggggatggagctactattgcgctggcctgaagaaagtgaccgaagtgaagggctacacgaaagggggacccggccatgaggaacctattcccatggccacatacgggtggaacctcgtcaagctgcactccggaaaagacgtgttctttgttcctcccgagaagtgtgataccctgctctgcgacatcggcgagagctctcctaatccgaccattgaagaggggcggacacttagagtgctgaagatggtcgaaccctggctgcgcggaaaccagttctgtatcaaaattctcaatccttatatgccctccgtggttgagaccctggagcaaatgcagcggaagcatggcggcatgcttgtgagaaaccctctgagccgcaattctacacacgaaatgtactgggtctcctgcgggacgggaaacatcgtgagcgcggtgaatatgacctctcggatgctcctgaacagatttacaatggcccaccgcaaacccacctatgagcgggatgtcgacctgggcgctgggacaagacatgttgccgtggaaccggaggtggctaacctcgatatcattggacagcgcatcgaaaatattaagcacgagcataaatccacctggcactacgacgaggataacccttataagacgtgggcctaccatggcagctatgaagtcaagccctccgggagcgcttctagcatggtgaatggagttgtgaaactgcttaccaagccctgggacgtcatccctatggtgacacagattgccatgaccgatacaacccccttcggccaacagagagtttttaaagagaaggtggacacacggacccctaaagcgaagcgcggcacggcccagatcatggaagtcacagctaagtggctgtgggggttcctctccagaaacaaaaagccgcggatctgtaccagagaggaatttacccggaaagtgcgctctaatgccgctattggagccgttttcgtggacgagaaccaatggaatagcgccaaggaggcggtcgaagatgagagattttgggacctggtgcaccgggaacgcgagcttcacaaacagggcaagtgcgctacatgcgtctacaacatgatggggaagagagagaagaagctgggagagttcggcaaagccaaggggtcccgggccatctggtacatgtggctcggcgctcgcttcctggagtttgaagccctgggattcatgaatgaggatcattggttttctagagaaaacagcctctccggcgtggagggggagggactgcacaaacttggctatattctgcgggacatctctaagattagcgggggaaatatgtacgctgatgacacggccggctgggatacccgcatcacagaagacgatctccagaacgaggcgaaaatcaccgacattatggaacccgagcatgccctgcttgctaattccatcttcaagctgacatatcagaacaaggttgtgagagtccaacggcctgccaaaaatgggaccgtgatggatgtgattagccgcagagaccagcggggctctggacaggttggcacatacgggctcaacacctttacgaacatggaagctcagctgatccgccaaatggagtccgagggaattttcagcccctctgaactggagacccctaatctcgccgaaagagtgctggattggcttgagaagtatggcgtcgaacggctgaaaagaatggcgatctccggggacgactgtgtggttaagcccatcgatgaccgctttgccacagctctcaccgccctgaacgatatgggaaaagtgcggaaggacattccgcagtgggagcctagcaagggctggaatgattggcagcaggtccccttctgctcccaccactttcatcaacttatcatgaaagacgggagagagattgtggtcccttgtcgcaaccaggatgaactggtgggccgggctagagtttctcagggagccggctggagcctccgcgagacagcttgcctggggaagtcctacgcccagatgtggcaactgatgtatttccaccggagagacctccgcctggcggccaatgctatctgtagcgccgtgcccgtcgattgggtgcctacctctcggacgacatggtccattcatgcccaccatcagtggatgaccgctgaagacatgcttagcgtttggaacagagtgtggatcgaggaaaatccctggatggaggataaaacacacatttctagctgggaggacgtcccgtacctgggaaagcgcgaagaccagtggtgcggctccctcatcgggctgaccgcccgggcgacgtgggctaccaacatccaagtggccattaatcaggtgagacggcttatcggaaacgagaattacctggattatatgacatctatgaaaagatttaagaacgaaagcgaccctgagggcgccctctggtga

SEQ ID NO: 19378 - RNA, 9879 nt, synthetic construct
  misc_feature 1..9879: note = derived and/or modified CDS sequence (opt5) from DENV-1__FJ384655__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagcccccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggcaaagcctgggaggagggggtgtgcggcatccggtctgctacaagactggaaaatattatgtggaagcagatcagcaacgagcttaatcatatcctgctcgaaaacgacatgaaattcaccgtcgtggtgggagacgccaatggcattctggctcaggggaagaaaatgatccgcccgcaacccatggagcacaagtactcctggaagtcttggggaaaagccaagattatcggcgccgatattcagaacaccacatttatcatcgacgggcctgatacccccgaatgtcctgacgagcagcgggcttggaatatttgggaggtcgaagattatggattcggcatctttacgacaaacatttggctgaaacttagagacagctacacccagatgtgcgatcaccgcctcatgtccgcggccatcaaggacagcaaagctgttcatgccgatatgggctattggattgagtctgaaaagaatgagacatggaagctggcccgggcttccttcatcgaagtgaaaacctgtatctggcccaagagccacacactgtggtctaacggggtgctcgagtccgagatgattatcccgaaaatttacggaggccctatcagccaacataattatagacccgggtacttcacccagacggccggaccttggcacctgggcaagcttgaactggactttgatctctgcgaggggaccacagtcgtggttgacgaacactgcggaaaccgcggcccctctctgcggaccacaaccgtgacgggcaaaattatccatgagtggtgttgcagaagctgtacactgcctccccttcggttccgcggggaggatggatgctggtacggcatggaaatcagaccggtcaaggagaaggaagagaatctcgtgcggtccatggttagcgcggggtctggagaagtggactcctttagcctgggcattctgtgtgtctccatcatgattgaggaggtgatgagatctcgctggagccggaaaatgctcatgaccgggacactggctgttttccttctgctcatcatgggacagctgacctggaacgacctgattagactttgcatcatggtgggcgccaatgcctccgataagatgggcatggggaccacatatctggctctcatggccacgtttaaaatgcgccctatgttcgcggtcggactgctctttagacggctggcttctcgcgaagtgcttctgctcaccattggcctgagcctggtggcctccgtcgagcttcccaactctctggaagagctcggggacggactggccatgggcatcatgatgctcaagctgcttacagaattccaaccccaccatctgtggaccacactcctgagcctgacctttatcaaaacgacactttccctggattacgcttggaagaccaccgccatggttctcagcattgtgtctctgttccctctctgtctgtccacaaccagccagaagacaacgtggcttccggtgctgctggggtcttttggatgcaaacccctcaccatgttcctgatcacagagaacaagatttggggcagaaaatcctggcctcttaatgagggcatcatggctattgggatcgtcagcatcctgctctcttccctgctcaagaacgacgtgcccctggccggacctcttattgcgggcgggatgctgatcgcctgttatgttattagcggatccagcgctgatctgtctctcgaaaaagccgctgaggtgagctgggaagaggaagccgagcactccggcacctctcataatatcctggtcgaggtgcaggacgatggggccatgaagattaaagacgaagagcgggatgacacacttaccatcctgctcaaggctacgctgctcgcggttagcggagtgtaccccatgtccatccctgccaccctgtttgtctggtatttctggcagaagaaaaagcaacgctctggcgtgctttgggatacacccagcccgcctgaagtcgagggcgctgtgctggacgatgggatttacagaatcctgcagcggggactcctgggccgctcccaggttggggtgggagtcttccaggacggcgtgtttcacaccatgtggcacgttacaagaggggccgtgcttatgtatcaaggaaaacggctggagccctcttgggccagcgtcaagaaagacctcatttcctacggcggcgggtggcgcttccagggaagctggaacaccggcgaagaggtgcaggtgatcgctgttgaacctgggaagaatcccaagaacgtccagacaacgccgggaacctttaaaacacctgagggcgaagtgggggccattgcgctggatttcaagcccggaacctctggctcccctatcgtgagcagagagggcaaaattgtcgggctctacggaaatggcgtggttaccacatctgggacgtatgtgtccgctatcgcccaagccaaggctagccaggagggacccctgcccgaaatcgaggacgaagtctttaaaaagcggaaccttaccattatggatctgcatcctggctccgggaagacaagacgctacctgccggccatcgtgcgggaggcgattaaaagaaagctccgcaccctgatccttgctcccacacgggttgtggcctctgaaatggccgaggctctgaaaggcatgcctattagatatcagaccacggccgtcaagagcgagcacacaggacgcgaaatcgtggacctcatgtgccatgctaccttcaccatgcggctgctgtcccccgttagagtgcctaattacaacatgatcattatggatgaggcccactttacagaccccgcgagcatcgccgctcgcggctatatttctacccgggtcgggatgggagaagccgctgccatcttcatgacagccacccctccgggctccgtggaggcttttccccaaagcaatgcggtgattcaggatgaagagagagacatccctgagcggtcttggaacagcgggtacgattggatcacggacttccccggaaaaacagtctggtttgttccttccattaagtctggcaatgatatcgccaactgtctccgcaagaatgggaaaagagtgattcagcttagccggaagaccttcgacacagaatatcagaaaaccaagaacaacgactgggattacgtggtcacgaccgacatctccgagatgggcgctaatttccgcgccgatagagtgattgacccccggagatgcctgaaaccggttatcctgaaggatggacctgaacgcgtgattctcgccggccccatgcccgtcacagtggcttctgccgcgcaacggagagggcgcatcggacggaaccagaataaggagggcgaccagtacgtttatatggggcagcctctgaacaatgatgaggaccatgctcactggaccgaagccaaaatgcttctggataacatcaatacacccgagggaattatccctgccctctttgaaccggagagagaaaagagcgctgccattgacggcgggtaccgcctgcggggcgaggcgagaaaaaccttcgtggagctgatgcgcagaggagatctccccgtctggctttcctataaggtggccagcgaaggctttcaatactctgaccggcgctggtgcttcgatggggagagaaacaatcaggtcctggaagagaacatggacgtggaaatctggacaaaagagggagagcggaagaaactgcgccctagatggctcgacgctcggacctattccgatcccctggcccttagagaatttaaggagttcgctgccggccgccggagcgtttccggggacctgattctcgaaatcggaaagctgcctcagcacctgacgctcagagctcagaatgcccttgataacctggtgatgctgcataattctgagcaaggcggcaaagcgtaccgccacgccatggaagagctccccgacacaatcgagaccctgatgcttctggctctcattgccgtgctgaccgggggagtcacactgtttttcctcagcggcaaggggcttggaaaaacctccatcggcctgctgtgtgttacagcttctagcgccctcctgtggatggcctccgtggaaccgcattggattgctgcgagcatcattcttgagtttttcctgatggtgctcctgatccctgaacccgatcggcagagaacgcctcaggacaaccagctggcctatgtcgtgatcgggctcctttttatgattctgaccgttgctgccaatgagatgggactgctcgagacaaccaagaaagatctgggcatcggccacgtggccgctgaaaaccaccaacatgccacaatgcttgacgtcgatctgcggcccgcgtctgcctggaccctctacgctgtggccacgaccgtcattacacctatgatgcgccacaccatcgagaacacaaccgctaatatttccctgacggccatcgcgaaccaggccgctattctgatggggctcgacaagggatggcccatcagcaagatggatatcggcgtgccgcttctggccctggggtgctactctcaggttaatcctctcacactgaccgctgccgtgcttatgctggtcgctcattatgccattatcggacccggcctccaagcgaaagccacaagagaagctcagaagcggaccgccgctgggattatgaaaaaccccaccgtggacggaatcgttgccattgatctggaccctgtggtctacgacgccaagttcgagaaacagctgggccagatcatgctccttatcctgtgtacatcccaaattctgctcatgcgcacgacctgggcgctgtgcgaaagcatcacacttgctaccggcccgctgacaaccctctgggaggggtctcccggaaagttttggaatacgacaattgccgtgagcatggctaacatcttcagaggctcctatctggccggggccggactggctttctctctcatgaagagccttggcgggggacggcgcggcaccggcgcccagggggagaccctgggagaaaaatggaagagacagctgaatcagctctccaaaagcgagtttaacacatacaagcggtccggcattatggaagtggatcgctctgaggcgaaagaagggctgaagagaggagagaccacaaagcacgccgttagccggggcacggctaaacttagatggttcgtcgagcgcaatctggtgaagcctgaagggaaagtgatcgacctcggatgtggccggggcgggtggtcctattactgcgccggactgaagaaagtcaccgaggttaagggctatacaaaagggggacccggccatgaagagcctgtgcccatggctacctacgggtggaacctggtgaagctccactctggaaaggatgtctttttcatgcctccggaaaaatgtgacacacttctgtgcgatatcggcgagagctcccccaatcctaccattgaggaaggcagaacgctgcgcgtgctcaagatggttgagccctggctgcgggggaaccaattttgtatcaaaattcttaatccttacatgccctctgtggtcgaaaccctggagcagatgcagagaaagcacggaggcatgctcgtgcgcaacccgctgagccggaattccacacatgagatgtattgggttagctgcgggaccggaaacatcgtgtctgccgtcaatatgacatccagaatgctgctcaaccgcttcaccatggcgcaccggaaacctacatacgaaagagacgtggatctgggcgccgggacccgccatgtggctgtcgagcccgaagttgccaaccttgacattatcggacagcggattgagaatatcaagaacgaacacaagagcacgtggcactatgatgaggacaatccctacaaaacatgggcttatcatggctcttacgaggtgaagccttccggcagcgcctcttccatggtgaacggggtcgtgagactgctcaccaaaccctgggatgttatccctatggtgacccaaattgctatgacagacacgaccccgtttggacagcagcgcgtcttcaaggaaaaagtggacacaagaaccccccgggccaagcgcggcacagcgcaaatcatggaggttaccgccaagtggctgtgggggtttcttagcagaaataaaaagcctcggatttgtacaagagaagagttcacccggaaagtgcgctccaacgctgccatcggagctgtctttgtggatgaaaatcagtggaacagcgccaaggaggccgttgaggacgaaagattctgggatctggtgcaccgggagcgcgaactccataaacagggcaagtgcgcgacgtgcgtctataatatgatggggaagagagagaaaaagctgggcgaatttggaaaagctaagggctctcgggccatttggtacatgtggctgggggcccgcttcctcgagttcgaggctctgggatttatgaacgaagaccactggttcagcagagagaattccctttctggcgtggaaggggagggactgcataaactcggctacatcctgcgggatatcagcaagattcccgggggcaacatgtatgccgacgataccgctggatgggacacacgcatcaccgaggatgaccttcagaatgaagccaaaattacagatatcatggagcctgaacacgcgctgctcgccacctccatttttaagctgacgtaccaaaacaaggtcgtgagagttcagcggcccgctaaaaatggcacagtgatggacgtcatctctcgcagagatcagcgggggagcggacaggtgggcacctatgggctgaacacattcaccaacatggaggtgcaactcatccgccagatggaatccgagggaatttttctgccgtctgagcttgaaacgcctaatctggccgagagagttctcgactggctggaaaagcacggcgctgagcggcttaaaagaatggccatcagcggggacgattgtgtggtcaagcccattgacgatcgcttcgcgaccgccctgatcgctctcaacgacatgggcaaagtgcggaaggatattcctcagtgggaaccctccaagggatggaatgactggcagcaagttcctttttgcagccatcacttccatcagctgatcatgaaagatggcagagagatcgtggtcccctgtcgcaaccaggacgagctggtggggcgggccagagtctctcagggagctggctggtccctccgcgaaacagcctgcctggggaagagctacgctcaaatgtggcagcttatgtattttcaccggagagatctgcgcctcgccgcgaatgccatttgttctgctgtgccggttgactgggtgcctacctcccggacaacctggagcatccacgcccatcaccagtggatgacaaccgaggatatgctgtccgtctggaacagagtgtggattgaagagaatccctggatggaagacaaaacgcatgtttctagctgggaggaggtgccctaccttggaaagcgcgaagaccaatggtgcggctccctgatcgggctcacagcccgggctacctgggccaccaacattcaggtcgcgatcaatcaggtgagacggctgattggcaacgagaattatctggattacatgacaagcatgaaaagattcaagaacgaatctgaccctgagggagctctctggtga

SEQ ID NO: 19379 - RNA, 9879 nt, synthetic construct
  misc_feature 1..9879: note = derived and/or modified CDS sequence (opt5) from DENV-1__KC759167__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctgtcacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggcccccgaagtggaggagcaggacgctaacttcgtgtgccggcgcacctttgtcgatagaggctggggcaatgggtgtggactgttcggcaaagggtctctcattacatgcgccaagtttaagtgcgtgaccaaactggaaggaaagatcgttcagtacgagaaccttaaatattccgtgatcgtcacagtgcacacgggcgaccagcatcaagttgggaatgaaagcaccgagcacggaacaaccgctacaattacccctcaggcccccacgaccgaaatccagctgacagactacggcgccctcaccctggattgttctcctcggacaggcctggacttcaacgagatggtgctcctgaccatgaaggagaaatcctggcttgtccataagcagtggtttctggatctccccctgccgtggacgagcggggcttccacatctcaagaaacctggaatcgccaggaccttctggtgacattcaaaaccgcgcacgccaagaagcaggaggtcgtggttctcggaagccaagaaggcgctatgcacaccgccctgacaggggccacggagattcagacctccggaacaaccacaatctttgctggccatctgaaatgcagactcaagatggataaactgacccttaaggggatgagctatgtgatgtgtacgggctctttcaaactggaaaaggaggtcgccgagacacagcacggaaccgtgctcgttcagattaagtacgaaggcaccgacgcgccttgcaaaatccccttctccacacaagatgagaagggggtgacccagaacggacggctgatcacagctaatcctattgtcacggacaaagaaaagcccgtgaacatcgaggccaaacccccttttggcgagagctgtattgtgatcggggccggagaaaaggctctgaagctttcttggttcaaaaagggcagctccattgggaaaatgtttgaggccaccgctagaggcgcccgccggatggcgatcctcggagatacagcctgggacttcggctctatcgggggagtttttaccagcgtcggcaagctggtgcatcagattttcgggacagcttatggagtgctgttttccggcgtcagctggaccatgaaaatcgggattggcgtgctcctgacgtggcttggactgaattctagatccaccagcctctctatgacatgcatcgccgttggcctggtgaccctgtaccttggggtcatggtgcaggctgattccggatgtgttattaactggaagggccgcgaactcaagtgcgggagcggaatcttcgtgacaaatgaggtccacacctggacagaacaatacaaatttcaggccgactccccgaagcggctgtctgcggccattggcaaagcttgggaggagggggtgtgtggcatcagaagcgccacccgcctggaaaacatcatgtggaagcagatttccaacgagctcaatcatatcctgcttgaaaacgacatgaaattcacggttgtggtcggagatgtggctggcattctggcccaggggaagaaaatgatccggccccaacctatggagtataagtactcttggaagagctggggaaaagccaagattatcggcgctgacgtgcagaatacaacctttatcattgatgggcccaacacccctgaatgccccgacgatcagagagcgtggaatatctgggaggtcgaggactatggattcggcatttttacaaccaacatctggctcaaactgcgcgattcctacacgcaggtttgtgaccaccggctgatgagcgccgctattaaggattctaaagccgtgcacgccgacatgggctattggatcgaatccgagaagaatgaaacatggaagcttgctagagccagcttcatcgaggtgaaaacctgcatttggccgaagtctcatacactctggtccaacggggtcctggaaagcgagatgatcattcctaaaatctacggaggccccatttctcaacacaattatcgccctgggtacttcacccagacagcgggaccctggcatctgggcaagctcgagctggattttgacctttgcgaagggaccacggtggttgtggatgagcactgtggaaaccggggccctagcctgagaaccacaaccgtcacaggcaaaatcatccacgaatggtgctgtcggtcctgcacccccccgcctctccgcttcagaggggaggacggatgttggtacggcatggagattcggcccgtgaaggaaaaggaggaaaatctggttaaaagcatggtgtctgctgggtccggagaggtcgacagcttttccctgggccttctctgcatctctattatgatcgaagaggtgatgagaagccgctggtcccggaagatgctgatgacgggggccctggccgttttcctcctgcttattatgggacagctgacatggaacgatctcatcagactgtgtattatggtgggcgctaatgcctctgaccgcatgggcatggggaccacatatctggcgcttatggctacctttaaaatgagacccatgttcgccgtcggactgctctttcggaagctgaccagccgcgaggtgctcctgcttacaatcggcctgtccctcgtggcctctgtcgaactgcctaacagcctggaggaacttggggatggactggctatgggcatcatgattctcaaactgctcacggacttccaatcccatcagctgtgggccacccttctgagcctcacatttatcaagaccacattctctctgcactacgcttggaagaccatggccatggttctgtccattgtgagcctttttccgctgtgcctctctacgacatcccagaaaaccacctggctgcccgtgctcctggggagccttggatgtaagcctctgacaatgttcctgatcgcggagaataaaatttggggcagacggtcttggcccctcaacgaaggcatcatggccgtcgggatcgtgtccattctgcttagctccctgctcaagaacgatgttcctctggctggacccctcatcgccggcgggatgctgattgcttgctatgtgatcagcggatctagcgccgacctttccctggagaaagccgctgaggtctcttgggaagaggaagcggagcatagcggcgcctcccacaatattctggtggaagttcaggatgacgggaccatgaagatcaaagatgaggagcgcgacgatacactcacgatcctgcttaaggctaccctgctcgccgtgtctggagtctaccctctgagcattcccgccacactctttgtgtggtatttctggagaaagaaaaagcaacggtccggcgtcctgtgggacaccccgtctcctcccgaagtggagcgcgctgttcttgatgacggcatctacagaattatgcagcgggggctgctgggacgcagccaggtgggcgtcggggtgttccaggaaaacgtttttcatacaatgtggcacgtgaccagaggagccgtcctcatgtatcaaggcaaacggctggagccttcctgggcgagcgtgaagaaagaccttatctcttacgggggaggctggagactgcagggctcctggaatacgggggagggagtgcaggttattgctgtcgaacccggcaagaacccgaagaatgtgcagaccgcccctgggacattcaaaacccccgagggagaagtgggcgccatcgctctcgattttaagcctgggacaagcggatctcccattgtcaaccgcgagggcaaaatcgtgggcctgtacgggaatggagttgtgaccacatccggcacgtatgtcagcgccatcgcgcaagctaaggcctcccaggaagggcccctccctgagattgaggacgaagtgttccggaaaagaaacctgaccatcatggatcttcacccgggatctggcaagacacgccggtacctgcccgccattgttagagaggctatcaagcgcaaactgcggaccctcattctggcccctaccagagtggtcgctagcgaaatggccgaggcgcttaaggggatgcccatccgctatcagacaacggccgtgaaatccgaatacaccggcaaggagatcgttgacctgatgtgtcatgctacatttaccatgcggctcctgagccctgtgagagtccccaattataacatgattatcatggatgaggcccacttcacagacccttcttccattgctgcccggggatacatcagcacccgcgtgggcatgggggaagccgctgcgatttttatgacggccacaccgcccggatctgtggaggctttccctcaaagcaatgccgtcatccaggatgaagagagagacatccccgaacggtcctggaactctggctatgagtggattaccgattttcctgggaaaaccgtttggttcgtgcccagcatcaagtccggaaatgacattgccaactgcctgcgcaagaatggcaaaagagtgatccagctctctcggaagacatttgataccgagtaccagaaaacaaagaacaacgactgggactacgtcgtgaccacggatattagcgaaatgggggctaatttcagagccgaccgcgttatcgatccgcggagatgccttaaacctgtgattctgaaggacggccccgagcgcgtcatcctggcgggacccatgcctgtgacagttgcttccgccgcccaacggagaggccgcatcgggcggaaccataataaggaaggagatcagtatatttacatgggccagcccctcaacaatgacgaggatcacgctcattggaccgaggccaaaatgctgcttgacaacatcaatacacctgaagggattatcccggcgctgttcgagcccgaaagagagaagagcgccgctattgatggagaatatcgcctcagaggcgaggcccggaaaacctacgtggagctgatgcgcagaggggacctgcctgtctggctctcttataaggtggcttccgaaggctttcagtacagcgatcggcgctggtatttcgacggagagagaaacaatcaagtccttgaagagaacatggatgtggaaatctggacgaaagagggcgagcggaagaaactgagaccccgctggctggacgcccggacctactccgaccctctcgctctgagagaatttaaggagttcgccgcggggcgccggtctgttagcggagatcttatcctggaaattggcaagctcccccagcacctgacacagagagcccagaatgctctggacaacctcgtgatgcttcacaattccgagcaagggggacgggcctaccgccatgctatggaagagctgccggataccatcgagacactgatgctcctggcccttattgccgtgctgaccggcggcgtcacactctttttcctgtctgggagaggactgggcaaaaccagcatcgggctcctttgtgttatggcttccagcgtgctgctgtggatggcgtctgtggaacctcactggattgccgcttccatcatcctcgagtttttcctgatggtccttctgattcccgaacctgaccggcagcgcacgccccaggataaccagctcgcctatgtggttatcggactgctgtttatgattctcacagtggccgctaatgagatgggccttctggagaccaccaagaaagacctggggatcggacatgtcgccgtgggcaaccaccaccatgcggccatgctcgatgtcgacctgcaccctgctagcgcctggacactttacgctgtggccaccacaattatcacgcccatgatgagacataccattgaaaacacaaccgcgaatatctctctgacagccatcgctaaccaagccgctattctcatgggcctggataaggggtggccgatctccaaaatggacattggagttcctctgctcgcccttggctgctatagccaggtgaatcccctgaccctgacggctgccgtcctcatgctggtggcgcactacgccatcattgggcccggacttcaggctaaggccacccgggaggctcaaaagcgcacagccgccggcatcatgaaaaaccctaccgttgatgggatcgtggcgattgacctggatccggtcgtgtatgacgctaagttcgaaaaacagctcggacagatcatgctgctgattctctgtacatctcagatccttctgatgagaaccacgtgggccctgtgcgagagcattacactcgctaccggccccctgacaaccctttgggaaggctcccctgggaagttttggaataccacaatcgccgtgtctatggccaacatcttccggggaagctacctggctggcgccgggctcgcgttttccctgatgaaaagcctgggaggcgggcgcagaggaacgggcgcccaaggcgagaccctcggggagaagtggaagcggcagcttaatcagctgtccaaactggaattcaactcttataagagaagcggaattatggaggttgaccgctccgaagctaaagagggcctcaagcggggggaaacaaccaaacatgccgtctctagaggaacagctaagctgcgctggttcgtggagcggaatcttgtgaagcccgagggcaaagtcatcgatctggggtgtggaagaggcggctggagctactactgcgccgggctcaagaaagttaccgaagtgaagggatatacgaaaggcgggcctggacacgaggaacccattcctatggcgacatacggctggaacctggtgaagctgcactccgggaaagacgtctttttcatcccgcccgagaagtgtgataccctcctttgcgacattggagaatctagccctaatcccaccatcgaggagggccgcacactgcgggtgctgaagatggttgaaccttggctcagaggcaaccagttttgtattaaaatcctgaatccctatatgccgtccgtggtcgagacccttgaacaaatgcagcgcaagcatgggggaatgctggtgcggaaccctctcagcagaaattctacacacgagatgtactgggtttcctgcggcacggggaacatcgtgagcgccgtcaatatgacctctcgcatgctgctgaaccggttcacaatggctcatagaaaacccacctatgagcgcgatgtggacctcggagccggcacaagacacgtggctgtcgaacccgaggttgccaacctggatattatcgggcagcggattgaaaatatcaagcacgagcataaatccacctggcactacgacgaagataacccttataagacgtgggcttaccatggaagctacgaggtgaagccctctggctccagctccagcatggtgaatggcgtcgtgaaacttctgaccaagccttgggacgttattccgatggtgacacagatcgccatgaccgatacaaccccctttgggcaacagcgcgtcttcaaagagaaggtggacacaagaacccctaaagcgaagcggggaacggcccagatcatggaagttacagctaagtggctctggggctttctgtctagaaacaaaaagccccggatttgtacccgcgaggaattcaccagaaaagtgcggagcaatgccgctatcggggccgtctttgtggacgagaaccaatggaattccgccaaggaagcggttgaggatgagcgcttctgggaccttgtgcacagagaacgggagctgcataaacagggaaagtgcgctacatgcgtctataacatgatgggcaagcgcgaaaaaaagctcggggagtttggcaaagccaagggatctagagccatttggtacatgtggctgggcgctcggttcctggaatttgaggccctcgggttcatgaatgaggatcactggttcagccgcgaaaactccctgtctggagtggagggcgaagggcttcacaaactgggatatatcctcagagacattagcaagatccctggcgggaatatgtacgctgatgacacggccggctgggatacccggatcacagaggacgatctgcagaacgaggcgcgcattaccgacatcatggaacccgagcatgcccttctggctaaatccatttttaagctcacatatcagaataaggtcgtgagagttcaacggccggccaaaaacggaaccgtgatggatgtcatctctcgcagagaccagcggggcagcgggcaggtgggaacatacggcctgaataccttcacgaacatggaagctcagctgattagacaaatggagtccgaagagatctttagcccttctgagctcgaaacccccaacctggccgagcgcgtgcttgattggctggaaaagtatgggatcgagcggctcaaaagaatggcgatttccggagacgactgtgttgtgaagcctatcgataatcgcttcgccacagctctgaccgcccttaacgacatgggcaaagtccggaaggatattccccagtgggaacctagcaaggggtggaatgactggcagcaggtgcccctgtgctctcaccattttcaccaactcatcatgaaagatggcagagagattgttgtgccgtgtcgcaaccaggacgagctggtcggacgggctagagtgtcccagggcgccgggtggagcctgcgcgaaacagcttgcctcggaaagtcctacgcccagatgtggcaactgatgtacttccaccggagagatcttcgcctggcggccaatgctatctgttctgccgtccctgtggactggattcccaccagccggacgacatggtccatccatgcccaccatcagtggatgaccacagaggatatgctcagcgtttggaacagagtgtggatcgaagagaatccctggatggaagacaaaacccacatttcttcctggggcgatgtcccttatctggggaagcgggaggaccagtggtgcggaagccttatcggcctgacggctagagccacctgggcgacaaacattcaagtggctatcaatcaggttcgccggctcattgggaacgagaattacctggactatatgacctctatgaaaagatttaagaacgaaagcgatccggagggcgccctgtggtga

SEQ ID NO: 19380 - RNA, 9879 nt, synthetic construct
  misc_feature 1..9879: note = derived and/or modified CDS sequence (opt5) from DENV-1__JQ048541__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttcctgacccaagatgaaaagggggtgacacagaacggacggcttatcacggctaatcccattgtcaccgacaaagagaagcctgtgaacatcgaagccgagcccccctttggcgagtcctatattgtgatcggggccggagaaaaagctctcaagctgagctggttcaagaaaggctctagcattgggaagatgtttgaggccacagctagaggcgcccgccggatggcgatcctgggagataccgcctgggacttcggctccatcgggggagtttttacatctgtcggcaaactcgtgcatcagattttcgggaccgcttacggagtgctgtttagcggcgtctcctggacgatgaagatcgggattggcgtgcttctgacctggctcggactgaatagcagatctacatccctgagcatgacctgtatcgccgttggccttgtgacactctacctgggggtcatggtgcaggctgattctggatgcgttattaactggaaaggccgcgaactgaagtgtgggtccggaatcttcgtgaccaatgaggtccacacatggaccgaacaatataagtttcaggccgacagccctaaacggctctccgcggccattggcaaggcttgggaggagggggtgtgcggcatcagatctgccacgcgcctggaaaacatcatgtggaaacagattagcaacgagcttaatcatatcctgctcgaaaacgacatgaagttcacagttgtggtcggagatgtggctggcattctggcccaggggaaaaagatgatccggccgcaacccatggagcacaaatactcctggaagtcttggggaaaggccaaaattatcggcgctgacgtgcagaataccacctttatcattgatgggcctaacacacccgaatgtcctgacgatcagagagcgtggaatatctgggaggtcgaggactatggattcggcatttttaccacgaacatctggctgaagcttcgcgatagctacacacaggtttgcgaccaccggctcatgtccgccgctattaaagatagcaaggccgtgcatgccgacatgggctattggatcgaatctgagaaaaatgaaacctggaagctggctagagcctccttcatcgaggtgaagacatgtatttggcccaaaagccacaccctgtggtctaacggggtcctcgaatccgagatgatcattccgaagatctacggaggccctattagccaacataaactgcgccccgggtatttcacacagaccgcgggaccttggcaccttggcaagctggagctcgattttgacctgtgcgaagggacgaccgtggttgtggatgagcactgcggaaatcggggcccctctctgagaacaaccacagtcaccggcaaaatcatccatgaatggtgttgccggagctgtacgcttcctcccctccgcttcagaggggaggacggatgctggtacggcatggagattcggccggtgaaggaaaaggaggaaaacctggttaaatccatggtgagcgctgggtctggagaggtcgactcctttagcctgggcctcctgtgtatctccattatgatcgaagaggtgatgagatctcgctggagccggaagatgcttatgacagggaccctggccgttttctttctcctgattatgggacagctgacatggaatgatcttatcagatcctgcattatggtgggcgccaacgcttctgaccgcatgggcatggggaccacctacctggccctcatggcgacattcaaaatgagacctatgtttgctgtcggactgctcttccggcgcctgacgagcagagaggtgcttctgctcaccatcggcctgtccctggtggcctctgtcgaacttcccaatagcctggaggaactcggggatggactggccatgggcatcatgattctcaagctgcttacagactttcaatcccaccagctgtgggctaccctcctgagcctgacattcatcaaaaccacgttttctcttcattatgcctggaagacaatggctatggttctgtccattgtgagcctcttccccctgtgtctctctaccacctcccagaagacaacctggctgcctgtgcttctggggagcctgggatgcaaaccgctcacaatgtttctgatcgccgagaacaagatttggggccggaaatcttggccccttaatgaaggcatcatggcggtcgggatcgtgtccattctgctcagctccctgctcaagaacgatgttcctctggccggaccccttatcgctggcgggatgctgattgcctgttacgtgatcagcggatctagcgctgacctgtccctcgagaaagccgccgaggtctcttgggaagaggaagctgagcacagcggcgcgtcccataacattctggtggaagttcaggatgacgggacgatgaagatcaaagatgaggagcgcgacgatacccttacaatcctgctcaaggccaccctgctcgctgtgtctggagtctatcctctgagcattcccgccacacttttcgtgtggtacttctggcaaaagaaaaagcagagatccggcgtcctgtgggacaccccttctcccccggaagtggagcgggccgttctggatgacggcatctatcgcattatgcagagagggctcctgggacggagccaggtgggcgtcggggtgtttcaagaaaatgttttccacacgatgtggcacgtgacccgcggagctgtccttatgtaccagggcaaaagactggagccttcctgggccagcgtgaagaaagacctcatctcttatgggggaggctggcggctgcagggctcctggaacacaggggaggaagtgcaggttattgcggtcgagcccggaaagaatcctaagaacgtgcaaaccgctcccggcacatttaaaaccccggaaggggaggtgggagccatcgccctcgatttcaagcctggcacaagcgggtctcccattgtcaatagagaaggaaaaatcgtgggcctgtacggcaacggggttgtgacgacctccggaacatacgtcagcgctatcgcccaggcgaaggcttcccaggagggccctcttcccgagattgaagacgaggtgtttcgcaaacggaatctgaccatcatggatctgcatcccgggtctggaaagaccagacgctatctccctgccattgttcgggaagccatcaagagaaaactgcgcacacttattctggctccgacgcgggtggtcgccagcgagatggctgaagccctcaagggcatgcccatcagataccaaaccacagcggtgaaatccgagcacaccgggaaggagatcgttgacctgatgtgccatgccacattcaccatgcgcctgctcagccctgtgcgggtccccaactataatatgattatcatggatgaagctcactttacggacccttcttccattgccgctagaggctacatcagcacacgggtgggaatgggcgaggccgccgctattttcatgaccgcgaccccccctgggtctgtggaagcctttccgcagagcaacgctgtcatccaggatgaggaacgcgacatccccgagagatcctggaattctggatatgagtggattacagatttccctggcaaaaccgtttggtttgtgcccagcatcaagtccgggaacgacattgccaattgtcttcggaagaacggaaaacgcgtgatccagctgtctagaaagacattcgataccgaataccaaaaaacgaagaataacgactgggactatgtcgtgacaaccgatattagcgagatgggcgccaacttccgggctgacagagttatcgatcctcgccggtgcctgaaacccgtgattctcaaggacgggccggaaagagtcatcctggccggccctatgcccgtgacagttgcgtccgctgcccagcgccggggaagaatcggccgcaatcataacaaggagggggatcagtacatttacatgggacagccccttaataacgacgaggatcacgcccactggaccgaagctaaaatgctgctcgacaatatcaacacgcctgagggcattatccccgccctgtttgaacctgagcgggaaaagagcgcggccattgatggggagtatagactgcgcggagaggctagaaaaaccttcgtggaactcatgcggcgcggcgaccttccggtctggctgtcttacaaggtggcctccgaggggtttcaatatagcgatagacggtggtgcttcgacggcgaacgcaataaccaggtcctggaggaaaatatggatgtggagatctggacaaaagagggagaaagaaagaaactccggcccagatggctggacgctcgcacctactccgaccctcttgccctgcgggagtttaaggaattcgctgccggcagacgctctgttagcggggatctcatcctggagattggaaagctgccccagcatctcacacagcgggcgcaaaacgcccttgacaatctggtgatgctgcacaactccgaacagggcgggagagcttatcggcatgccatggaggagctccctgataccatcgaaacactgatgcttctggctctcattgccgtgctgaccggaggcgtcacgctgtttttcctctctggccgcgggcttggaaaaacaagcatcggcctgctgtgtgttatggcctccagcgtgctcctgtggatggcttctgtggagccccactggattgcggcctccatcatccttgaatttttcctgatggtcctcctgattccggagcctgacagacagcggaccccccaggataatcaactggcttacgtggttatcgggctcctttttatgattctgaccgtggccgccaacgagatgggactgctcgaaacaaccaagaaagacctgggcatcgggcacgtcgctgtggagaatcatcaccatgccacaatgcttgatgtcgacctgcaccctgcgagcgcctggacgctctatgctgtggccaccacaattatcacccccatgatgcgccatacaattgaaaacaccacggctaacatctctctgaccgccatcgcgaatcaggccgctattctgatgggactcgataagggctggcctatctccaaaatggacattggcgttccccttctggccctggggtgctacagccaggtgaacccgctcacactgaccgctgccgtccttatgctggtggctcactacgccatcattggacctggcctccaagcgaaggccacaagagaggctcagaagcggaccgccgctgggatcatgaaaaatcccacggttgatggaatcgtggccattgacctggatcccgtcgtgtatgacgccaagttcgaaaaacagctgggccagatcatgctccttattctgtgtacatctcaaatcctgctcatgcgcaccacatgggcgctgtgcgagagcattacccttgctaccgggcctctgacaacgctctgggagggatccccgggcaagttttggaacaccacaatcgccgtgtctatggctaatatcttcagaggcagctacctggccggggccggactggctttctccctcatgaaaagccttggcgggggacggcgcggcaccggggcccagggagaaacactgggcgagaagtggaagagacagctgaaccagctctccaaatctgaatttaatacctataagcggagcggcattatggaggttgacagatccgaagcgaaagaggggctgaagcgcggagagacgacaaaacacgccgtctctcggggcaccgctaagcttagatggttcgtggaacgcaacctggtgaagcccgaggggaaagtcatcgatctcggatgtggccgggggggatggagctactattgcgccggcctgaagaaagttaccgaagtgaagggctacacaaaagggggacctggccatgaggaacccattcctatggctacctatgggtggaatctggtgaagctctactccggaaaagacgtctttttcatgccccctgagaagtgtgatacacttctgtgcgacatcggcgagtctagcccgaaccccacgattgaagaggggagaaccctgcgcgtgctcaagatggttgaaccttggctgcggggaaatcaattttgtatcaaagtgcttaacccctacatgccttccgtcgtggagacactggagcagatgcagagaaagcacggcggcatgctcgttcgcaatcccctgagccggaactctacccatgaaatgtattgggtgtcctgcgggacaggaaatattgtcagcgccgtgaacatgacctctagaatgctgctcaatcgcttcacgatggcgcaccggaaaccgacctacgagagagatgtggacctgggcgccgggacacgccacgtcgctgttgaacctgaggtggccaaccttgatatcatcggacagagaattgaaaacatcaagcatgagcacaaatccacctggcattatgacgaggataatccctacaagacatgggcttatcacggcagctacgaagtgaagccctctgggtccgccagctccatggtcaacggagtggttaaactgctcaccaagccttgggacgtgattcccatggtcacacaaatcgctatgaccgatacgacaccttttggccagcagcgggtgttcaaagagaaggttgacacccgcaccccgaaagccaagagaggcacagcgcaaattatggaagtgacggcccggtggctgtgggggtttcttagcagaaataagaaaccccggatctgtacccgcgaggaattcacaagaaaggtccggtctaacgctgccatcggagctgtgtttattgacgagaatcagtggaacagcgccaaagaggccgttgaagatgagcgcttctgggacctggtgcatagagaacgggagctccacaagcagggcaaatgcgcgacctgcgtctataatatgatggggaagcgcgaaaagaaactgggagagtttggcaaggctaaagggtccagagccatctggtacatgtggctgggcgcccggttcctcgagttcgaagctctgggatttatgaacgaggatcactggttctctcgcgaaaatagcctttccggcgtggagggggagggactgcataagctcggctacattctgagagacatctctaaaattcctgggggaaacatgtatgccgatgacacagctggctgggatacccggatcacagaagacgatcttcagaatgaggccaagatcaccgacattatggaacccgagcacgcgctgctcgccaaagctatctttaagctgacgtaccaaaacaaggtcgtgcgcgttcagagacctgccaaaaatgggaccgtgatggatgtcattagccggcgcgaccagagaggctccggacaggtgggcacatatgggctgaacaccttcacaaatatggaagctcaactcatccggcagatggagtctgagggaatttttagcccctccgaactggagaccccgaaccttgccgaaagagtgctggattggctcgagaagtacggcgttgaacgcctgaaacggatggcgatcagcggggacgactgtgtggtcaagcctatcgatgacagattcgccacggctcttacagccctgaacgatatgggaaaagtgcgcaaggacattccccagtgggagccttctaagggctggaatgattggcagcaagttcccttttgctcccatcacttccaccagctcatcatgaaagacgggcgggagattgtggtcccttgtagaaaccaggatgaactggtgggccgcgctcgggtcagccagggagccggctgggggctgagagagaccgcttgcctcggaaagtcttatgcccaaatgtggcagctgatgtactttcatcgccgggaccttagactggcggccaatgctatctgttccgccgtgcccgttgattgggtgccgacaagccgcaccacgtggtccattcacgcccatcaccagtggatgaccacagaagacatgctctctgtctggaaccgggtgtggatcgaggaaaatccttggatggaggataaaacccatattagctcctgggaggacgttccctatctgggcaagagagaagaccaatggtgcgggagccttatcggactgacagctcgggccacctgggcgacaaacatccaggtggctattaatcaggtcagacgcctcatcggcaacgagaattacctggattacatgacctctatgaaacggttcaagaacgaatccgaccccgagggggccctgtggtga

SEQ ID NO: 19381 - RNA, 9879 nt, synthetic construct
  misc_feature 1..9879: note = derived and/or modified CDS sequence (opt5) from DENV-1__JN697056__SS-prME
  source 1..9879: mol_type = other RNA
agcgtgaccatgctgctcatgctgcttcccacagccctgacgttccacctcaccacaagaggcggggagcctcatatgatcgtctccaagcaggaacggggaaaatctctgctttttaagaccagcgctggcgttaacatgtgcacactgattgccatggacctcggggagctgtgtgatgacaccatgacatacaaatgcccgcgcatcaccgaaacggagcccgatgacgtggattgttggtgcaatgcgaccgaaacatgggtgacctatggaacatgttcccaaaccggcgagcacagacgggacaagcgctctgtcgctctggcccctcatattgggctcggactggagacgagaacagaaacctggatgagctccgagggcgcctggcggcagatccagaaagtggaaacatgggctcttcgccaccccggcttcaccgttattgccctgtttctcgctcatgccatcgggacctctatcacacagaagggaattatcttcattctgcttatgctggtgacgcctagcatggcgatgagatgcgtcggcatcgggaaccgggattttgtggagggactctccggcgccacctgggttgacgtggtcctggagcacgggagctgtgtgacaaccatggctaaggataaacccacactggacattgaactcctgaagaccgaggtgacgaatcctgccgtccttcgcaaactgtgcatcgaagctaagatttctaacacaaccaccgattccagatgtccgacacaaggagaggccaccctcgttgaagagcaggacacaaatttcgtgtgccggcgcacgtttgtggatagaggctggggcaacgggtgtggactgttcggcaaagggagccttatcacctgcgcgaagtttaagtgcgtcacaaaactggagggaaagatcgtgcagtacgaaaatctcaaatattctgttattgtgaccgtccacacaggcgaccagcatcaagtggggaacgagaccacggaacacggaaccatcgccacaattaccccccaggctcctacatccgagatccagctgaccgactacggcgccctgacgctcgattgtagcccccggacaggcctggacttcaatgaaatggttcttctgaccatgaaggagaaatcttggctcgtgcataagcagtggtttctggatcttcctctgccctggacatccggggctagcacctcccaagagacctggaaccgccaggacctcctggtcacattcaaaacggcccacgccaagaagcaggaagtggtcgtgctgggatctcaagagggcgctatgcacaccgcgctcacaggggccaccgaaattcagacaagcggaaccacgacaatctttgctggccatctgaaatgcagacttaagatggataaactgaccctcaaggggatctcctatgttatgtgtaccggcccgttcaaactggagaaggaagtggccgagacacagcacggaaccgtcctggtgcaggttaagtacgagggcacagacgccccttgcaaaattcccttcagctctcaagatgaaaagggggtgacgcagaatggacggcttgtcaccgctaaccctatcgtgacagacaaagagaagcccgtgaatattgaagccgagcccccttttggcgagtcctatatcgttgtcggggcgggagaaaaagctctcaagctgagctggttcaagaaaggctctagcattgggaagatgtttgaggccaccgccagaggcgctcgccggatggccatcctgggagatacagcttgggacttcggctccatcgggggagtgtttacctctgtgggcaaactcgtccatcagattttcgggacggcctacggagtgctgtttagcggcgtttcctggaccatgaagatcgggattggcatccttctgacatggctcggactgaacagcagatctacctccctgagcatgacatgtattgcggtgggcatgatcaccctttacctcggggtcatggtgcaggccgattctggatgcgttattaattggaaaggccgcgaactgaagtgtgggtccggaatcttcgtgacaaacgaggtccacacctggacggaacaatataagtttcaggctgacagcccgaaacggctgtccgccgctatcggcaaggcctgggaggagggggtgtgcggcattagatctgcgacacgcctcgaaaacatcatgtggaaacagattagcaatgagctgaaccatatccttctggaaaatgacatgaagttcaccgttgtggtcggagatgtgtccggcattctcgcccaggggaaaaagtctatccggccccaacctatggagcacaaatacagctggaagtcctggggaaaggctaaaatcattggcgccgacgtgcagaacaccacatttatcattgatgggcccaatacccctgaatgtcccgacgatcagagagcttggaacatctgggaggtcgaggactatggattcggcatttttacgacaaatatctggctgaagctgcgcgatagctacacccaggtttgcgaccaccggcttatgtctgccgccatcaaagattccaaggctgtgcatgcggacatgggctattggattgaaagcgagaaaaacgaaacatggaagctcgccagagcttctttcatcgaggtgaagacctgtatttggccgaaatcccacacactgtggagcaatggggtcctggaatctgagatgatcattcctaagatctacggaggccccatcagccaacataactatcgccctgggtacttcacccagacggccggaccctggcacctcggcaaactggagcttgattttgacctgtgcgaagggaccacagtggttgtggatgagcactgcggaaatcggggcccttccctcagaaccacaaccgtcacgggcaagattatccatgaatggtgttgccggagctgtacactgcccccgctgcgcttcaaaggggaggacggatgctggtacggcatggagattagacctgtgaaggaaaaggaggaaaaccttgttaaatctatggtgtccgccgggagcggagaggtcgactccttttctctcggcctgctgtgtatcagcattatgatcgaagaggtgatgcggtccagatggtctaagaaaatgctcatgaccgggacactggctgttttccttctgctcaccatgggacagctgacctggaatgatctgattcgcctttgcatcatggtgggcgccaacgcgagcgacaatatgggcatggggacaacgtatctggctctcatggccacctttcggatgagacccatgttcgccgtcggactgctctttcgcagactgacatcccgggaggtgcttctgctcaccgtgggcctgtctctggtcgctagcgttgaacttcccaactccctggaggaactcggggatggactggccatgggcatcatgattctcaagctgcttacagacttccaaagccaccagctgtgggcgaccctcctgtctctgacgtttgtgaaaacaaccttctcccttcattacgcttggaagaccatggccatgatcctgagcattgtgtctctcctgcctctctgtctgtccacaaccagccagaagacaacgtggcttccggtcctgctggggtctctcggatgcaaacccctgaccatgtttcttatcacagagaacaagatttggggccgcaaatcctggcctctgaatgaaggcatcatggccgtggggatcgttagcattctcctgtccagcctcctgaagaacgatgtgccccttgctggacctctgatcgccggcgggatgctgattgcttgttatgtcatctctggaagctccgccgacctctctctggagaaagcggccgaggtgagctgggaagaggaagctgagcactccggcgcctctcataatattcttgttgaaatccaggatgacgggaccatgaagatcaaagatgaggagagagacgatacaattaccatcctgctcaaggctacgctgctcgccattagcggagtgtaccccatgtccatccctgccaccctgttcgtctggtatttttggcaaaagcggaaacagcgctctggcgtgctttgggacacacccagcccgcctgaagtcgagagagctgtgctggatgacggcatttaccggatcctgcagcgcgggctcctgggaagatcccaggttggcgtgggggtcttccaagaaggagtgttccacaccatgtggcacgttacacggggcgcggtgcttatgtatcaggggaagcgcctggagcccagctgggcctctgtcaaaaaggacctcatttcctacggaggcggctggagatttcaggggagctggaacaccggagaggaagtgcaggtgatcgctgttgagcctggcaaaaatcccaagaacgtccaaacagccccggggacgttcaagacctctgaaggagaggtgggcgccatcgctctggattttaaacctgggacatccggaagccccattgtgaatcgggaaggcaagatcgtcggcctctacgggaacggagtggttaccacctccggcacatatgtgtctgccattgcgcaggctaaagccagccaggaggggcctctgcccgagatcgaagacgaggtcttcagaaagcgcaatcttacgattatggatctgcatcccggatccggcaaaacccggagatacctgcctgccatcgtgcgcgaagctatcaagcggaagctcagaacactggttcttgccccgacccgcgtggtcgcgagcgagatggctgaagccctgaaagggatgcccattcggtatcaaacaaccgccgtgaagtctgagcacacgggcagagagatcgttgacctcatgtgccatgctacatttaccatgcgcctgctgtcccctgtgcgggtccccaactacaatatgattatcatggatgaagcccacttcaccgaccctgctagcattgccgcgagaggatatatctctacacgggtgggcatgggggaggccgctgccatctttatgaccgctacaccccctggaagcgtggaagccttcccgcagtccaacgccgtcattctcgatgaggaaaaagacatccccgagcgctcttggaatagcggctacgattggattaccgactttcctgggaagacggtttggttcgtgccctccatcaaatctggaaacgatattgctaattgtcttagaaagaacggcaagcgggtgatccagctgagccgcaaaacatttgacaccgagtatcagaagacaaaaaacaatgactgggattacgtcgtgaccacggacatttccgaaatgggggcgaacttcagagccgatcgggttatcgaccctagacgctgcctgaagcccgtgatcctcaaagatggcccggagcgggtcattctggctggacctatgcccgtgaccgttgccagcgccgctcaaagacgcggccggatcgggagaaatcagaacaaggaaggagaccagtacatttatatgggccagccccttaataacgatgaggaccatgcccactggacagaggcgaagatgctgctcgataatatcaacacccctgaagggattatccccgctctgttcgagcctgaacgcgagaaatctgccgccatcgacggagaataccggctgagaggcgaggctcgcaagacatttgtggagctcatgagacggggggatcttccggtctggctgtcctataaagtggccagcgaaggcttccaatactccgaccgcagatggtgctttgatggagagcggaataaccaggtcctggaagagaatatggacgtggaaatttggaccaaggagggcgagcgcaaaaagctcagaccccggtggctggacgcgagaacatattctgatcctcttgccctgcgcgaattcaaagagtttgctgccgggcggagaagcgtttccggagacctcatcctggaaattggcaagctgccccagcacctcacccagcgcgctcaaaacgcccttgataatctggtgatgctgcataactctgagcaggggggaaaggcttaccggcacgccatggaagagctccctgacacgatcgagacactgatgcttctggcgctcattgccgtgctgaccggcggcgtcaccctgttctttctcagcgggagaggacttggcaaaacatccatcgggctgctgtgtgttatgagctcttccgctctcctgtggatggccagcgtggaaccccattggatcgctgcctctattatccttgagttctttctgatggtgctcctgattccggaacctgatcggcagcgcaccccccaggacaatcaactggcctatgtcgtgatcggactccttttcatgattctgacagttgctgcgaacgagatgggcctgctcgagacgaccaagaaagatctggggatcggacacgccgctgccgaaaaccaccatcacgccgctatgcttgacgtggatctgcatcctgcctccgcgtggacactctacgccgtcgctaccacaattatcacccccatgatgagacacacgatcgagaataccacagccaacattagcctgaccgctatcgccaatcaggcggccattctgatgggcctcgacaagggctggcctatctctaaaatggatattggggtgccccttctggctctgggatgctacagccaggtcaacccgctcacactgaccgccgctgtgcttatgctggttgcccattatgctatcatcggccctgggctccaagccaaggcgacgcgggaagcccagaagcgcacagctgccggaattatgaaaaatcccaccgtggacggcatcgtcgctattgatctggaccccgtggtttacgacgccaagtttgagaaacagctggggcagatcatgctccttattctgtgtacatcccaaatcctgctcatgagaaccacctgggccctgtgcgaatctatcacacttgcgacgggacctctgaccacactctgggagggcagcccgggcaagttctggaacaccacaattgctgtgtccatggccaatatctttcgggggagctatctggctggagccggcctggccttctccctcatgaaatctcttgggggaggccgcagagggaccggagctcagggcgagacgctgggcgaaaagtggaagcggcagctgaaccagctcagcaaatccgagttcaatatttacaagcgctctgggatcgtcgaagtggatagaagcgaggccaaagaaggactgaagcggggcgagacaaccaaacacgcggtgtccagagggaccgccaagcttcgctggtttgttgagcggaacctggtcaagcccgaaggaaaagtgattgacctcggctgtgggagaggaggctggtcttattactgcgctggcctgaagaaagtgacagaggtcaaggggtataccaaaggaggccctgggcacgaagagcccatccctatggccacatacggatggaatctggttaagctctacagcggcaaagatgtgttctttattccccctgaaaagtgtgacacgcttctgtgcgatatcggggagtccagcccgaaccccaccatcgaggaaggacgcacactgcgggtgctcaagatggtcgagccttggctgagaggcaatcaattctgtattaaaatccttaacccctatatgccttctgtggttgaaaccctggagcagatgcagcgcaagcatggcgggatgctcgtgcggaatcccctgtccagaaacagcacacacgagatgtactgggtctcttgcggaaccggcaatattgtgtccgctgttaacatgacgagccgcatgctgctcaaccggtttaccatggcccatagaaaaccgacatatgaacgcgacgtggatctgggggcgggaacccggcacgtcgccgtggagcctgaagtggctaatcttgacatcattggccagagaatcgagaacatcaagaatgaacacaaatctacatggcattacgatgaggacaacccctataagacctgggcctaccacgggtcctatgaggtcaagcccagcggatccgctagctctatggttaatggcgtggtgcgcctgctcacaaaaccttgggatgtcattcccatggtgacccaaatcgccatgacggacacaacccctttcggccagcagagagtttttaaggaaaaagtggacacccggacaccgaaggctaaacgcgggacggcccaaattatggaggtcaccgcgaagtggctgtggggattccttagcagaaacaagaaaccccggatctgtacaagagaagagtttacccggaaggtgcgctccaatgccgctattggcgccgttttcgtggatgaaaaccagtggaattctgctaaagaggccgtcgaggacgaaagattttgggatctggtgcggcgcgagagagaactccataagcaggggaaatgcgccacatgcgtttacaacatgatgggaaagcgggagaagaaactgggcgaattcgggaaggcgaaaggcagccgcgctatctggtacatgtggctgggagccagatttctcgagttcgaggccctgggcttcatgaatgaagaccactggttttcccgggagaactctcttagcggggtggaaggagagggcctgcataagctcgggtatatcctgcgcgatatttccaaaatccctggaggcaatatgtacgctgacgataccgccgggtgggacacaagaattaccgaggatgaccttcagaacgaagctaagatcacggatattatggagcccgaacacgccctgctcgcgacctctatcttcaaactgacatatcaaaataaggtcgtgcgggtccagcgccctgccaagaacggcaccgtgatggacgttatcagcagacgggatcagcgcggatccggccaggtggggacatacggactgaacacctttacgaatatgggcgctcaactcattagacagatggagagcgaagggatcttcctgccctctgagcttgagacaccgaacctggccggacgggtcctcgactggctggaaaaacacggcattgagagacttcgccggatggctatctccggggacgattgtgtggtgaagcctattgacgatagatttgccaccgcgctgacagccctcaatgacatgggcaaagttcgcaaggatatcccccagtgggaacctagcaaaggatggaacgactggcagcaagtgcccttctgctctcatcactttcatcagctgattatgaaggatggccgggagatcgtcgtgccttgtagaaatcaggacgaactggttgggcgcgctcgggtgtcccagggagccggctggagcctcagagagaccgcttgcctggggaagtcctatgcccaaatgtggcagcttatgtacttccaccgccgggatctgagactcgctgccaacgcgatctgttctgccgtccccgtggactgggtcccgacgagccgcaccacatggtccattcacgctcatcaccagtggatgaccacagaggatatgctgagcgtgtggaatcgggtttggatcgaagagaacccttggatggaagacaaaacccatgtgtcttcctgggaggacgtcccctatcttggaaagagagaagatcaatggtgcggcagcctgattgggctcacagcccgggccacctgggctacgaatatccaggtggccattaaccaggttagacgcctgatcggcaatgagaactacctggactacatgacatctatgaaacggtttaagaatgagagcgatcccgaaggagcgctctggtga

SEQ ID NO: 19382 - RNA, 9879 nt, synthetic construct
  misc_feature 1..9879: note = derived and/or modified CDS sequence (opt5) from DENV-1__JN697057__SS-prME
  source 1..9879: mol_type = other RNA
agcgtgaccatgctgctcatgctgatgcccacagcccttgctttccacctgacgacccggggaggggaacctcatatgatcgtctccaagcaggaacggggaaaatctctcctgtttaagaccagcgccggcgttaacatctgcacccttatcgccatggacctgggggagctctgtgaagatacaatgacctacaaatgcccccgcattacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagatccagcgggttgaaacatgggctctgcgccaccccggcttcaccgtgattgccctttttctggcgcatgccatcgggacatctatcacccagaagggaattatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccgttctgcgcaaactttgcatcgaagcgaagatttccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgatcacatgcgccaagtttaagtgcgtgacaaaacttgagggaaagatcgttcagtacgaaaacctgaaatattccgtgattgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaatccctttctccacccaagatgaaaagggggtgacacagaacggacggctgattacggctaatcccatcgtcaccgacaaagagaagcctgtgaacattgaagccgagccgccctttggcgagagctatatcgtgattggggccggagaaaaagctcttaaggtttcttggttcaagaaaggcagctccatcgggaagatgtttgaggccacagctagaggcgcccgccggatggcgatcctcggagataccgcctgggacttcggctctattgggggagtctttacaagcgtgggcaaactggtgcatcagatcttcgggaccgcttacggagtcctgttttccggcgtgagctggacgatgaagattgggatcggcgttctcctgacctggcttggactcaattctagatccacaagcctctctatgacctgtattgccgtgggcctggtcacactgtaccttggggtgatggttcaggctgattccggatgcgtgatcaactggaaaggccgcgaactcaagtgtgggagcggaattttcgtcaccaatgaggtgcacacatggaccgaacaatataagtttcaggccgactcccctaaacggctgtctgcggccatcggcaaggcttgggaggagggggtttgcggcatcagaagcgccacgcgcctggaaaacattatgtggaaacagatctccaacgagctcaatcatattctgcttgaaaacgacatgaagttcacagtggtcgtgggagatgtggctggcatcctggcccaggggaaaaagatgattcggccgcaacccatggagcacaaatactcttggaaaagctggggaaaggccaagatcatcggcgctgacgtccagaataccacctttattatcgatgggcctaacacacccgaatgtcctgacgatcagagagcgtggaatatttgggaggttgaggactatggattcggcatctttaccacgaacatttggctcaagctgcgcgattcctacacacaggtgtgcgaccaccggctgatgagcgccgctatcaaagattctaaggccgtgcatgccgacatgggctattggatcgaatccgagaaaaatgaaacctggaaacttgctagagccagcttcattgaggtcaagacatgtatctggcccaagtctcacaccctctggtccaacggggtgctggaaagcgagatgattatcccgaagatttacggaggccctatctctcaacataattatcgccccgggtacttcacacagaccgcgggaccttggcacctgggcaaactcgagctggattttgacctttgcgaagggacgaccgttgtggtcgatgagcactgcggaaaccggggccccagcctgagaacaaccacagtgaccggcaagatcattcatgaatggtgttgccggtcctgtacgctccctcccctgcgcttcagaggggaggacggatgctggtacggcatggagatccggccggttaaagaaaaggaggaaaatctggtgaaaagcatggtctctgctgggtccggagaggtggacagcttttcccttggcctcctgtgtatttctatcatgattgaagaggttatgagaagccgctggtcccggaaaatgctgatgacagggaccctcgccgtgttctttctgcttatcatgggacagctgacatggaacgatctcattagactgtgcatcatggtcggcgccaatgcttctgaccgcatgggcatggggaccacctatctggcccttatggcgacattcaagatgagacctatgtttgctgtgggactgctgttccggcgcctgacgagcagagaggtgctcctgcttaccatcggcctgtccctcgtcgcctctgttgaactgcccaacagcctggaggaacttggggatggactggccatgggcattatgatcctcaaactgctcacagactttcaatcccaccagctgtgggtgacccttctgagcctcacattcattaagaccgctttttctctgcattacgcctggaaaacgatggctatggtgctgtccatcgtcagccttttccccctgtgtctctctacaacctcccagaagaccacatggctgcctgtgctcctggggagccttggatgcaagccgctgaccatgtttctgattgccgagaataaaatctggggccggaagtcttggcccctcaacgaaggcatcatggcggttgggattgtgtccatcctgcttagctccctgctcaaaaacgatgtccctctggccggacccctcattgctggcgggatgctgatcgcctgttatgtgattagcggatctagcgctgacctttccctggagaaggccgccgaggtttcttgggaagaggaagctgagcacagcggcgcgtcccataatatcctggtggaagtccaggatgacgggacaatgaaaatcaaggatgaggagcgcgacgatacgctcaccattctgcttaaagccacactgctcgctgtgtctggagtctaccctctgagcatccccgccaccctcttcgtgtggtatttctggcaaaagaagaaacagagatccggcgttctgtgggacacaccttctcccccggaagtggagcgggccgtccttgatgacggcatttaccgcatcatgcagagagggctgctgggacggagccaggtgggcgttggggtgtttcaagaaaacgtcttccacaccatgtggcacgtgacgcgcggagctgtgctcatgtatcagggcaagagactggagccttcctgggccagcgttaaaaaggaccttatttcttacgggggaggctggcggctgcagggctcctggaataccggggaggaagtccaggtgatcgcggtggagcccggcaagaaccctaagaatgtccaaacagctcccggcacctttaagacaccggaaggggaggtgggagccattgccctcgatttcaaacctggcaccagcgggtctcccatcgttaacagagaacgcaagatcgtgggactgtacggcaatggcgtcgtgacaacgtccgggacctatgttagcgctattgcccaggcgaaggcttcccaggagggacctctccccgagatcgaagacgaggtgtttcggaagagaaacctgacaattatggatcttcatcccggctctgggaaaacccgccggtacctgcctgccatcgtcagagaagccattaagcgcaagctgcggaccctcatcctggctccgacaagagtggttgccagcgagatggctgaagcccttaaaggaatgcccatccgctatcaaacgaccgcggtgaagtccgagcacacaggcaaagagattgtcgacctgatgtgccatgccaccttcacaatgcggctcctgagccctgtgagagtgcccaattacaacatgatcattatggatgaagctcactttaccgacccttcttccatcgccgctcgggggtatattagcacgcgcgtcggcatgggagaggccgccgctatcttcatgacagcgacaccccctggctctgttgaagcctttccgcagagcaatgctgtgatccaggatgaggaaagagacattcccgagcggtcctggaactctgggtacgagtggatcaccgatttccctggaaagacagtgtggtttgtccccagcattaaatccggcaatgacatcgccaactgtctgcgcaagaatgggaagagagtgattcagctctctcggaaaaccttcgatacagaatatcaaaagaccaaaaacaacgactgggactacgttgtgacgacagatatcagcgagatgggagccaatttcagagctgaccgcgtcattgatcctcggagatgccttaagcccgtgatcctgaaagacggcccggaacgcgttatcctggccgggcctatgcccgtgaccgtcgcgtccgctgcccagcggagaggccgcattggacggaaccataataaggagggcgatcagtacatctatatggggcagcccctcaacaatgacgaggatcacgcccactggacagaagctaagatgctgcttgacaacattaatacccctgagggaatcattcccgccctgtttgaacctgagagagagaaaagcgcggccatcgatggcgagtaccgcctcagaggggaggctcggaagacgttcgtggaactgatgcgcagaggagacctgccggtctggctctcttataaagtggcctccgagggctttcaatacagcgatcggcgctggtgcttcgacggggaaagaaacaatcaggttcttgaggaaaacatggatgtggagatctggaccaaggagggcgaacggaaaaagctgagaccccgctggctggacgctcggacatattccgaccctctcgccctgagagagtttaaagagttcgctgccggacgccggtctgtgagcggcgatcttattctggagatcgggaagctcccccagcatctgacccagagagcgcaaaatgccctggacaacctcgtcatgcttcacaattccgaacagggaggccgggcttaccgccatgccatggaggagctgcctgatacaattgaaaccctgatgctcctggctcttatcgccgttctgacagggggagtgaccctctttttcctgtctggcagaggcctggggaagacgagcattggactcctttgtgtgatggcctccagcgtcctgctgtggatggcttctgtggagccccactggatcgcggcctccatcattctcgaatttttcctgatggttcttctgatcccggagcctgaccggcagcgcacaccccaggataaccaactcgcttatgtggtcattggcctgctgtttatgatcctcaccgtggccgccaatgagatggggcttctggaaaccaccaaaaaggacctgggaattggccacgtcgctgtggagaaccatcaccatgccgcgatgctcgatgttgacctgcaccctgccagcgcttggaccctttacgccgtggctacaacgatcattacccccatgatgagacatacaatcgaaaacaccacagccaatatctctctgaccgcgattgccaaccaggctgccatcctcatggggctggataaaggatggcctatttccaagatggacatcggcgtccccctgctcgctcttggctgctacagccaggtgaatccgctgacgctgaccgccgctgttctcatgctggccgcgcactatgccattatcgggcctggacttcaagctaaagccacacgggaggctcagaagcgcaccgccgccggcatcatgaagaaccccacagtggatgggattgtcgcgatcgacctggatcccgtggtgtacgacgctaaattcgaaaagcagctcggacagattatgctgctgatcctctgtacctctcaaattcttctgatgagaacgacatgggccctgtgcgagagcatcaccctcgctacaggccctctgaccaccctttgggaggggtccccgggaaaattttggaatacaacgatcgccgtttctatggccaacattttccggggcagctatctggctggcgccgggctcgcgttctccctgatgaaaagcctgggaggcgggcgcagaggaaccggcgcccagggggaaacactcggagagaaatggaagcggcagcttaatcagctgtccaagtctgaatttaacacctacaaaagaagcggcatcatggaggtcgaccgctccgaagctaaggagggcctgaaaagaggggaaacaaccaagcacgccgtgtctagaggaacggctaaactccgctggttcgtggaacggaatctggtcaagcccgagggcaaggttgtggatcttgggtgtggaagaggcgggtggagctattactgcgccggactgaaaaaggtgacagaagtcaaaggctataccaagggcgggcctggacatgaggaacccattcctatggcgacctacggctggaacctcgtgaaactgcactccgggaaggacgtctttttcattccccctgagaaatgtgatacactgctctgcgacattggagagtctagcccgaatcccaccatcgaagagggccgcacacttcgggtgctgaagatggtcgaaccttggctgagagggaaccaattttgtattaagatcctcaatccctacatgccttccgtggttgagacgctggagcagatgcagcgcaaacatggaggcatgcttgtgcggaaccccctgagcagaaattctacccacgaaatgtattgggtctcctgcggcacagggaacatcgtgagcgccgtgaatatgacctctcgcatgctcctgaaccggttcacaatggctcacagaaagccgacctacgagcgcgatgtcgacctgggagccggcacgagacatgttgctgtggaacctgaggtggccaacctcgatattatcgggcagcggattgaaaatatcaaacacgagcataagtccacctggcactatgacgaggataacccctacaaaacatgggcttatcatggaagctacgaagtcaagccctctggctccgccagctccatggtgaatggggttgtgaagctgcttaccaaaccttgggacgtcattcccatggtgacacaaatcgcgatgaccgatacaaccccttttggacagcagcgcgttttcaaggagaaagtggacacgagaacaccgaaggccaaacggggcaccgctcaaatcatggaagtcaccgccagatggctgtggggctttctcagccggaacaagaagccccgcatttgtacaagagaggagttcacgcggaaagtgcgctctaatgctgccatcggggccgtttttgtggacgagaaccagtggaatagcgcgaaggaggctgtcgaagatgagagattctgggacctggtgcaccgggaacgcgagcttcacaaacagggaaagtgcgcgacctgcgtctataacatgatgggcaaaagagaaaagaagctgggggagtttggaaaagccaagggctcccgggctatttggtacatgtggctcggggcccgcttcctggagttcgaagctctgggctttatgaatgaggatcattggttctctagagaaaacagcctctccggagtggagggcgaggggctgcacaaacttggatacatcctgcgggacatttctaagatccctggcgggaatatgtatgccgatgacacagcgggatgggatacccgcatcacagaagacgatctccagaacgaggccaaaattaccgacatcatggaacccaagcatgctctgcttgccaaagctatttttaagctgacataccaaaataaggttgtgagagtccagcggcctgccaaaaacggcaccgtgatggatgtgatcagccgcagagaccagcgggggtccggccaggttggaacgtatggcctcaataccttcacaaacatggaggcgcaactgattagacagatggaatctgaggggatctttagcccctccgagctggaaaccccgaacctcgccgagcgcgtgctggattggcttgaaaagtacggagtcgagcggctgaaaagaatggctatcagcggcgacgactgtgtggttaagcctattgatgaccgcttcgccacagctctcaccgccctgaatgatatggggaaagtgcggaaggacatcccccagtgggaaccttctaagggatggaacgattggcagcaagtccccttttgctcccaccacttccatcagcttattatgaaagacggcagagagatcgtggtcccttgtcgcaatcaggatgagctggtggggcgggctagagttagccagggcgccggatggtctctccgcgaaacggcgtgcctgggcaagtcctatgcccaaatgtggcagctgatgtactttcaccggagagacctccgcctggctgccaacgccatttgtagcgctgtgcccgtcgattgggtgccgacatcccggaccacatggtctatccatgcccaccatcagtggatgaccacggaggacatgcttagcgtttggaatagagtgtggattgaagagaacccttggatggaagataaaacccacatctccagctgggaggacgtcccctatctggggaagcgggaggaccaatggtgcggatctctcatcggcctgacagcgagagctacctgggccacaaatattcaggtggccatcaaccaggtgcgccggcttattgggaatgaaaactacctggattacatgacctccatgaaaagattcaagaatgagagcgaccccgaaggagctctctggtga

SEQ ID NO: 19383 - RNA, 9879 nt, synthetic construct
  misc_feature 1..9879: note = derived and/or modified CDS sequence (opt5) from DENV-1__HQ624984__SS-prME
  source 1..9879: mol_type = other RNA
agcgtgaccatgctgctcatgctgatgcccacggcccttgctttccacctgacgaccagaggcggggagcctcatatgatcgtctccaagcaggaacgggggaaatctctcctgtttaagacaagcgccggcgttaatatgtgcacccttatcgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagtctgcctggaaacagattcagcgggttgaaacatgggctctgcgccaccccggcttcaccgtgatcgccctttttctggcgcatgccattggcacaagcatcacccagaaggggatcattttcatcctcctgatgcttgtcaccccttccatggctatgagatgcgtgggaattggcagccgggattttgttgaggggctgtctggagccacatgggtggacgtcgtgctcgagcacggctcctgtgtgacgaccatggctaaggataaacccacactggacatcgaactgctcaagaccgaggtcacaaaccctgccattctgcgcaaactttgcatcgaagcgaagattagcaataccacgacagattctagatgtccgacccaaggggaggccaccctggttgaagaacaagacgctaacttcgtgtgccggcgcacatttgtggatagaggatggggcaatggctgtggactcttcggaaaaggctccctgattacctgcgccaagtttaagtgcgtcacaaaacttgaggggaagatcgtgcagtacgaaaacctgaaatatagcgttattgtgacggtccacaccggagaccagcatcaagtgggcaatgagtctacagaacacgggaccacagctaccatcacgccccaggcccctaccacagagattcagctcaccgactacggagccctgacactggattgtagcccccggaccggcctcgacttcaacgaaatggttctgcttacgatgaaggagaaaagctggctggtgcataagcagtggtttctcgatctgcctcttccctggacatccggcgcttctaccagccaagagacatggaatcgccaggacctgctcgtcaccttcaaaaccgcgcacgccaagaagcaggaagtggtcgtgctggggtcccaagagggagctatgcacacagccctgacgggcgccaccgaaatccagacaagcgggaccacaaccatttttgctggacatctcaaatgcagactgaagatggataaacttacgctgaagggcatgtcttatgttatgtgtacagggtccttcaaactcgagaaggaagtggccgagacccagcacggcaccgtcctggtgcagatcaagtacgagggaacagacgcgccgtgcaaaatccctttcagcacccaagatgaaaagggcgttacacagaacgggcggctgattacggctaatcccatcgtgaccgacaaagagaagcctgtcaacattgaagccgagccgccctttggagagtcttatatcgtgattggcgccggggaaaaagctcttaagctcagctggttcaagaaaggatcctctatcggcaagatgtttgaggccacagctagaggggcccgccggatggcgatcctgggcgataccgcctgggacttcggaagcattggcggggtgtttacatccgttggaaaactggtccatcagatcttcggcaccgcttacggggtgctctttagcggagtgtcttggacgatgaagattggcatcggggtcctgcttacctggctgggcctcaattccagaagcacatctctgtccatgacctgtattgccgtgggactggttacactttacctcggcgtgatggtccaggctgatagcgggtgcgtgatcaactggaaaggacgcgaactgaagtgtggctccgggattttcgttaccaatgaggtgcacacatggaccgaacaatataagtttcaggccgactctcctaaacggctgagcgcggccatcggaaaggcttgggaggagggcgtctgcgggatcagatccgccacgcgcctcgaaaacattatgtggaaacagatctctaacgagctgaatcatattcttctggaaaacgacatgaagttcacagtggttgtgggcgatgtcgctggaatcctcgcccagggcaaaaagatgattcggccgcaacccatggagtacaaatatagctggaagtcctgggggaaggccaaaatcatcggagctgacgtgcagaataccacctttattatcgatggccctaacacacccgaatgtcctgacgatcagagagcgtggaatatttgggaggtggaggactacgggttcggaatctttaccacgaacatttggctgaagctgcgcgatagctatacacaggtctgcgaccaccggcttatgtctgccgctatcaaagattccaaggccgttcacgccgacatgggctactggatcgaaagcgagaaaaatgaaacctggaagctcgctagagcctctttcattgaggtgaagacatgtatctggcccaaatcccataccctgtggagcaacggcgtgctggaatctgagatgattatcccgaagatttatgggggacctatcagccaacacaattaccgccccggctacttcacacagaccgcggggccttggcatctcggaaaactggagcttgattttgacctgtgcgaaggcacgaccgtcgtggttgatgagcactgcgggaaccggggaccctccctcagaacaaccacagtgaccggcaagatcattcacgaatggtgttgccggagctgtacgctgcctcccctgcgcttcagaggcgaggacgggtgctggtatggaatggagatccggccggtcaaagaaaaggaggaaaatcttgtgaagtctatggtttccgctggcagcggggaggtggactccttttctctcggactgctgtgtattagcatcatgattgaagaggtcatgagatcccgctggtctcggaaaatgctcatgacaggcaccctggccgtgttccttctgctcatcatggggcagctgacatggaacgatctgattagactttgcatcatggttggagccaatgctagcgaccgcatgggcatgggcaccacctacctggccctcatggcgacatttaagatgagacctatgttcgctgtggggctgctctttcggcgcctgacgtccagagaggtccttctgctcaccatcggactgtctctggtggccagcgtggaacttcccaactccctggaggaactcggcgatgggctggccatgggaattatgatcctcaaactgcttacagacttccaaagccatcagctgtgggctaccctcctgtctctgacatttattaagaccacgttctcccttcactatgcctggaaaacaatggctatggtcctgagcatcgtttctctctttcccctgtgtctctccaccaccagccagaagacaacctggctgcctgtgcttctgggctctctggggtgcaagccgctcacaatgttcctgattgccgagaataaaatctggggacggcgctcctggccccttaacgaaggcatcatggcggtgggcattgtcagcatcctgctctccagcctgctcaagaacgatgtgcctctggccgggccccttattgctggaggcatgctgatcgcctgttacgttatttctgggagctccgctgacctgtctctcgagaaagccgccgaggtgagctgggaagaggaagctgagcattccggagcgtctcacaatatcctggtcgaagtgcaggatgacggcacgatgaagatcaaagatgaggagagagacgatacccttacaattctgctcaaggccaccctgctcgctgttagcggggtgtatcctctgtccatccccgccacactttttgtctggtacttctggcagaagaagaagcagcggtctggagtgctgtgggacaccccttcccctcccgaagtcgagcgcgccgtgctggatgacggcatttatagaatcatgcagcggggcctcctggggcgctcccaggttggagtgggcgtcttccaagaaaacgtgtttcatacgatgtggcacgttaccagaggggctgtgcttatgtaccagggaaaacggctggagcccagctgggcctctgtcaagaaagacctcatttcctacggcgggggatggagactgcagggcagctggaatacaggcgaggaagtgcaagtgatcgcggttgagcccgggaagaaccctaaaaatgtccaaaccgctcccggaacattcaagacctctgaaggcgaggtgggggccattgccctcgattttaagccgggaacatccggcagccctatcgtgaaccgcgaagggaaaatcgtcggactgtatggcaatggcgtggttacgacctccgggacatacgtgtctgctattgcccaggcgaaggctagccaggagggaccccttcctgagatcgaagacgaggtcttccggaaaagaaacctgaccattatggatctgcaccccggctccgggaagacccgccggtatctccccgccatcgtgagagaagccattaaacgcaagctgcggacacttatcctggctcctacgagagttgtggccagcgagatggctgaagccctcaagggaatgccgatccgctaccaaaccacagcggtcaaatctgagcataccggcaaggagattgtggacctgatgtgccacgccacatttaccatgcggctgctctcccccgttagagtgcctaattataacatgatcattatggatgaagctcatttcacggaccccagctctatcgccgctcgggggtacattagcacacgcgtcggcatgggagaggccgccgctatctttatgaccgcgacccctcccggctccgtggaagccttccctcagtctaatgctcttatccaggatgaggaaagagacattccggagcggagctggaactccgggtatgagtggatcacagattttcccggaaaaaccgtgtggttcgtcccttctattaagagcggcaatgacatcgccaactgtctgcgcaaaaatgggaagagagttattcagctgtcccggaagacatttgataccgaataccagaaaacgaagaacaacgactgggactacgtggtgacaaccgatatcagcgagatgggagccaatttcagagctgaccgcgtcattgatccccggagatgcctcaaacctgtgatcctgaaggacggccccgaacgcgttatccttgccgggccgatgcctgtgacagtcgcgtctgctgcccagcggagaggccgcattggacggaaccacaataaagagggcgatcagtatatctacatggggcagcccctgaacaatgacgaggatcatgcccactggaccgaagctaagatgctcctggacaacattaatacgcccgagggaatcattcctgccctgttcgaacccgagagagaaaagtccgcggccatcgatggcgagtatcgcctcagaggggaggctcggaaaacctttgtggaacttatgcgcagaggagacctgcctgtttggctgagctacaaggtggcctccgagggcttccaatattctgatcggcgctggtgctttgacggggaaagaaacaatcaggtcctcgaggaaaacatggatgtggagatctggacaaaagagggcgaacggaagaaactgagaccgcgctggcttgacgctcggacctacagcgaccccctggccctcagagagttcaaggaatttgctgccggacgccggtccgtctctggcgatctgattctggagatcgggaaactccctcagcaccttacacagagagcgcaaaatgccctggacaacctggtgatgctccataatagcgaacagggaggccgggcttatcgccacgccatggaggagctgcccgataccattgaaacacttatgctgctcgctctgatcgccgttctgaccgggggagtgacactcttctttctttccggcagaggcctggggaagacaagcattggactgctctgtgtgatggcctcttccgtcctgctttggatggctagcgttgagcctcattggatcgcggcctctatcattctggagttctttctcatggtgctgctgatccccgagccggaccggcagcgcacccctcaggataaccaactcgcttacgtggtcattggccttctgttcatgatcctgaccgtggccgccaatgagatggggctcctggaaacaaccaagaaagaccttggaattggccacgttgctgtggggaaccaccatcacgccgcgatgctggatgtcgacctccatcccgcctccgcttggacactgtacgccgtggctacgaccatcattacacctatgatgagacacaccatcgagaacacaaccgccaatatcagcctgacggcgattgccaaccaggctgccatcctcatgggacttgataagggctggcccatttctaaaatggacatcggcgtccctctgctggctctcgggtgctatagccaggtgaatcccctgacccttacagccgctgttctgatgctcgtggcccattacgcgattatcggaccgggcctgcaagccaaggctacccgggaagcccagaaacgcacagctgccgggatcatgaagaaccctaccgtcgatggaattgtggccatcgacctggatcccgttgtgtatgacgcgaagtttgagaaacagctcggccagattatgcttctgatcctgtgtacgtcccaaattctcctgatgagaacaacctgggctctttgcgaatctatcacactggccaccgggcccctcaccacactgtgggagggaagccctggcaagttctggaatacgaccatcgctgtctccatggccaacatttttcggggcagctacctggccggggctggactcgccttctcccttatgaaatctctgggcgggggacgcagaggcacaggggcgcagggagagaccctgggcgaaaagtggaaacggcagctcaatcagctgagcaagtccgagttcaacacatataagagatctggcatcaccgaagtggaccgcagcgaggccaaagaagggcttaagcggggagagacgacaaaacacgctgtgtccagaggcaccgccaagctgcgctggtttgttgagcggaatctcgtcaaaccggaagggaaggtgattgatctgggatgtggcagagggggatggtcttactattgcgctggcctgaagaaagtgaccgaggtcaagggctacacaaaagggggacccggccacgaagaacctatccccatggccacctacgggtggaacctcgttaaacttcatagcggaaaagacgtgttctttattcctcccgaaaagtgtgatacactgctgtgcgacatcggcgagtccagccctaatccgacgattgaggaagggcgcaccctccgggtgctgaaaatggtcgagccctggcttagaggaaaccaattctgtatcaagatcctgaatccttatatgccctctgtggttgaaacactcgagcagatgcagcgcaagcacggcggcatgctggtgcggaaccctctgtccagaaatagcacccatgagatgtactgggtctcttgcgggacaggaaacattgtgtccgcggttaatatgaccagccgcatgctcctgaaccggtttacgatggcccacagaaaacccacctatgaacgcgatgtggaccttggcgctgggacaagacacgtcgccgtggagccggaagtggctaacctggatatcattggacagcggatcgagaatattaagcatgaacacaaatctacctggcattacgacgaggataacccttataagacatgggcctaccacggctcctatgaggtcaaacccagcgggtccgctagctctatggttaatggagtggtgaagctcctgaccaagccctgggacgtcatccctatggtgacacaaatcgccatgaccgatacgacacccttcggccagcagcgcgtttttaaagaaaaggtggacaccagaacccctaaagcgaagcggggcacagcccaaattatggaggtcacggctaaatggctttgggggttcctgagcagaaacaagaagccgcggatctgtacccgcgaagagtttacaagaaaagtgcggtccaatgccgctattggagccgttttcgtggacgaaaaccagtggaactctgccaaggaggcggtcgaggatgaacgcttttgggacctcgtgcatagagagcgggaactgcacaaacagggcaagtgcgctacctgcgtttacaacatgatggggaaacgcgagaagaagctgggagagttcggcaaagccaaggggagcagagccatctggtacatgtggctcggcgctcggtttctggagttcgaggcccttggattcatgaatgaagatcactggttttcccgcgagaactctctgagcggcgtggaaggggagggactccataaactgggctatattcttagagacatctccaagatccccgggggaaatatgtacgctgatgacacagccggctgggatacccggattacagaggacgatctgcagaacgaagcgcgcatcaccgacattatggagcctgaacacgccctcctggctaaatctatcttcaagctgacgtatcaaaataaagtcgtgagagtccagcggcccgccaagaacgggaccgtgatggatgttattagccgcagagaccagcggggctccggacaggtgggcacatacgggctcaatacctttacaaacatggaggctcaactgatcagacagatggaaagcgagggaatcttctctccttccgagcttgaaacccccaacctggccgagcgcgtcctcgattggctggaaaagtatggcgtggagcggcttaaaagaatggcgattagcggggacgactgtgtggttaagccgatcgatgaccgctttgccacggctctgacagccctcaatgatatgggaaaagtgcggaaggacattcctcagtgggaaccctctaaaggctggaacgattggcagcaagtccctttctgctcccatcactttcaccagctgatcatgaaggacgggagagagattgtggttccctgtcgcaatcaggatgagctggtgggccgggctagagtcagccagggagccggctggtccctccgcgaaaccgcttgcctggggaagtcttacgcccaaatgtggcagcttatgtatttccatcggagagacctgcgcctcgcggccaacgctatctgtagcgccgtgcctgtcgattggattcccacatcccggaccacgtggagcatccacgcccatcaccagtggatgaccacagaggacatgctgtctgtgtggaatagagtttggatcgaagagaacccgtggatggaagataaaacccatatttccagctggggagacgtgccttaccttggcaagcgggaggaccaatggtgcgggtctctgatcggactcacagctagagccacctgggcgacaaatattcaggtcgctatcaaccaggtgcgccggctgattggcaatgagaactacctggattatatgaccagcatgaaaagatttaagaatgaatccgaccccgagggggccctctggtga

SEQ ID NO: 19384 - RNA, 9879 nt, synthetic construct
  misc_feature 1..9879: note = derived and/or modified CDS sequence (opt5) from DENV-1__HQ891314__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcacggaaatggtgcttctgacaatgaaggagaaatcctggctcgtccataagcagtggtttctggatcttcctctgccctggaccagcggggcttccacatctcaagagacctggaaccgccaggacctcctggtgaccttcaaaacagcgcacgccaagaagcaggaagtcgtggttctgggaagccaagagggcgctatgcacacggccctcaccggggccacagaaatccagacctccggaacaaccacgatttttgctggccatctgaaatgcagacttaagatggataaactgacactcaaggggatgagctatgtgatgtgtaccggctctttcaaactggagaaggaagtcgccgagacccagcacggaacagtgctggttcagatcaagtacgagggcaccgacgcgccgtgcaaaattcctttctccacacaagatgaaaagggggtgacgcagaatggacggcttatcaccgctaaccccatcgtcacagacaaagagaagcctgtgaatattgaagccgagcccccctttggcgagagctatatcgtgattggggccggagaaaaagctctcaagctgtcttggttcaagaaaggcagctccatcgggaagatgtttgaggccaccgctagaggcgcccgccggatggcgattctgggagatacagcctgggacttcggctctatcgggggagtttttaccagcgtcggcaaactcgtgcatcagatcttcgggacggcttacggagtgctgttttccggcgtcagctggaccatgaagattgggatcggcgtgcttctgacatggctcggactgaactctagatccaccagcctgtctatgacatgtattgccgttggccttgtgaccctctacctgggggtcatggtgcaggctgattccggatgcgttatcaattggaaaggccgcgaactgaagtgtgggagcggaattttcgtgacaaacgaggtccacacctggacggaacaatataagtttcaggccgactcccctaaacggctctctgcggccatcggcaaggcttgggaggagggggtgtgcggcattagaagcgccacacgcctggaaaatatcatgtggaaacagatctccaacgagcttaaccatattctgctcgaaaatgacatgaagttcaccgttgtggtcggagatgtggctggcatcctggcccaggggaaaaagatgattcggccgcaacccatggagcacaaatactcttggaagaactggggaaaggccaaaatcattggcgctgacgtgcagaatagcacctttatcatcgatgggcctaacacacccgaatgttccgacgatcagagagcgtggaatatttgggaggtcgaggactatggattcggcatctttaccacgaacatttggctgaagcttcgcgatagctacacacaggtttgcgaccaccggctcatgtctgccgctatcaaagattccaaggccgtgcatgccgacatgggctattggattgaaagcgagaaaaatgaaacctggaagctggctagagcctctttcatcgaggtgaagacatgtatctggcctaaatcccacaccctgtggagcaacggggtcctcgaatctgagatgattatccccaagatttacggaggcccgatcagccaacataattatcgccctgggtacttcacacagaccgcgggaccctggcacctgggcaaacttgagctggattttgacctctgcgaagggacgaccgtggttgtggatgagcactgcggaaaccggggcccttccctgagaacaaccacagtcaccggcaagattatccatgaatggtgttgccggagctgtacgctgccccctcttcgcttcagaggggaggacggatgctggtacggcatggagatccggcccgtgaaagaaaaggaggaaaatctcgttaagtctatggtgtccgctgggagcggagaggtcgactccttttctctgggcctgctctgtattagcatcatgattgaagaggtgatgagatcccgctggtctcggaaaatgctgatgacagggacccttgccgttttctttctgctcatcatgggacagctgacatggaacgatctgattagactttgcatcatggtgggcgccaatgctagcgaccgcatgggcatggggaccacctatctggccctcatggcgacattcaagatgagaccgatgtttgctgtcggactgctcttccggcgcctgacgtccagagaggtgcttctgctcaccattggcctgtctctggtggccagcgtcgaacttcctaactccctggaggaactcggggatggactggccatgggcatcatgatcctcaaactgcttacagactttcaaagccaccagctgtgggctaccctcctgtctatgacattcattaagaccacgttttccctgcattacgcctggaaaacaatggctatggttcttagcatcgtgtctctgttccccctctgtctgtccaccaccagccagaagacaacctggctccccgtgctgcttgggtctctgggatgcaagcctctgacaatgtttctcattgccgagaataaaatctggggccggaagtcctggccgctgaacgaaggcattatggcggtcgggatcgtgagcatccttctgtccagcctcctgaaaaacgatgttcccctcgccggacctctgattgctggcgggatgcttatcgcctgttatgtgatttctggaagctccgctgacctgtctctggagaaggccgccgaggtcagctgggaagaggaagctgagcactccggcgcgtctcataatatcctcgtggaagttcaggatgacgggacgatgaaaattaaggatgaggagcgcgacgataccctgacaatccttctgaaagccaccctcctggctgtgagcggagtctaccccctctccatccctgccacactgttcgtgtggtatttctggcaaaagaagaaacagagatctggcgtcctttgggacacccccagccctcccaaggtggaacgggccgttctggatgacggcatttaccgcatcatgcagagagggctgctcggacggtcccaggtgggcgtcggggtgtttcaagagaacgttttccacacgatgtggcacgtgacccgcggagctgtcctgatgtatcagggcaaaagacttgaaccgagctgggcctctgtgaagaaagacctgatttcctacgggggaggctggcggctccagggcagctggaatacaggggaggaggtgcaggttatcgcggtcgaacctggaaagaaccccaagaatgtgcaaaccgctcctggcacatttaaaacccccgagggggaagtgggagccattgccctggatttcaagccgggcacatctgggtcccctatcgtcaacagagagggaaaaattgtgggcctctacggcaatggggttgtgacgaccagcggaacatatgtctccgctatcgcccaggcgaaggcttctcaggaaggccccctgcctgagatcgaggacgaagtgtttcgcaaacggaaccttaccattatggatctgcatcccgggagcggaaagaccagacgctacctgcccgccatcgttcgggaggccattaagagaaaaatgcgcacactcatcctggctcctacgcgggtggtcgcctccgaaatggctgaggcccttaagggcatgccgattagatatcaaaccacagcggtgaaaagcgaacacaccgggaaggagatcgttgacctgatgtgccatgccacattcaccatgcgcctcctgtctcccgtgcgggtccctaattacaacatgatcattatggatgaggctcactttacggacccctccagcatcgccgctagaggctatatttctacacgggtgggaatgggcgaagccgccgctatcttcatgaccgcgacccctcccgggagcgtggaggcctttcctcagtccaatgctgtcattcaggatgaagagcgcgacatcccggaaagatcttggaacagcggatacgagtggatcacagatttccccggcaaaaccgtttggtttgtgccttccattaaggccgggaatgacatcgccaactgtctgcggaagaatggaaaacgcgtgattcagctctctagaaagacattcgataccgagtatcaaaaaacgaagaacaacgactgggactacgtcgtgacaaccgatatcagcgaaatgggcgctaatttccgggccgacagagttattgatccccgccggtgccttaaacctgtgatcctgaaggacgggcccgagagagtcattctggcgggcccgatgcctgtgacagttgcttccgccgcccagcgccggggaagaatcggccgcaaccataataaggaaggggatcagtacatctatatgggacagcccctcaacaatgacgaggatcacgctcactggaccgaggccaaaatgctgcttgacaacattaatacgcccgaaggcatcattcctgcgctgtttgagcccgaacgggagaagagcgccgctatcgatggggaatacagactccgcggagaggccagaaaaaccttcgtggagctgatgcggcgcggcgacctgcctgtctggctctcttataaggtggcttccgaagggtttcaatacagcgatagacggtggtgcttcgacggcgagcgcaacaatcaggtccttgaagagaacatggatgtggaaatttggacaaaagagggagagagaaagaaactgcggccgagatggctggacgcccgcacctattccgaccccctcgctctgcgggaatttaaggagttcgccgcgggcagacgctctgttagcggggatcttatcctggaaatcggaaagctccctcagcatctgacacagcgggcccaaaatgctctggacaacctcgtgatgcttcacaattccgagcagggcgggagagcctaccggcatgctatggaagagctgcccgataccattgagacactgatgctcctggcccttatcgccgtgctgaccggaggcgtcacgctctttttcctgtctggcaaagggctgggaaagacaagcattggcctcctttgtgttatggcttccagcgcgctgctgtggatggcctctgtggaacctcactggatcgctgcctccattatcctcgagtttttcctgatggtgcttctgatccccgaaccggaccgccagagaacccctcaggataaccaactcgcctatgtcgtgattgggctgctgtttatgatcctcaccgttgctgccaatgagatgggacttctggagacaaccaaaaaggacctgggcattgggcacgtggcggtcgaaaaccatcaccatgccgctatgctcgatgtggacctgcaccccgccagcgcttggacactttacgccgtcgcgacgaccatcattacacctatgatgcggcataccatcgagaacacaaccgccaatatttctctgacggctatcgccaaccaggctgccatcctcatgggactggataaaggctggcccatttccaagatggacatcggcgtgcctctgctcgctcttgggtgctacagccaggttaatcccctgaccctgacagccgcggtgctcatgctggtcgcccactatgctattatcggaccgggccttcaagccaaggctacccgcgaagcccagaaaagaacagccgcggggattatgaagaaccctaccatcgatggaatcgtggctattgacctggatcccgttgtgtacgacgccaaattcgagaagcagctcggccagatcatgctgctgattctctgtacgtctcaaatccttctgatgcggacaacctgggctctgtgcgaaagcattacactcgccaccgggcccctgaccacactttgggagggatcccctggcaaattttggaatacgaccatcgccgtctctatggctaacatcttccgcggcagctatctggccggggcgggactcgccttctccctgatgaagagcctgggcgggggaagacggggcacaggggctcagggagagaccctcggcgaaaagtggaaacgccagcttaatcagctgtccaagtctgagtttaacacatacaaaagaagcggcattatggaagtggaccggtccgaggccaaggaagggctgaaaagaggagagaccacgaagcacgctgtgtctcgcggcacagccaagctccggtggttcgttgagagaaatctggtcaaaccggaagggaaggtgatcgatcttggatgtggccgcgggggatggagctattactgcgcgggcctgaaaaaggtgaccgaggtcaaaggctataccaaggggggacccggccatgaagagcctattcccatggccacatacgggtggaacctcgttaaactgcactccggaaaggacgtgtttttcatccctcccgaaaagtgtgataccctgctctgcgacattggcgagtctagccctaatccgacaatcgaggaagggcggacgcttagagtgctgaaaatggtcgagccctggctgcgcggaaaccaattttgtattaagatcctcaatccttacatgccctccgtggttgaaaccctggagcagatgcagcggaaacatggcggcatgcttgtgagaaaccctctgagccgcaattctacacacgagatgtattgggtctcctgcgggaccggaaacatcgtgagcgctgttaatatgacatctcggatgctcctgaacagattcaccatggcccaccgcaagcccacgtacgaacgggatgtggacctgggcgctgggaccagacatgtcgccgtggagccggaagtggctaacctcgatattatcggacagcgcattgagaatatcaaacacgaacataagtccacatggcactatgacgaggataacccttacaagacctgggcctatcatggcagctacgaggtcaaaccctctgggtccgcgagctccatggttaatggagtggtgaagctgcttacaaaaccctgggacgtcattcctatggtgacccaaatcgccatgacagataccacgccctttggccagcagagagttttcaaggaaaaagtggacacacggacccctaaggctaagcgcggcaccgcccaaatcatggaggtcacagctagatggctgtggagctttctctctcggaacaaaaagccgagaatttgtacgcgggaagagttcacccgcaaagtgagaagcaatgccgccatcggggcggtttttgtggacgaaaaccagtggaattccgctaaggaggccgtcgaggatgaccggttctgggatctggtgcaccgcgaaagagagcttcacaaacagggaaagtgcgccacatgcgtttataacatgatgggcaagcgggaaaaaaagctgggggagtttggaaaagctaagggctctcgcgccatttggtacatgtggctcggggctagattcctggaattcgaggccctgggctttatgaatgaggaccattggttcagccgggaaaactccctctctggagtggagggcgaagggctgcacaaacttggatacatcctgcgcgatattagcaagatccccggcgggaatatgtatgcggacgataccgccggatgggacacaagaatcaccgaggatgacctccagaacgaggctaaaattacagatatcatggaacctgagcatgccctgcttgctaagtccatttttaagctgacctaccaaaataaagtcgtgcgggtccagcgccccgccaagaacggcacggtgatggacgttatctctagacgggatcagcgcgggagcggccaggtgggaacctatggcctcaatacattcaccaacatggaagcgcaactgattagacagatggagtccgaagagatctttagccctaacgagctggaaacacccaatctcgccgagcgggtcctggactggcttgaaaaatacggggtggagagactgaagcgcatggctatctctggagacgattgtgtggttaaaccgattgacgatcggttcgccaccgctctcacggccctgaacgacatgggcaaggtgagaaaggatatccctcagtgggaaccctccaaagggtggaatgactggcagcaagtccctttttgcagccaccacttccatcagcttattatgaaggatggacgcgagatcgtggttccctgtcggaaccaggacgagctggtgggcagagctcgcgtctctcagggggccggctggtccctccgggaaacagcgtgcctgggaaaaagctatgcccaaatgtggcagctgatgtactttcacagacgcgatctccggctggctgccaatgccatttgttccgctgtgcctgtcgactgggtgcccacctctagaacaacctggagcatccatgcccaccatcagtggatgacgaccgaggatatgctttccgtttggaaccgcgtgtggattgaagagaatccgtggatggaagacaagacacgggtcagctcttgggaggacgtgccttatctgggcaaaagagaggatcaatggtgcgggtccctcatcggactgaccgcgcgggctacatgggccaccaacatccaggttgccattaatcaggtgagacgccttatcggcaacgaaaattacagcgactacatgacatctatgaagcggttcaagaacgagagcgaacccgagggggctctgtggtga

SEQ ID NO: 19385 - RNA, 9879 nt, synthetic construct
  misc_feature 1..9879: note = derived and/or modified CDS sequence (opt5) from DENV-1__HQ891315__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagcccccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactgaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagcacaaatactcttggaagaattggggaaaggccaaaatcattggcgctgacgtgcagaacagcacctttatcatcgatgggcctaatacccccgaatgttccgacgatcagagagcgtggaacatttgggaggtcgaggactatggattcggcatctttacaaccaatatttggctgaagcttcgcgatagctacacgcaggtttgcgaccaccggctcatgtctgccgctatcaaagattccaaggccgtgcatgccgacatgggctattggattgaaagcgagaaaaacgaaacatggaagctggctagagcctctttcatcgaggtgaagacctgtatctggcctaaatcccacacactgtggagcaatggggtcctcgaatctgagatgattatccccaagatttacggaggcccgatcagccaacataactatcgccctgggtacttcacccagacagcgggaccctggcacctgggcaaacttgagctggattttgacctctgcgaagggaccacggtggttgtggatgagcactgcggaaatcggggcccttccctgagaaccacaaccgtcacaggcaagattatccatgaatggtgttgccggagctgtaccctgccccctcttcgcttcagaggggaggacggatgctggtacggcatggagatccggcccgtgaaagaaaaggaggaaaacctcgttaagtctattgtgtccgctgggagcggagaggtcgactccttttctctgggcctgctctgtatcagcattatgatcgaagaggtgatgagatcccgctggtctcggaaaatgctgatgacggggacacttgccgttttctttctgctcattatgggacagctgacctggaatgatctgatcagactttgcattatggtgggcgccaacgctagcgaccgcatgggcatggggacaacctatctggccctcatggcgaccttcaagatgagaccgatgtttgctgtcggactgctcttccggcgcctgacatccagagaggtgcttctgctcacgatcggcctgtctctggtggccagcgtcgaacttcctaattccctggaggaactcggggatggactggccatgggcatcatgattctcaaactgcttaccgactttcaaagccaccagctgtgggctacactcctgtctatgaccttcatcaagacaaccttttccctgcattacgcctggaaaacgatggctatggttcttagcattgtgtctctgttccccctctgtctgtccacaaccagccagaagaccacatggctccccgtgctgcttgggtctctgggatgcaagcctctgaccatgtttctcatcgccgagaacaaaatttggggccggaagtcctggccgctgaacgaaggcatcatggcggtcgggatcgtgagcattcttctgtccagcctcctgaaaaatgatgttcccctcgccggacctctgatcgctggcgggatgcttattgcctgttatgtgatctctggaagctccgctgacctgtctctggagaaggccgccgaggtcagctgggaagaggaagctgagcactccggcgcgtctcataacattctcgtggaagttcaggatgacgggacaatgaaaatcaaggatgaggagcgcgacgatacgctgaccatccttctgaaagccacactcctggctgtgagcggagtctaccccctctccattcctgccaccctgttcgtgtggtatttctggcaaaagaagaaacagagatctggcgtcctttgggacacacccagccctcccaaggtggaacgggccgttctggatgacggcatctaccgcattatgcagagagggctgctcggacggtcccaggtgggcgtcggggtgtttcaagagaatgttttccacaccatgtggcacgtgacgcgcggagctgtcctgatgtatcagggcaaaagacttgaaccgagctgggcctctgtgaagaaagacctgatctcctacgggggaggctggcggctccagggcagctggaacaccggggaggaggtgcaggttattgcggtcgaacctggaaagaatcccaagaacgtgcaaacagctcctggcacctttaaaacacccgagggggaagtgggagccatcgccctggatttcaagccgggcacctctgggtcccctattgtcaatagagagggaaaaatcgtgggcctctacggcaacggggttgtgacaacgagcggaacctatgtctccgctatcgcccaggcgaaggcttctcaggaaggccccctgcctgagattgaggacgaagtgtttcgcaaacggaatcttacaatcatggatctgcatcccgggagcggaaagaccagacgctacctgcccgccattgttcgggaggccatcaagagaaaaatgcgcaccctcattctggctcctacacgggtggtcgcctccgaaatggctgaggcccttaagggcatgccgatcagatatcaaacgaccgcggtgaaaagcgaacacacagggaaggagatcgttgacctgatgtgccatgccaccttcacaatgcgcctcctgtctcccgtgcgggtccctaactacaatatgattatcatggatgaggctcactttaccgacccctccagcattgccgctagaggctatatctctacgcgggtgggaatgggcgaagccgccgctattttcatgacagcgacccctcccgggagcgtggaggcctttcctcagtccaacgctgtcatccaggatgaagagcgcgacatcccggaaagatcttggaatagcggatacgagtggattaccgatttccccggcaaaacagtttggtttgtgccttccatcaaggccgggaacgacattgccaattgtctgcggaagaacggaaaacgcgtgatccagctctctagaaagaccttcgatacagagtatcaaaaaaccaagaacaatgactgggactacgtcgtgacgacagatattagcgaaatgggcgctaacttccgggccgacagagttatcgatccccgccggtgccttaaacctgtgattctgaaggacgggcccgagagagtcatcctggcgggcccgatgcctgtgaccgttgcttccgccgcccagcgccggggaagaatcggccgcaatcataacaaggaaggggatcagtacatttatatgggacagcccctcaataacgacgaggatcacgctcactggacagaggccaaaatgctgcttgacaatatcaacacccccgaaggcattatccctgcgctgtttgagcccgaacgggagaagagcgccgctattgatggggaatacagactccgcggagaggccagaaaaacgttcgtggagctgatgcggcgcggcgacctgcctgtctggctctcttataaggtggcttccgaagggtttcaatacagcgatagacggtggtgcttcgacggcgagcgcaataaccaggtccttgaagagaatatggatgtggaaatctggaccaaagagggagagagaaagaaactgcggccgagatggctggacgcccgcacatattccgaccccctcgctctgcgggaatttaaggagttcgccgcgggcagacgctctgttagcggggatcttatcctggaaattggaaagctccctcagcatctgacccagcgggcccaaaacgctctggacaatctcgtgatgcttcacaactccgagcagggcgggagagcctaccggcatgctatggaagagctgcccgatacaatcgagaccctgatgctcctggcccttattgccgtgctgacaggaggcgtcaccctctttttcctgtctggcaaagggctgggaaagacgagcatcggcctcctttgtgttatggcttccagcgcgctgctgtggatggcctctgtggaacctcactggattgctgcctccatcatcctcgagtttttcctgatggtgcttctgattcccgaaccggaccgccagagaacacctcaggataatcaactcgcctatgtcgtgatcgggctgctgtttatgattctcaccgttgctgccaacgagatgggacttctggagaccacaaaaaaggacctgggcatcgggcacgtggcggtcgaaaaccatcaccatgccgctatgctcgatgtggacctgcaccccgccagcgcttggaccctttacgccgtcgcgacaacgattatcacccctatgatgcggcatacaattgagaataccacagccaacatctctctgaccgctatcgccaatcaggctgccattctcatgggactggataaaggctggcccatctccaagatggacattggcgtgcctctgctcgctcttgggtgctacagccaggttaaccccctgacgctgaccgccgcggtgctcatgctggtcgcccactatgctatcattggaccgggccttcaagccaaggctacacgcgaagcccagaaaagaaccgccgcggggatcatgaagaatcctacaatcgatggaattgtggctatcgacctggatcccgttgtgtacgacgccaaattcgagaagcagctcggccagattatgctgctgatcctctgtacctctcaaattcttctgatgcggacgacatgggctctgtgcgaaagcatcaccctcgccacagggcccctgaccaccctttgggagggatcccctggcaaattttggaacacaacgatcgccgtctctatggctaatattttccgcggcagctatctggccggggcgggactcgccttctccctgatgaagagcctgggcgggggaagacggggcaccggggctcagggagagacactcggcgaaaagtggaaacgccagcttaaccagctgtccaagtctgagtttaatacctacaaaagaagcggcatcatggaagtggaccggtccgaggccaaggaagggctgaaaagaggagagacaaccaagcacgctgtgtctcgcggcacggccaagctccggtggttcgttgagagaaacctggtcaaaccggaagggaaggtgattgatcttggatgtggccgcgggggatggagctattactgcgcgggcctgaaaaaggtgacagaggtcaaaggctataccaaggggggacccggccatgaagagcctatccccatggccacctacgggtggaatctcgttaaactgcactccggaaaggacgtgtttttcattcctcccgaaaagtgtgatacactgctctgcgacatcggcgagtctagccctaacccgaccattgaggaagggcggacacttagagtgctgaaaatggtcgagccctggctgcgcggaaatcaattttgtatcaagatcctcaacccttacatgccctccgtggttgaaacgctggagcagatgcagcggaaacatggcggcatgcttgtgagaaatcctctgagccgcaactctacccacgagatgtattgggtctcctgcgggacaggaaatattgtgagcgctgttaacatgacctctcggatgctcctgaacagattcacaatggcccaccgcaagcccacctacgaacgggatgtggacctgggcgctgggacgagacatgtcgccgtggagccggaagtggctaatctcgatatcattggacagcgcatcgagaacattaaacacgaacataagtccacctggcactatgacgaggataatccttacaagacatgggcctatcatggcagctacgaggtcaaaccctctgggtccgcgagctccatggttaacggagtggtgaagctgcttaccaaaccctgggacgtcatccctatggtgacacaaatcgccatgaccgatacaaccccctttggccagcagagagttttcaaggaaaaagtggacacgcggacacctaaggctaagcgcggcaccgcccaaattatggaggtcaccgctagatggctgtggagctttctctctcggaataaaaagccgagaatctgtacacgggaagagttcacgcgcaaagtgagaagcaacgccgccattggggcggtttttgtggacgaaaatcagtggaactccgctaaggaggccgtcgaggatgaccggttctgggatctggtgcaccgcgaaagagagcttcacaaacagggaaagtgcgccacctgcgtttataatatgatgggcaagcgggaaaaaaagctgggggagtttggaaaagctaagggctctcgcgccatctggtacatgtggctcggggctagattcctggaattcgaggccctgggctttatgaacgaggaccattggttcagccgggaaaattccctctctggagtggagggcgaagggctgcacaaacttggatacattctgcgcgatatcagcaagatccccggcgggaacatgtatgcggacgatacagccggatgggacaccagaattacagaggatgacctccagaatgaggctaaaatcaccgatattatggaacctgagcatgccctgcttgctaagtccatctttaagctgacataccaaaacaaagtcgtgcgggtccagcgccccgccaagaatggcaccgtgatggacgttatttctagacgggatcagcgcgggagcggccaggtgggaacgtatggcctcaacaccttcacaaacatggaagcgcaactgatcagacagatggagtccgaagagatctttagccctaatgagctggaaacccccaacctcgccgagcgggtcctggactggcttgaaaaatacggggtggagagactgaagcgcatggctatttctggagacgattgtgtggttaaaccgatcgacgatcggttcgccacagctctcaccgccctgaatgacatgggcaaggtgagaaaggatattcctcagtgggaaccctccaaagggtggaacgactggcagcaagtccctttttgcagccaccacttccatcagcttatcatgaaggatggacgcgagattgtggttccctgtcggaatcaggacgagctggtgggcagagctcgcgtctctcagggggccggctggtccctccgggaaacggcgtgcctgggaaaaagctatgcccaaatgtggcagctgatgtactttcacagacgcgatctccggctggctgccaacgccatctgttccgctgtgcctgtcgactgggtgcccacatctagaaccacatggagcattcatgcccaccatcagtggatgaccacggaggatatgctttccgtttggaatcgcgtgtggatcgaagagaacccgtggatggaagacaagacccgggtcagctcttgggaggacgtgccttatctgggcaaaagagaggatcaatggtgcgggtccctcatcggactgacagcgcgggctacctgggccacaaatattcaggttgccatcaaccaggtgagacgccttattggcaatgaaaactacagcgactacatgacctctatgaagcggttcaagaatgagagcgaacccgagggggctctgtggtga

SEQ ID NO: 19386 - RNA, 9879 nt, synthetic construct
  misc_feature 1..9879: note = derived and/or modified CDS sequence (opt5) from DENV-1__HQ891316__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagcccccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactgaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagcacaaatactcttggaagaattggggaaaggccaaaatcattggcgctgacgtgcagaacagcacctttatcatcgatgggcctaatacccccgaatgttccgacgatcagagagcgtggaacatttgggaggtcgaggactatggattcggcatctttacaaccaatatttggctgaagcttcgcgatagctacacgcaggtttgcgaccaccggctcatgtctgccgctatcaaagattccaaggccgtgcatgccgacatgggctattggattgaaagcgagaaaaacgaaacatggaagctggctagagcctctttcatcgaggtgaagacctgtatctggcctaaatcccacacactgtggagcaatggggtcctcgaatctgagatgattatccccaagatttacggaggcccgatcagccaacataactatcgccctgggtacttcacccagacagcgggaccctggcacctgggcaaacttgagctggattttgacctctgcgaagggaccacggtggttgtggatgagcactgcggaaatcggggcccttccctgagaaccacaaccgtcacaggcaagattatccatgaatggtgttgccggagctgtaccctgccccctcttcgcttcagaggggaggacggatgctggtacggcatggagatccggcccgtgaaagaaaaggaggaaaacctcgttaagtctatggtgtccgctgggagcggagaggtcgactccttttctctgggcctgctctgtattagcatcatgattgaagaggtgatgagatcccgctggtctcggaaaatgctgatgacggggacacttgccgttttctttctgctcatcatgggacagctgacctggaatgatctgattagactttgcatcatggtgggcgccaacgctagcgaccgcatgggcatggggacaacctatctggccctcatggcgaccttcaagatgagaccgatgtttgctgtcggactgctcttccggcgcctgacatccagagaggtgcttctgctcacgattggcctgtctctggtggccagcgtcgaacttcctaattccctggaggaactcggggatggactggccatgggcatcatgatcctcaaactgcttaccgactttcaaagccaccagctgtgggctacactcctgtctatgaccttcattaagacaaccttttccctgcattacgcctggaaaacgatggctatggttcttagcatcgtgtctctgttccccctctgtctgtccacaaccagccagaagaccacatggctccccgtgctgcttgggtctctgggatgcaagcctctgaccatgtttctcattgccgagaacaaaatctggggccggaagtcctggccgctgaacgaaggcattatggcggtcgggatcgtgagcatccttctgtccagcctcctgaaaaatgatgttcccctcgccggacctctgattgctggcgggatgcttatcgcctgttatgtgatttctggaagctccgctgacctgtctctggagaaggccgccgaggtcagctgggaagaggaagctgagcactccggcgcgtctcataacatcctcgtggaagttcaggatgacgggacaatgaaaattaaggatgaggagcgcgacgatacgctgaccatccttctgaaagccacactcctggctgtgagcggagtctaccccctctccatccctgccaccctgttcgtgtggtatttctggcaaaagaagaaacagagatctggcgtcctttgggacacacccagccctcccaaggtggaacgggccgttctggatgacggcatttaccgcatcatgcagagagggctgctcggacggtcccaggtgggcgtcggggtgtttcaagagaatgttttccacaccatgtggcacgtgacgcgcggagctgtcctgatgtatcagggcaaaagacttgaaccgagctgggcctctgtgaagaaagacctgatttcctacgggggaggctggcggctccagggcagctggaacaccggggaggaggtgcaggttatcgcggtcgaacctggaaagaatcccaagaacgtgcaaacagctcctggcacctttaaaacacccgagggggaagtgggagccattgccctggatttcaagccgggcacctctgggtcccctatcgtcaatagagagggaaaaattgtgggcctctacggcaacggggttgtgacaacgagcggaacctatgtctccgctatcgcccaggcgaaggcttctcaggaaggccccctgcctgagatcgaggacgaagtgtttcgcaaacggaatcttacaattatggatctgcatcccgggagcggaaagaccagacgctacctgcccgccatcgttcgggaggccattaagagaaaaatgcgcaccctcatcctggctcctacacgggtggtcgcctccgaaatggctgaggcccttaagggcatgccgattagatatcaaacgaccgcggtgaaaagcgaacacacagggaaggagatcgttgacctgatgtgccatgccaccttcacaatgcgcctcctgtctcccgtgcgggtccctaactacaatatgatcattatggatgaggctcactttaccgacccctccagcatcgccgctagaggctatatttctacgcgggtgggaatgggcgaagccgccgctatcttcatgacagcgacccctcccgggagcgtggaggcctttcctcagtccaacgctgtcattcaggatgaagagcgcgacatcccggaaagatcttggaatagcggatacgagtggatcaccgatttccccggcaaaacagtttggtttgtgccttccattaaggccgggaacgacatcgccaattgtctgcggaagaacggaaaacgcgtgattcagctctctagaaagaccttcgatacagagtatcaaaaaaccaagaacaatgactgggactacgtcgtgacgacagatatcagcgaaatgggcgctaacttccgggccgacagagttattgatccccgccggtgccttaaacctgtgatcctgaaggacgggcccgagagagtcattctggcgggcccgatgcctgtgaccgttgcttccgccgcccagcgccggggaagaatcggccgcaatcataacaaggaaggggatcagtacatctatatgggacagcccctcaataacgacgaggatcacgctcactggacagaggccaaaatgctgcttgacaatattaacacccccgaaggcatcattcctgcgctgtttgagcccgaacgggagaagagcgccgctatcgatggggaatacagactccgcggagaggccagaaaaacgttcgtggagctgatgcggcgcggcgacctgcctgtctggctctcttataaggtggcttccgaagggtttcaatacagcgatagacggtggtgcttcgacggcgagcgcaataaccaggtccttgaagagaatatggatgtggaaatttggaccaaagagggagagagaaagaaactgcggccgagatggctggacgcccgcacatattccgaccccctcgctctgcgggaatttaaggagttcgccgcgggcagacgctctgttagcggggatcttatcctggaaatcggaaagctccctcagcatctgacccagcgggcccaaaacgctctggacaatctcgtgatgcttcacaactccgagcagggcgggagagcctaccggcatgctatggaagagctgcccgatacaattgagaccctgatgctcctggcccttatcgccgtgctgacaggaggcgtcaccctctttttcctgtctggcaaagggctgggaaagacgagcattggcctcctttgtgttatggcttccagcgcgctgctgtggatggcctctgtggaacctcactggatcgctgcctccattatcctcgagtttttcctgatggtgcttctgatccccgaaccggaccgccagagaacacctcaggataatcaactcgcctatgtcgtgattgggctgctgtttatgatcctcaccgttgctgccaacgagatgggacttctggagaccacaaaaaaggacctgggcattgggcacgtggcggtcgaaaaccatcaccatgccgctatgctcgatgtggacctgcaccccgccagcgcttggaccctttacgccgtcgcgacaacgatcattacccctatgatgcggcatacaatcgagaataccacagccaacatttctctgaccgctatcgccaatcaggctgccatcctcatgggactggataaaggctggcccatttccaagatggacatcggcgtgcctctgctcgctcttgggtgctacagccaggttaaccccctgacgctgaccgccgcggtgctcatgctggtcgcccactatgctattatcggaccgggccttcaagccaaggctacacgcgaagcccagaaaagaaccgccgcggggattatgaagaatcctacaatcgatggaatcgtggctattgacctggatcccgttgtgtacgacgccaaattcgagaagcagctcggccagatcatgctgctgattctctgtacctctcaaatccttctgatgcggacgacatgggctctgtgcgaaagcattaccctcgccacagggcccctgaccaccctttgggagggatcccctggcaaattttggaacacaacgatcgccgtctctatggctaatatcttccgcggcagctatctggccggggcgggactcgccttctccctgatgaagagcctgggcgggggaagacggggcaccggggctcagggagagacactcggcgaaaagtggaaacgccagcttaaccagctgtccaagtctgagtttaatacctacaaaagaagcggcattatggaagtggaccggtccgaggccaaggaagggctgaaaagaggagagacaaccaagcacgctgtgtctcgcggcacggccaagctccggtggttcgttgagagaaacctggtcaaaccggaagggaaggtgatcgatcttggatgtggccgcgggggatggagctattactgcgcgggcctgaaaaaggtgacagaggtcaaaggctataccaaggggggacccggccatgaagagcctattcccatggccacctacgggtggaatctcgttaaactgcactccggaaaggacgtgtttttcatccctcccgaaaagtgtgatacactgctctgcgacattggcgagtctagccctaacccgaccatcgaggaagggcggacacttagagtgctgaaaatggtcgagccctggctgcgcggaaatcaattttgtattaagatcctcaacccttacatgccctccgtggttgaaacgctggagcagatgcagcggaaacatggcggcatgcttgtgagaaatcctctgagccgcaactctacccacgagatgtattgggtctcctgcgggacaggaaatatcgtgagcgctgttaacatgacctctcggatgctcctgaacagattcacaatggcccaccgcaagcccacctacgaacgggatgtggacctgggcgctgggacgagacatgtcgccgtggagccggaagtggctaatctcgatattatcggacagcgcattgagaacatcaaacacgaacataagtccacctggcactatgacgaggataatccttacaagacatgggcctatcatggcagctacgaggtcaaaccctctgggtccgcgagctccatggttaacggagtggtgaagctgcttaccaaaccctgggacgtcattcctatggtgacacaaatcgccatgaccgatacaaccccctttggccagcagagagttttcaaggaaaaagtggacacgcggacacctaaggctaagcgcggcaccgcccaaatcatggaggtcaccgctagatggctgtggagctttctctctcggaataaaaagccgagaatttgtacacgggaagagttcacgcgcaaagtgagaagcaacgccgccatcggggcggtttttgtggacgaaaatcagtggaactccgctaaggaggccgtcgaggatgaccggttctgggatctggtgcaccgcgaaagagagcttcacaaacagggaaagtgcgccacctgcgtttataatatgatgggcaagcgggaaaaaaagctgggggagtttggaaaagctaagggctctcgcgccatttggtacatgtggctcggggctagattcctggaattcgaggccctgggctttatgaacgaggaccattggttcagccgggaaaattccctctctggagtggagggcgaagggctgcacaaacttggatacatcctgcgcgatattagcaagatccccggcgggaacatgtatgcggacgatacagccggatgggacaccagaatcacagaggatgacctccagaatgaggctaaaattaccgatatcatggaacctgagcatgccctgcttgctaagtccatttttaagctgacataccaaaacaaagtcgtgcgggtccagcgccccgccaagaatggcaccgtgatggacgttatctctagacgggatcagcgcgggagcggccaggtgggaacgtatggcctcaacaccttcacaaacatggaagcgcaactgattagacagatggagtccgaagagatctttagccctaatgagctggaaacccccaacctcgccgagcgggtcctggactggcttgaaaaatacggggtggagagactgaagcgcatggctatctctggagacgattgtgtggttaaaccgattgacgatcggttcgccacagctctcaccgccctgaatgacatgggcaaggtgagaaaggatatccctcagtgggaaccctccaaagggtggaacgactggcagcaagtccctttttgcagccaccacttccatcagcttattatgaaggatggacgcgagatcgtggttccctgtcggaatcaggacgagctggtgggcagagctcgcgtctctcagggggccggctggtccctccgggaaacggcgtgcctgggaaaaagctatgcccaaatgtggcagctgatgtactttcacagacgcgatctccggctggctgccaacgccatttgttccgctgtgcctgtcgactgggtgcccacatctagaaccacatggagcatccatgcccaccatcagtggatgaccacggaggatatgctttccgtttggaatcgcgtgtggattgaagagaacccgtggatggaagacaagacccgggtcagctcttgggaggacgtgccttatctgggcaaaagagaggatcaatggtgcgggtccctcatcggactgacagcgcgggctacctgggccacaaatatccaggttgccattaaccaggtgagacgccttatcggcaatgaaaactacagcgactacatgacctctatgaagcggttcaagaatgagagcgaacccgagggggctctgtggtga

SEQ ID NO: 19387 - RNA, 9879 nt, synthetic construct
  misc_feature 1..9879: note = derived and/or modified CDS sequence (opt5) from DENV-1__JN054256__SS-prME
  source 1..9879: mol_type = other RNA
agcgtgaccatgctgctcatgctgatgcccacagcccttgctttccacctgacgaccagagagggcgaacctcatatgatcgtctccaagcaggagcgggggaaatctctcctgtttaagacaagcgccggagttaacatgtgcacccttattgcgatggacctgggcgaactctgtgaggatacaatgacctacaaatgcccgcgcatcacagaagctgagcccgacgatgtggactgttggtgcaatgccaccgatacgtgggtgacctatgggacatgttcccaaaccggagagcacagacgggacaagcgctctgtcgccctggctcctcatgtgggcctggggctcgaaacaagaaccgagacgtggatgagctccgaaggagcctggaaacagattcagcgggttgagacatgggctctgcgccaccccggcttcaccgtgatcgccctttttctggcgcatgccattggcacatctatcacccagaaggggatcattttcatcctcctgatgcttgtcacccctagcatggctatgagatgcgtgggaattggctcccgggattttgttgaggggctgagcggagccacatgggtggacgtcgtgctcgaacacggctcttgtgtgacgaccatggctaaggataaacccacactggacatcgagctgctcaagaccgaagtcacaaaccctgccgttctgcgcaaactttgcattgaggcgaagatctccaataccacgacagatagcagatgtccgacccaaggggaagccaccctggtggaggagcaggacgctaacttcgtgtgccggcgcacatttgtcgatagaggatggggcaatggctgtgggctcttcggaaaaggctctctgcttacctgcgccaagtttaagtgcgtgacaaaactggaagggaagattgttcagtacgagaacctcaaatattccgtgatcgtcacggtgcacaccggagaccagcatcaagttggcaatgaaagcacagagcacgggaccacagctaccatcacgccccaggcccctaccacagaaattcagctgaccgactacggagccctgacactcgattgttctccccggaccggcctggacttcacggagatggtgcttctgacaatgaaggagaaatcctggctcgtccataagcagtggtttctggatcttcctctgccctggaccagcggcgcttccacatctcaagaaacctggaaccgccaggacctcctggtgaccttcaaaacagcgcacgccaagaagcaggaggtcgtggttctggggagccaagaaggagctatgcacacggccctcaccggcgccacagagatccagacctccgggacaaccacgatttttgctggacatctgaaatgcagacttaagatggataaactgacactcaagggcatgagctatgtgatgtgtaccgggtctttcaaactggaaaaggaggtcgccgagacccagcacggcacagtgctggttcagatcaagtacgaaggaaccgacgcgccgtgcaaaattcctttctccacacaagatgagaagggcgtgacgcagaatgggcggcttatcaccgctaaccccatcgtcacagacaaagaaaagcctgtgaatattgaggccgagcccccctttggagaaagctatatcgtgattggcgccggggagaaagctctcaagctgtcttggttcaagaaaggaagctccatcggcaagatgtttgaagccaccgctagaggggcccgccggatggcgattctgggcgatacagcctgggacttcggatctatcggcggggtttttaccagcgtcggaaaactcgtgcatcagatcttcggcacggcttacggggtgctgttttccggagtcagctggaccatgaagattggcatcggggtgcttctgacatggctcggcctgaactctagatccaccagcctgtctatgacatgtattgccgttggacttgtgaccctctacctgggcgtcatggtgcaggctgattccgggtgcgttatcaattggaaaggacgcgagctgaagtgtggcagcgggattttcgtgacaaacgaagtccacacctggacggagcaatataagtttcaggccgactcccctaaacggctctctgcggccatcggaaaggcttgggaggaaggcgtgtgcgggattagaagcgccacacgcctggagaatatcatgtggaaacagatctccaacgaacttaaccatattctgctcgagaatgacatgaagctgaccgttgtggtcggcgatgtggctggaatcctggcccagggcaaaaagatgattcggccgcaacccatggaacacaaatactcttggaagaactgggggaaggccaaaatcattggagctgacgtgcagaatagcaccttcatcatcgatggccctaacacacccgagtgttccgacgatcagagagcgtggaatatttgggaggtcgaagactatgggtttggaatcttcaccacgaacatttggcttaagctccgcgatagctacacacaggtttgcgaccaccggctgatgtctgccgctatcaaagattccaaggccgtgcatgccgacatgggctattggattgagagcgaaaaaaatgagacctggaagctggctagagcctcttttatcgaagtgaagacatgtatctggcctaaatcccacaccctctggagcaacggcgtcctggagtctgagatgattatccccaagatttacgggggaccgatcagccaacataattatcgccctggctacttcacacagaccgcggggccctggcaccttggaaaactggaactcgatttcgacctgtgcgagggcacgaccgtggttgtggatgaacactgcgggaaccggggaccttccctgagaacaaccacagtcaccggcaagattatccatgagtggtgttgccggagctgtacgcttccccctctccgctttagaggcgaggacgggtgctggtacggaatggaaatccggcccgtgaaagagaaggaagagaatctggttaagtctatggtgtccgctggcagcggggaagtcgactccttctctctgggactcctgtgtattagcatcatgattgaggaggtgatgagatcccgctggtctcggaaaatgcttatgacaggcaccctggccgtttttttcctcctgatcatggggcagctgacatggaacgatcttattagactgtgcatcatggtgggagccaatgctagcgaccgcatgggcatgggcaccacctatctcgccctgatggcgacatttaagatgagaccgatgttcgctgtcgggctcctgtttcggcgccttacgtccagagaagtgctgctcctgaccattggactgtctcttgtggccagcgtcgagctgcctaactccctcgaagagctgggcgatgggctcgccatgggaatcatgatcctgaaacttctgattgacttccaaagccaccagctctgggctacactgctgtctatgacctttatcaagacaaccttctcccttcattacgcctggaaaacgatggctatggttctgagcattgtgtctctctttcccctgtgtctctccacaaccagccagaagaccacatggctgcccgtgcttctgggctctctggggtgcaagcctctcaccatgttcctgatcgccgaaaataaaatttggggacggaagtcctggccgcttaacgagggcatcatggcggtcggcatcgtgagcattctgctctccagcctgctcaaaaacgatgttcccctggccgggcctcttatcgctggaggcatgctgattgcctgttatgtgatctctgggagctccgctgacctgtctctcgagaaggccgccgaagtcagctgggaggaagaggctgaacactccggagcgtctcataatattctggtggaggttcaggatgacggcacaatgaaaatcaaggatgaggaacgcgacgatacgcttaccatcctgctcaaagccacactgctcgctgtgagcggggtctaccccctgtccattcctgccaccctttttgtgtggtatttctggcaaaagaagaaacagagatctggagtcctgtgggacacacccagccctcccaaggtggagcgggccgttctggatgacggcatctaccgcattatgcagagaggcctcctggggcggtcccaggtgggagtcggcgtgttccaagaaaacgtttttcacaccatgtggcacgtgacgcgcggggctgtccttatgtatcagggaaaaagactggagccgagctgggcctctgtgaagaaagacctcatctcctacggcgggggatggcggctgcagggcagctggaataccggcgaggaagtgcaggttattgcggtcgagcctgggaagaaccccaagaatgtgcaaacagctcctggaaccttcaaaacacccgaaggcgaggtgggggccatcgccctcgattttaagccgggaacctctggctcccctattgtcaacagagaagggaaaatcgtgggactgtacggcaatggcgttgtgacaacgagcgggacctatgtctccgctatcgcccaggcgaaggcttctcaggagggaccccttcctgagattgaagacgaggtgttccgcaaacggaacctgacaatcatggatctgcatcccggcagcgggaagaccagacgctacctccccgccattgttcgggaagccatcaagagaaaaatgcgcaccctgattcttgctcctacacgggtggtcgcctccgagatggctgaagccctgaagggaatgccgatcagatatcaaacgaccgcggtgaaaagcgagcacacaggcaaggagatcgttgacctcatgtgccatgccacctttacaatgcgcctgctgtctcccgtgcgggtccctaattacaacatgattatcatggatgaagctcacttcaccgacccctccagcattgccgctagagggtatatctctacgcgggtgggcatgggagaggccgccgctatttttatgacagcgacccctcccggcagcgtggaagccttccctcagtccaatgctgtcatccaggatgaggaacgcgacatcccggagagatcttggaacagcgggtacgagtggattaccgattttcccggaaaaacagtttggttcgtgccttccatcaaggccggcaatgacattgccaactgtctccggaagaatgggaaacgcgtgatccagctttctagaaagacctttgatacagaatatcaaaaaaccaagaacaacgactgggactacgtcgtgacgacagatattagcgagatgggagctaatttccgggccgacagagttatcgatccccgccggtgcctgaaacctgtgattctgaaggacggccccgaaagagtcatcctcgcggggccgatgcctgtgaccgttgcttccgccgcccagcgccggggcagaatcggacgcaaccataataaggagggcgatcagtacatttatatggggcagcccctgaacaatgacgaggatcacgctcactggacagaagccaaaatgcttctggacaacatcaatacccccgagggaattatccctgcgctcttcgaacccgagcgggaaaagagcgccgctattgatggcgagtacagactgcgcggggaggccagaaaaacgtttgtggaactgatgcggcgcggagacctccctgtctggctttcttataaggtggcttccgagggcttccaatacagcgatagacggtggtgctttgacggggaacgcaacaatcaggtcctggaggaaaacatggatgtggagatctggaccaaagagggcgaaagaaagaaactgcggccgagatggctcgacgcccgcacatattccgaccccctggctcttcgggagttcaaggaatttgccgcgggaagacgctctgttagcggcgatctgatcctcgagattgggaagctgcctcagcatctgacccagcgggcccaaaatgctctcgacaaccttgtgatgctgcacaattccgaacagggaggcagagcctaccggcatgctatggaggagctgcccgatacaatcgaaaccctcatgctgcttgccctgattgccgtgctcacagggggagtcaccctgttctttctgtctggcaaaggcctcgggaagacgagcatcggacttctgtgtgttatggcttccagcgcgctgctctggatggcctctgtggagcctcactggattgctgcctccatcatcctggaattctttcttatggtgctgctcattcccgagccggaccgccagagaacacctcaggataaccaactggcctatgtcgtgatcggcctgctcttcatgattcttaccgttgctgccaatgagatggggctgctggaaaccacaaaaaaggacctcggaatcggccacgtggcggtcgagaaccatcaccatgccgctatgctggatgtggaccttcaccccgccagcgcttggaccctgtacgccgtcgcgacaacgattatcacccctatgatgcggcatacaattgaaaacaccacagccaatatctctctcaccgctatcgccaaccaggctgccattctgatggggctggataaaggatggcccatctccaagatggacattggcgtgcctctccttgctctgggctgctacagccaggttaatcccctgacgctcaccgccgcggtgctgatgcttgtcgcccactatgctatcattgggccgggactgcaagccaaggctacacgcgaggcccagaaaagaaccgccgcgggcatcatgaagaaccctacaatcgatgggattgtggctatcgacctcgatcccgttgtgtacgacgccaaatttgaaaagcagctgggacagattatgctgctcatcctttgtacctctcaaattctgctgatgcggacgacatgggctctctgcgagagcatcaccctggccacaggcccccttaccaccctgtgggaggggtcccctggaaaattctggaatacaacgatcgccgtctctatggctaacatttttcgcggcagctatctcgccggcgcggggctggccttctccctgatgaagagcctcggaggcgggagacggggaaccggcgctcagggggaaacacttggagagaagtggaaacgccagctgaatcagctgtccaagtctgaattcaacacctacaaaagaagcggcatcatggaggtggaccggtccgaagccaaggagggcctcaaaagaggggagacaaccaagcacgctgtgtctcgcggaacggccaagctgcggtggtttgttgaaagaaatcttgtcaaaccggagggcaaggtgattgatctggggtgtggacgcggcgggtggagctattactgcgcgggactcaaaaaggtgacagaagtcaaaggctataccaagggcgggcccggacatgaggaacctatccccatggccacctacggctggaacctggttaaactgcactccgggaaggacgtgttctttattcctcccgagaagtgtgatacactcctttgcgacatcggagagtctagccctaatccgaccattgaagagggccggacactgagagtgctgaaaatggtcgaaccctggctccgcgggaaccaattctgtatcaagatcctgaatccttacatgccctccgtggttgagacgcttgagcagatgcagcggaaacatggaggcatgctggtgagaaaccctctcagccgcaattctacccacgaaatgtattgggtctcctgcggcacagggaacattgtgagcgctgttaatatgacctctcggatgctgctgaacagatttacaatggcccaccgcaagcccacctacgagcgggatgtggacctcggagctggcacgagacatgtcgccgtggaaccggaggtggctaacctggatatcattgggcagcgcatcgaaaatattaaacacgagcataagtccacctggcactatgacgaggataacccttacaagacatgggcctatcatggaagctacgaagtcaaaccctctggctccgcgagctccatggttaatggggtggtgaagcttctgaccaaaccctgggacgtcatccctatggtgacacaaatcgccatgaccgatacaacccccttcggacagcagagagtttttaaggagaaagtggacacgcggacacctaaggctaagcgcggcaccgcccaaattatggaagtcaccgctagatggctctggagcttcctgtctcggaacaaaaagccgagaatctgtacacgggaggaatttacgcgcaaagtgagaagcaatgccgccattggcgcggttttcgtggacgagaaccagtggaattccgctaaggaggccgtcgaagatgaccggttttgggatcttgtgcaccgcgagagagaactgcacaaacaggggaagtgcgccacctgcgtttataacatgatgggaaagcgggagaaaaagctcggcgaattcgggaaagctaagggatctcgcgccatctggtacatgtggctgggcgctagatttctggagttcgaggccctcgggttcatgaatgaagaccattggtttagccgggagaactccctgtctggcgtggaaggagagggccttcacaaactggggtacattctccgcgatatcagcaagatccccggaggcaatatgtatgcggacgatacagccgggtgggacaccagaattacagaggatgacctgcagaacgaagctaaaatcaccgatattatggagcctgaacatgcccttctggctaagtccatcttcaagctcacataccaaaataaagtcgtgcgggtccagcgccccgccaagaacggaaccgtgatggacgttatttctagacgggatcagcgcggcagcgggcaggtgggcacgtatggactgaatacctttacaaacatggaggcgcaactgatcagacagatggaatccgaggagatcttcagccctaacgaactcgagacccccaatctggccgaacgggtccttgactggctggagaaatacggcgtggaaagactcaagcgcatggctatttctggggacgattgtgtggttaaaccgatcgacgatcggtttgccacagctctgaccgcccttaacgacatgggaaaggtgagaaaggatattcctcagtgggagccctccaaaggctggaatgactggcagcaagtccctttctgcagccaccactttcatcagctgatcatgaaggatgggcgcgagattgtggttccctgtcggaaccaggacgaactcgtgggaagagctcgcgtctctcagggcgccgggtggtccctgcgggagacggcgtgcctgggcaaaagctatgcccaaatgtggcagctcatgtacttccacagacgcgatctgcggcttgctgccaatgccatctgttccgctgtgcctgtcgactgggtgcccacatctagaaccacatggagcattcatgcccaccatcagtggatgaccacggaagatatgctgtccgtttggaaccgcgtgtggatcgaggaaaatccgtggatggaggacaagacccgggtcagctcttgggaggacgtgccttatctcggaaaaagagaagatcaatggtgcggctccctgatcgggcttacagcgcgggctacctgggccacaaacattcaggttgccatcaatcaggtgagacgcctgattggaaacgagaattacagcgactacatgacctctatgaagcggtttaagaacgaaagcgagcccgagggcgctctctggtga

SEQ ID NO: 19388 - RNA, 9879 nt, synthetic construct
  misc_feature 1..9879: note = derived and/or modified CDS sequence (opt5) from DENV-1__JN054255__SS-prME
  source 1..9879: mol_type = other RNA
agcgtgacaatgctgctgatgctgatgcccacagcccttgctttccacctgacgacccggggcggggagcctcatatgatcgtgtccaagcaggaacggggaaagtctctcctgtttaagacaagcgccggcgttaacatgtgcacccttattgcgatggacctgggggagctctgtgaagatacaatgacctacaaatgccccagaatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagatgtccggaacaaccacaatttttgctggccatctgaaatgcagacttaagatggataaactgaccctcaaggggatgagctatgtgatgtgtacgggctctttcaaactggagaaggaagtcgccgagacacagcacggaaccgtgctggttcagatcaagtacgagggcaccgacgcgccgtgcaaaattcctttctccacacaagatgaaaagggggtgacccagaacggacggcttatcacagctaatcccatcgtcacggacaaagagaagcctgtgaacattgaagccgagccgccctttggcgagagctatatcgtgattggggccggagaaaaagctctcaagctgtcttggttcaagaaaggcagctccatcgggaagatgtttgaggccaccgctagaggcgcccgccggatggcgattctgggagatacagcctgggacttcggctctatcgggggagtttttaccagcgtcggcaaactcgtgcatcagatcttcgggacagcttacggagtgctgttttccggcgtcagctggaccatgaagattgggatcggcgtgcttctgacgtggctcggactcaattctagatccaccagcctgtctatgacatgtattgccgttggccttgtgaccctctacctgggggtcatggtgcaggctgattccggatgcgttatcaactggaaaggccgcgaactgaagtgtgggagcggaattttcgtgacaaatgaggtccacacctggacagaacaatataagtttcaggccgactcccctaaacggctctctgcggccatcggcaaggcttgggaggagggggtgtgcggcattagaagcgccacccgcctggaaaacatcatgtggaaacagatctccaacgagcttaatcatattctgctcgaaaacgacatgaagttcacggttgtggtcggagatgtggctggcatcctggcccaggggaaaaagatgattcggccgcaacccatggagcacaaatactcttggaagaattggggaaaggccaaaatcattggcgctgacgtgcagaacagcacatttatcatcgatgggcctaatacccccgaatgttccgacgatcagagagcgtggaacatttgggaggtcgaggactatggattcggcatctttaccacaaatatttggctgaaacttcgcgatagctacacccaggtttgcgaccaccggctcatgtctgccgctatcaaagattccaaggccgtgcatgccgacatgggctattggattgaaagcgagaaaaacgaaacgtggaagctggctagagcctctttcatcgaggtgaagacatgtatctggcctaaatcccacaccctgtggagcaatggggtcctcgaatctgagatgattatccccaagatttacggaggcccgatcagccaacataactatcgccctgggtacttcacacagaccgcgggaccctggcacctgggcaaacttgagctggattttgacctctgcgaagggacaaccgtggttgtggatgagcactgcggaaatcggggcccttccctgagaacgaccacagtcaccggcaagattatccatgaatggtgttgccggagctgtacactgccccctcttcgcttcagaggggaggacggatgctggtacggcatggagatccggcccgtgaaagaaaaggaggaaaacctcgttaagtctatggtgtccgctgggagcggagaggtcgactccttttctctgggcctgctctgtattagcatcatgattgaagaggtgatgagatcccgctggtctcggaaaatgctgatgaccgggacgcttgccgttttctttctgctcatcatgggacagctgacatggaatgatctgattagactttgcatcatggtgggcgccaacgctagcgaccgcatgggcatggggaccacatatctggccctcatggcgaccttcaagatgagaccgatgtttgctgtcggactgctgttccggcgcctgacctccagagaggtgcttctgctcacaattggcctgtctctggtggccagcgtcgaacttcctaattccctggaggaactcggggatggactggccatgggcatcatgatcctcaaactgcttacggactttcaaagccaccagctgtgggctaccctcctgtctatgacattcattaagaccacattttccctgcattacgcctggaaaaccatggctatggttcttagcatcgtgtctctgttccccctctgtctgtccacgacaagccagaagaccacctggctccccgtgctgcttgggtctctgggatgcaagcctctgacaatgtttctcattgccgagaacaaaatctggggccggaagtcctggccgctgaacgaaggcattatggcggtcgggatcgtgagcatccttctgtccagcctcctgaaaaatgatgttcccctcgccggacctctgattgctggcgggatgcttatcgcctgttatgtgatttctggaagctccgctgacctgtctctggagaaggccgccgaggtcagctgggaagaggaagctgagcactccggcgcgtctcataacatcctcgtggaagttcaggatgacgggaccatgaaaattaaggatgaggagcgcgacgatacactgacgatccttctgaaagccaccctcctggctgtgagcggagtctaccccctctccatccctgccacactgttcgtgtggtatttctggcaaaagaagaaacagagatctggcgtcctttgggacacccccagccctcccaaggtggaaaaagccgttctggatgacggcatttaccggatcatgcagcgcgggctgctcggaagatcccaggtgggcgtcggggtgtttcaagagaatgttttccacacaatgtggcacgtgacccggggagctgtcctgatgtatcagggcaagcgccttgaaccgagctgggcctctgtgaaaaaggacctgatttcctacgggggaggctggagactccagggcagctggaacacgggggaggaggtgcaggttatcgcggtcgaacctggaaagaatcccaaaaacgtgcaaaccgctcctggcacatttaagacccccgagggggaagtgggagccattgccctggatttcaaaccgggcacatctgggtcccctatcgtcaatcgggagggaaagattgtgggcctctacggcaacggggttgtgaccacaagcggaacgtatgtctccggcatcgctcaggccaaagcgtctcaggaagggcccctgcctgagatcgaggacgaagtgtttagaaagcgcaatcttaccattatggatctgcatcccggaagcggcaagacacggagatacctgcccgctatcgttcgcgaggccattaaacggaagatgagaaccctcatcctggcccctacccgcgtggtcgcttccgaaatggccgaggctcttaaagggatgccgattcggtatcaaacaacggccgtcaagagcgaacacaccggcaaagagatcgttgacctgatgtgccatgcgacattcaccatgagactcctgtctcccgtgcgcgtccctaactacaatatgatcattatggatgaggcccactttacagacccctccagcatcgctgcccggggatatatttctaccagagtgggcatgggggaagctgccgccatcttcatgacggctacacctcccggaagcgtggaggcgtttcctcagtccaacgccgtcattcaggatgaggaacgggacatcccggaacgctcttggaatagcggctacgagtggatcaccgatttccccgggaagaccgtttggtttgtgccttccattaaggctggaaacgacatcgccaattgtctgcgcaagaatggcaagcgggtgattcagctctctcgcaaaacattcgataccgagtatcaaaagaccaagaacaatgactgggactacgtcgtgaccacggatatcagcgaaatgggggccaacttcagagctgaccgggttattgatcccagacgctgccttaagcctgtgatcctgaaggacggccccgagcgggtcattctggccggaccgatgcctgtgacagttgcgtccgctgcccagagacgcggccggatcgggagaaatcataacaaagaaggagatcagtacatctatatgggccagcccctcaataacgacgagaatcacgcccactggaccgaggctaagatgctgcttgataacattaatacacccgaagggatcattcctgccctgtttgagcccgaacgcgagaaaagcgcggccatcgacggagaataccggctcagaggcgaggctcgcaagaccttcgtggagctgatgagaagaggggatctgcctgtctggctctcttataaagtggcctccgaaggctttcaatacagcgaccgcagatggtgcttcgatggagagcggaacaatcaggtccttgaagagaacatggacgtggaaatttggacgaaggagggcgagcgcaaaaagctgagaccgcggtggctggatgctagaacctattccgaccccctcgccctgcgcgaatttaaggagttcgctgccgggcggagatctgttagcggagaccttatcctggaaatcggcaaactccctcagcatctgacacagcgcgcgcaaaatgccctggataacctcgtgatgcttcacaattccgagcaagggggacgggcttacagacatgccatggaggaactgcccgacaccattgagacactgatgctcctggctcttatcgccgtgctgaccggcggcgtcacactctttttcctgtctgggaagggactgggcaaaaccagcattgggctcctttgtgttatggcctccagcgctctgctgtggatggcgtctgtggaacctcactggatcgccgcttccattatcctcgagtttttcctgatggtgcttctgatccccgaaccggatcggcagcgcacgcctcaggacaaccaactcgcctatgtcgtgattggactgctgtttatgatcctcacagttgccgctaacgagatgggccttctggagaccaccaagaaagatctggggattggacacgtggccgtcgaaaatcatcaccatgcggccatgctcgacatcgatctgcaccccgctagcgcctggacactttacgctgtggccaccacaattatcacgcctatgatgagacataccattgagaacacaaccgcgaatatctctctgacagccatcgctaaccaggccgctattctcatgggcctggacaagggctggcccatctccaagatggatattggggtccctctgctcgcccttggatgctacagccaggtgaatcccctgaccctgacggctgccgttctcatgctggtggcgcactatgccatcattggcccggggcttcaagctaaagccacccgggaagctcagaagcgcacagccgccggaatcatgaaaaaccctaccatcgacggcattgtcgcgatcgatctggaccccgtggtttacgatgctaagttcgagaaacagctcgggcagattatgctgctgatcctctgtacatctcaaattcttctgatgagaaccacgtgggccctgtgcgaaagcatcacactcgctaccggacccctgacaaccctttgggagggctcccctggcaagttttggaataccacaatcgccgtgtctatggccaacattttccgggggagctatctggctggagccggcctcgcgttctccctgatgaaaagcctcgggggaggccgcagagggacgggagcccagggcgagaccctcggcgaaaaatggaagcggcagcttaatcagctgtccaaatctgagtttaacacatacaagcgcagcgggatcatggaagtcgacagatccgaggctaaagaaggactgaagcggggcgagaccacaaagcacgccgtgtctagagggaccgctaaactccgctggttcgtggagcggaatctggttaagccggaaggaaaagtcattgaccttggctgtgggagaggaggctggagctattactgcgccggcctgaagaaagtgacggaggtgaaggggtatacaaaaggaggccccgggcatgaggaacctatccccatggcgacctacggatggaacctcgtcaagctgcactccggcaaggatgtgtttttcattcctcccgaaaaatgtgacaccctgctctgcgatatcggggagtctagccctaatccgacaattgaggaaggacgcacccttcgggttctgaagatggtggagccctggctgagaggcaaccaattttgtatcaaaatcctcaatccttacatgccctccgtcgtggaaacactggagcagatgcagcgcaagcatggcgggatgcttgttcggaaccctctgagcagaaattctacgcacgagatgtattgggtgtcctgcggaaccggcaacattgtcagcgccgtgaacatgacatctcgcatgctcctgaatcggttcaccatggctcacagaaaacccacatacgaacgcgacgttgatctgggggccggaacccggcatgtggctgtcgagccggaagtggccaacctcgacatcattggccagagaatcgagaatattaagcacgaacataagtccacgtggcactatgatgaggacaacccttacaaaacctgggcttatcatgggagctacgaggtgaagccctctggatccgccagctccatggtcaatggcatggttaaactgcttacaaagccctgggatgtgatccctatggtgacccaaatcgcgatgacagacaccacaccctttggccagcagcgcgtcttcaaagaaaaggtggataccagaacgcctaaggccaaacgggggacagctcaaattatggaggttaccgcccgctggctgtggagctttctctctagaaacaagaaaccgcggatctgtaccagagaagagttcacacggaaggtgcgcagcaatgctgccattggagccgtctttgtggacgaaaaccagtggaactccgcgaaagaggctgttgaggacgatagattctgggacctggtgcaccgggaacgcgagcttcacaagcagggcaagtgcgccacgtgcgtctataacatgatggggaaaagagaaaagaaactgggagagtttggcaaggccaaagggtctcgggctatctggtacatgtggctcggcgcccgcttcctggagttcgaggctctgggatttatgaatgaggatcattggttcagcagagaaaactccctctctggcgtggagggggaaggactgcacaaacttggctacattctgcgggacatcagcaaaatccccgggggaaatatgtatgccgatgacaccgcgggctgggatacacgcattaccgaggacgatctccagaacgaggccaagatcacagacattatggaacctgagcatgctctgcttgccaagtccatctttaaactgacctaccaaaataaggttgtgagagtccagcggccctctaaaaacgggacagtgatggatgtcattagccgcagagaccagcggggctccggacaggtgggcacctatgggctcaacacgttcaccaatatggaagctcaactgatccgccagatggagagcgaagagatcttttctcctaacgagctggaaacacccaatctcgccaagagagttctggattggcttgagaaatacggagtggaacggctgaagagaatggcgatttccggcgacgactgtgtcgtgaagccgatcgatgaccgcttcgccaccgctctcacagccctgaacgatatggggaaagtgcggaaggacattcctcagtgggagcccagcaaaggatggaatgattggcagcaagttcctttttgctctcaccacttccatcagcttatcatgaaggacggcagagaaattgtggtcccctgtcgcaaccaggatgagctggtggggcgggctagagtttcccagggcgccggatggagcctccgcgagaccgcttgcctgggcaaatcctatgcccaaatgtggcagctgatgtactttcaccggagagacctccgcctggcggccaatgctatctgttctgccgtgcctgtcgattgggtgcccacgagccggacaacctggtccattcatgcccaccatcagtggatgacaaccgaagacatgcttagcgtctggaacagagtgtggatcgaggaaaatccgtggatggaggataagacgcgcgtttcttcctgggaagacgtgccttatctggggaagcgggaggaccaatggtgcggaagcctcatcggcctgaccgctagagccacatgggcgaccaacattcaggtcgctatcaatcaggtgcggagacttattgggaacgagaattactctgattacatgacaagcatgaaacgcttcaagaacgaatccgagcccgaaggagccctgtggtga

SEQ ID NO: 19389 - RNA, 9879 nt, synthetic construct
  misc_feature 1..9879: note = derived and/or modified CDS sequence (opt5) from DENV-1__KP406801__SS-prME
  source 1..9879: mol_type = other RNA
agcgtgaccatgctgctcatgctgcttcccaccgccctggctttccacctcacgacccggggcggggaacctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatacaattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccaaggagaggcgacactcgtggaagaacaggatgccaacttcgtgtgccggcgcacctttgtcgacagaggctggggcaatgggtgtggactgttcggcaaagggagccttctgacatgcgctaagtttaagtgcgtgacgaaactcgagggaaagattgttcagtacgaaaacctgaaatattctgtgatcgtcaccgtgcacacaggcgatcagcatcaagttgggaatgagaccacagaacacggaaccatcgccacgattacaccccaggctcctacatccgagatccagctgaccgactacggcgccctcacactggactgtagcccccggaccggccttgatttcaacgaaatggtgctgctcacgatgaaggagaaatcttggctggtccataagcagtggtttcttgacctgcctctcccctggacatccggggccagcacctcccaagagacatggaatcgccaggatctgctggtgaccttcaaaaccgctcacgcgaagaagcaggaagtcgtggttctcggatctcaagagggcgccatgcacacagctctggccggggccacggaaattcagatgagcggaaccacaaccatctttgctggccatcttaaatgcagactgaagatggacaaactcacactgaagggggtgtcctatgtcatgtgtaccggcagcttcaaactggagaaggaagtggccgagacgcagcacggaacagttcttgtgcaggtcaagtacgagggcaccgatgcgccgtgcaaaattcctttctctatccaagacgaaaagggggtgacccagaacggacggctcatcacagctaatcccattgccaccgataaagagaagcctgtgaacatcgaaacagagccgccctttggcgagtcctatattgttatcggggccggagaaaaagctctgaagctgagctggttcaagaaaggctctagcattgggaagatgtttgaggccacggctagaggcgcccgccggatggcgatcctcggagacaccgcctgggatttcggctccatcgggggagtctttacatctgtgggcaaactggtgcatcaggtcttcgggaccgcttacggagtgctttttagcggcgtttcctggacaatgaagattgggatcggcattctgctcacctggctgggactgaatagcagatctacgtcccttagcatgacctgtatcgccgtgggcatggtcacactctacctgggggtgatggttcaggctgactctggatgcgtgattaactggaaaggccgcgaactgaagtgtgggtccggaatcttcgtcaccaacgaggtgcacacatggaccgaacaatataagtttcaggccgatagccctaaacggctctccgcggccattggcaaggcttgggaggagggggtttgcggcatcagatctgccacacgcctggaaaatatcatgtggaaacagattagcaacgagcttaatcatatcctgctcgaaaacgacatgaagttcaccgtggtcgtgggagacgctaatggcattctgacgcaggggaaaaagatgatccggccgcaacccatggagcacaaatactcctggaagtcttggggaaaggccaaaattatcggcgccgatacacagaacaccacctttatcattgacgggcctgatacacccgaatgtcctgacgatcagagagcttggaatatctgggaggtggaggactatggattcggcatttttaccacgaacatctggctgaaacttcgcgatagctacacacagatgtgcgaccaccggctcatgtccgcggccattaaagatagcaaggctgtccatgccgacatgggctattggatcgaatctgagaaaaatgaaacctggaagctggccagagcttccttcatcgaggttaagacatgtatttggccccgcagccacaccctgtggtctaacggggtgctcgaatccgagatgatcattccgaaaatctacggaggccctattagccaacataattatcggcccgggtacttcacacagaccgccggaccttggcacctgggcaaacttgagctggattttgacctctgcgaagggacgaccgtggtcgtggatgagcactgcggaaacagaggcccctctctgcggacaaccacagttaccggcaaaatcatccatgaatggtgttgccgcagctgtacgctgcctccccttagattcaagggggaggacggatgctggtacggcatggagattcggccggtgaaagaaaaggaggaaaatctcgtcagatccatggtgagcgcggggtctggagaggttgactcctttagcctgggcctgctctgtgtgtccatcatgattgaagaggtcatgcgctctcggtggagcagaaagatgctgatgacagggacccttgctgtgttctttctgctcatcatgggacagctgacatggaacgatctgattcgcctttgcatcatggttggcgccaatgtgtccgacagaatgggcatggggaccacctatctggccctcatggctacattcaaaatgcggcctatgtttgccgtcggactcctgttccgcagactgacgtctcgggaggtgcttctgctcaccattggcctgagcctggtggcgtccgtcgaacttcccaactctctggaggaactcggggatggactggctatgggcatcatgatgctcaagctgcttacagactttcaaagccaccagctgtggaccacactcctgtccctgaccttcatcaaaacgacacttagcctggattacgcctggaagaccattgccatggttctctctatcgtgtccctgtttcccctctgtctgagcaccacatctcagaaaaccacatggcttcctgtgctgctggggtccttcggatgcaagccgctcacgatgtttctgattaccgagaacaagatctggggccgcagaagctggccccttaatgaaggcattatggctgtcgggatcgtgtctatcctgctctccagcctgctcaaaaacgacgttcctctggccggaccccttattgctggcgggatgctgatcgcctgttatgtgatttccggaagctctgcggatctgagcctcgagaaggccgctgaggtctcctgggaagaggaagccgagcattctggcgctagccacaatatcctggtggaagttcaggacgatgggacaatgaaaattaaggacgaggagcgggatgacacccttacaatcctgctcaaagccaccctgctcgccgtgtccggagtctaccctatgtctatccccgctacgctgttcgtgtggtatttctggcaaaagaaaaagcagcgcagcggcgtcctttgggatacccctagccctcccgaagtggagagagcggttctggacgacggcatttaccggatcctgcagcgcgggctcctgggaagatctcaggtgggcgtcggggtgtttcaagatggagttttccatacaatgtggcacgtgacccggggcgccgtccttatgtatcaggggaagagactggaacccagctgggcttccgtgaaaaaggacctcattagctacggaggcggctggcgctttcaggggtcttggaacacaggagaggaggtgcaggttatcgccgtcgaacccggcaaaaatcctaagaacgtgcaaaccacacccgggacgttcaaaaccccggagggagaagtgggcgccattgctctggattttaagcctgggacatccggaagccccatcgtcaatcgggagggcaagattgtgggcctctacgggaacggagttgtgaccacctctggcacatatgtctccgccatcgcgcaggctaaagccagccaggaagggcctctgcccgagatcgaggacgaagtgttcaagaaaagaaatcttacgattatggatctgcaccccggatccggcaagacccgccggtacctgcctgccatcgttagagaggctattaaacgcaagctccggacactgatccttgccccgaccagagtggtcgcgtctgaaatggctgaggccctgaaggggatgcccattcgctatcaaacaaccgccgtgaaaagcgaacatacgggccgggagatcgttgacctcatgtgccacgctacatttaccatgagactgctgtcccctgtgcgggtccccaactacaatatgatcattatggatgaggcccatttcaccgaccctgctagcatcgccgcgcgcggatatatttctacaagagtgggcatgggggaagccgctgccatctttatgaccgctacaccccctggatccgtggaggccttcccgcagagcaacgccgtcattcaggatgaagaacgggacatccccgaacgctcttggaatagcggctacgattggatcaccgactttcctgggaagacggtttggttcgtgccctccattaaatctggaaacgacatcgctaattgtctcagaaagaacggcaaacgggtgattcagcttagcagaaagacattcgataccgagtatcaaaagaccaagaacaatgactgggattacgtcgtgaccacggacatctccgagatgggggcgaactttcgcgccgatcgggttattgaccctagacgctgcctgaagcccgtgatcctgaaagatggcccggaacgggtcattctcgctggacctatgcccgtgaccgttgcctctgccgctcagagacgcggccggatcgggagaaatcagaacaaggagggagaccagtacatctatatgggccaacccctgaataacgatgaagaccacgcccattggacagaggcgaaaatgcttctggataatattaacacccctgaggggatcattcccgctctcttcgaacctgagcgcgaaaagagcgccgccatcgacggagagtacagactgcggggcgaagctcgcaagacatttgtggagctgatgagaagaggggatctcccggtctggctttcctataaagtggccagcgagggcttccagtactctgaccgcagatggtgctttgacggagaacggaataaccaggtcctggaggaaaatatggatgtggagatttggaccaaggaaggcgagcgcaagaaactgcgcccccggtggctcgacgcgagaacatattccgatcctctggcccttcgcgagttcaaagaatttgctgccgggcggagaagcgtttccggagacctgatcctcgagatcggcaagctgccccagcacctgaccctccgggctcaaaacgcccttgataatctggtgatgctgcacaactctgaacaagggggaaaggcttaccgccatgccatggaggaactccctgacacgattgagacactgatgcttctggcgctcatcgccgtgctgaccggcggcgtcaccctgttctttctcagcgggaagggacttggcaagacatccattgggctgctgtgtgttatggcttctagcgtgctcctgtggatggcctccgtggagccccactggatcgctgccagcattatccttgagttctttctgatggtcctcctgatcccggagcctgatagacagcggacaccccaggacaatcaactggcctatgtggttattggactccttttcatgatcctgacagtggctgcgaacgaaatgggcctgctcgagacgaccaaaaaggatctggggattggacatgtcgtggccgagaaccaccaccatgctacaatgcttgacatcgatctgcaccctgcctctgcctggaccctctacgctgtcgccacaaccattatcacgcccatgatgcgccataccattgaaaatacaaccgcgaacatctccctgacagccatcgctaatcaggccgctattctgatgggcctcgacaaaggctggcctatcagcaagatggatattggggtgccccttctggccctgggatgctactctcaggttaacccgctcaccctgacggcggccgtgcttatgctggtcgctcactatgccatcattggccctgggctccaagctaaagccacaagagaggctcagaagcggaccgccgcgggaatcatgaagaatcccacagtggacggcatcgttgccattgacctggatcccgtggtctacgacgctaaatttgaaaagcagctggggcagatcatgctccttattctgtgtacctcccaaatcctgctcatgcgcaccacatgggccctgtgcgagagcattacgcttgctaccggacctctgacaaccctctgggaaggctctccgggcaaattctggaacacaaccatcgccgtgagcatggccaatatcttcagagggtcctatctggcgggagctggcctggccttttctctcatgaagtcccttgggggaggccggcgcgggacgggagctcagggcgagacactgggcgagaaatggaagagacagctgaaccagctctccaagagcgagttcaatacctacaaacggtccgggattatggaggtggatagatctgaagccaaggagggactgaaacgcggcgaaaccacaaagcatgccgttagccgggggaccgctaaacttagatggtttgtcgagcgcaacctggtgcggcccgagggaaaggtgatcgacctcggctgtgggagaggaggctggtcctattactgcgccggcctgaagaaagtcacagaagttaaggggtatacgaaaggaggccctgggcacgaggaacccattcctatggcgacctacggatggaatctggtgaagctctactctggcaaagatgtgttctttacaccccctgagaagtgtgacacccttctgtgcgatatcggggaaagctccccgaaccccacaattgaggagggacgcaccctgcgggtcctcaaaatggtggaaccttggctgagaggcaatcaattctgtatcaagattcttaacccctatatgccttctgttgtggagacgctggaacagatgcagcgcaagcacggcgggatgctcgtccggaatcccctgagcagaaactccacccatgagatgtactgggtgagctgcggaacaggcaatatcgtttctgccgtgaacatgacctcccgcatgctgctcaaccggtttacaatggctcacagaaaaccgacctatgagcgcgacgtcgatctgggggccggaacaagacatgtggctgtggaacctgagatcgccaatcttgacattatcggccagcggattgaaaacatcaagaatgagcacaaaagcacctggcactacgatgaagacaacccctataagacgtgggcgtaccatgggtcttatgaggtcaaaccctccggaagcgcctcttccatggttaatggcgtggtgcgcctgctcacaaagccttgggacgtcattcccatggtgacccaaatcgctatgaccgatacaacgcctttcggccagcagagagtttttaaggagaaagtggacacccggacaccgagacccaagcgggggaccgcccaaatcatggaagtcacagctaaatggctgtggggattccttagccgcaacaagaaacctagaatttgtacccgggaggaatttacacgcaaggtgagatccaatgccgctatcggcgccgttttcgtggatgagaaccagtggaatagcgcgaaggaagccgtcgaggacgagaaattttgggatctggtgcaccgggaacgcgagctccataagcaggggaaatgcgctacctgcgtttacaacatgatgggaaagagagagaaaaagctgggcgagttcgggaaggccaaaggctctcgggctatttggtacatgtggctgggagcccgcttcctcgaatttgaggccctgggcttcatgaatgaggaccactggtttagcagagaaaactccctttctggggtggagggagaaggcctgcataagctcgggtatatcctgcgggatattagcaaaatccccggaggcaatatgtacgcggacgatacggctgggtgggacacccgcatcacagaggatgaccttcagaacgaggccaagattaccgatatcatggaacctgagcacgccctgctcgctacatccattttcaaactgacctatcaaaataaggtcgtgagagtccagcggcccgccaaatctggcacggtgatggacgttatcagccgcagagaccagcggggatccggccaggtggggacatacggactgaacacctttacaaacatggaagtccaactcattagacagatggagtctgaaggcatcttcagcccgtccgagctggagaatagcaaccttgctgaacgcgtgctggattggctcgagaagcacggggtggaacggctgaagagaatggccatctctggagacgattgtgttgtgaaacctaccgacgatcgctttgcgacggcccttaccgctctgaatgacatgggcaaggtccggaaagatattccccagtgggagccttccaaggggtggaacgactggcagcaagtgcccttctgcagccatcactttcatcagctcatcatgaaagatggcagagaaattgttgtgccttgtcgcaatcaggacgagctggtcggacgggccagagtgtctcagggcgctgggtggtccctgcgcgagacagcctgcctcggaaagagctatgcgcaaatgtggcagctgatgtacttccaccggagagatcttcgcctggccgctaacgccatctgttccgctgtccccgtggactgggttccgacctctcggacaacctggagcattcacgcccatcaccagtggatgacaaccgaagacatgctctccgtgtggaatagagtctggatcgaggaaaacccttggatggaggataagacgcatgtgagctcttgggaagacgttccctatctgggcaaacgggaggatcaatggtgcgggtcccttattggactgacagctagagccacctgggcgaccaatatccaggtggccatcaaccaggtccgccggctcattggcaatgagaactacctggactacatgacaagcatgaagagatttaaaaatgaatctgatcccgagggggctctgtggtga

SEQ ID NO: 19390 - RNA, 9879 nt, synthetic construct
  misc_feature 1..9879: note = derived and/or modified CDS sequence (opt5) from DENV-1__KP406802__SS-prME
  source 1..9879: mol_type = other RNA
agcgtgaccatgctgctcatgctgatgcccacagcccttgctttccacctgacgacccggggaggggaacctcatatgatcgtgtccaagcaggaacggggaaaatctctcctgtttaagaccagcgccggcattaacatgtgcacccttatcgcgatggacctgggggaactctgtgaagatacactgacctacaaatgcccccgcattacagaggctgaacccgacgatgttgactgttggtgcaatgccaccgatacgtgggtgacctatggaacatgttcccaaaccggcgagcaccggcgggacaagcgctctgtggccctggctcctcatgtggggctcggactggagacaagaaccgaaacgtggatgagctccgagggcgcctggaaacagatccagcgggtggaaacatgggctcttagacaccccggcttcaccgttattgccctgtttctcgcgcatgccatcgggacatctatcacccagaagggaattatcttcattctgcttatgctggtgacccctagcatggctatgagatgcgtcggcatcgggtcccgggattttgtggagggactcagcggcgccacatgggttgacgtggtcctggagcacgggtcttgtgtgacgaccatggctaaggataaacccacactggacattgaactcctgaagaccgaggtgacaaaccctgccgtccttcgcaaactgtgcatcgaagcgaagatttccaataccacgacagatagcagatgtccgacccaaggagaggccaccctcgttgaagaacaggacgctaacttcgtgtgccggcgcacatttgtggatagaggctggggcaatgggtgtggactgttcggcaaagggtctcttatcacatgcgccaagtttaagtgcgtcacaaaactggagggaaagatcgtgcagtacgaaaacctcaaatattccgttattgtgacggtccacaccggcgaccagcatcaagtggggaatgagagcacagaacacggaaccacagctaccatcacgccccaggcccctaccacagagattcagctgaccgactacggcgccctgacactcgattgttctccccggaccggcctggacttcaacgaaatggttcttctgacgatgaaggagaaatcctggctcgtgcataagcagtggtttctggatcttcctctgccctggacaagcggggcttccacctctcaagagatctggaatcgccaggacctcctggtcacattcaaaaccgcgcacgccaagaagcaggaagtggtcgtgctgggaagccaagagggcgctatgcacaccgccctcacaggggccacggaaattcagacctccggaacaaccacaatctttgctggccatctgaaatgcagacttaagatggataaactgaccctcaaggggatgagctatgttatgtgtacgggctctttcaaactggagaaggaagtggccgagacacagcacggaaccgtcctggtgcagatcaagtacgagggcaccgacgcgccgtgcaaaattcctttctccacacaagatgaaaagggggttacccagaacggacggcttatcacagctaatcccattgtgacggacaaagagaagcctgtcaacatcgaagccgagccgccctttggcgagagctatattgtgatcggggccggagaaaaagctctcaagctgtcttggttcaagaaaggcagctccatcgggaagatgtttgaggccaccgctagaggcgcccgccggatggcgattctgggagatacagcctgggacttcggctctatcgggggagtgtttaccagcgttggcaaactcgtccatcagattttcgggacagcttacggagtgctgttttccggcgtgagctggaccatgaagatcgggattggcgtccttctgacgtggctcggactcaattctagatccaccagcctgtctatgacatgtatcgccgtgggccttgttaccctctacctgggggtgatggtccaggctgattccggatgcgtgattaactggaaaggccgcgaactgaagtgtgggagcggaatcttcgttacaaatgaggtgcacacctggacagaacaatataagtttcaggccgactcccctaaacggctctctgcggccatcggcaaggcttgggaggagggggtctgcggcattagaagcgccacccgcctggaaaacatcatgtggaaacagatttccaacgagcttaatcatatcctgctcgaaaacgacatgaagttcacggtggttgtgggagatgtcgctggcattctggcccaggggaaaaagatgatccggccgcaacccatggagcacaaatactcttggaaaagctggggaaaggccaagatcattggcgctgacgtgcagaatacaacctttatcattgatgggcctaacacccccgaatgtcctgacgatcagagagcgtggaatatctgggaggtggaggactatggattcggcatttttacaaccaacatctggctgaaacttcgcgattcctacacgcaggtctgcgaccaccggctcatgagcgccgctatcaaagattctaaggccgttcatgccgacatgggctattggattgaatccgagaaaaatgaaacatggaagctggctagagccagcttcatcgaggtgaagacctgtatttggcccaaatctcacacactgtggtccaacggggtgctcgaaagcgagatgatcattccgaagatctacggaggccctatctctcaacataattatcgccccgggtacttcacccagacagcgggaccttggcacctgggcaaacttgagctggattttgacctctgcgaagggaccacggtcgtggttgatgagcactgcggaaaccggggccccagcctgagaaccacaaccgtgacaggcaagattatccatgaatggtgttgccggtcctgtaccctgcctccccttcgcttcagaggggaggacggatgctggtacggcatggagattcggccggtcaaagaaaaggaggaaaatctcgtcaagagcatggtttctgctgggtccggagaggtggacagcttttccctgggcctgctctgtatctctattatgatcgaagaggtcatgagaagccgctggtcccggaaaatgctgatgacggggacacttgccgtgttctttctgctcattatgggacagctgacctggaacgatctgatcagactttgcatcatggttggcgccaatgcttctgaccgcatgggcatggggacaacctatctggccctcatggcgaccttcaagatgagacctatgtttgctgtgggactgctgttccggcgcctgacaagcagagaggtccttctgctcacgattggcctgtccctggtggcctctgtggaacttcccaacagcctggaggaactcggggatggactggccatgggcatcatgattctcaaactgcttaccgactttcaatcccaccagctgtgggctacactcctgagcctgaccttcatcaagacaaccttttctcttcattacgcctggaaaacgatggctatggtcctgtccattgttagcctcttccccctgtgtctctctacaacctcccagaagaccacatggctgcctgtgcttctggggagcctgggatgcaagccgctcaccatgtttctgatcgccgagaataaaatctggggccggaagtcttggccccttaacgaaggcattatggcggtggggatcgtctccattctgctcagctccctgctcaaaaacgatgtgcctctggccggaccccttatcgctggcgggatgctgattgcctgttatgttatcagcggatctagcgctgacctgtccctcgagaaggccgccgaggtgtcttgggaagaggaagctgagcacagcggcgcgtcccataatatcctggtcgaagtgcaggatgacgggacaatgaaaattaaggatgaggagcgcgacgatacgcttaccatcctgctcaaagccacactgctcgctgtttctggagtgtaccctctgagcattcccgccacccttttcgtctggtatttctggcaaaagaagaaacagagatccggcgtgctgtgggacacaccttctcccccggaagtcgagcgggccgtgctggatgacggcatctaccgcattatgcagagagggctcctgggacggagccaggttggcgtgggggtctttcaagaaaacgtgttccacaccatgtggcacgttacgcgcggagctgtgcttatgtatcagggcaagagactggagccttcctgggccagcgtcaaaaaggacctcatctcttacgggggaggctggcggctgcagggctcctggaataccggggaggaagtccaggtgattgcggttgagcccggcaagaaccctaagaatgtccaaacagctcccggcacctttaagacaccggaaggggaggtgggagccatcgccctcgatttcaaacctggcaccagcgggtctcccatcgtgaacagagaaggaaagattgtcggcctgtacggcaatggggtggttacaacgtccggaacctatgtgagcgctatcgcccaggcgaaggcttcccaggagggccctcttcccgagattgaagacgaggtctttcgcaagcggaacctgacaatcatggatctgcatcccgggtctggaaaaaccagacgctacctccctgccattgtgcgggaagccatcaagagaaagctgcgcacccttatcctggctccgacacgggttgtggccagcgagatggctgaagccctcaaaggcatgcccattagatatcaaacgaccgcggtcaagtccgagcacacagggaaagagatcgtggacctgatgtgccatgccaccttcacaatgcgcctgctcagccctgttcgggtgcccaattacaacatgattatcatggatgaagctcactttaccgacccttcttccattgccgctagaggctatatcagcacgcgggtcggaatgggcgaggccgccgctatcttcatgacagcgacaccccctgggtctgtggaagcctttccgcagagcaatgctgtgattcaggatgaggaacgcgacatccccgagagatcctggaactctggatacgagtggattaccgatttccctggcaagacagtctggtttgttcccagcatcaaatccgggaatgacattgccaactgtcttcggaagaatggaaagcgcgtgatccagctgtctagaaaaaccttcgatacagaatatcaaaagaccaaaaacaacgactgggactacgtggtcacgacagatattagcgagatgggcgccaatttccgggctgacagagtgatcgatcctcgccggtgcctgaagcccgttatcctcaaagacgggccggaaagagtgattctggccggccctatgcccgtcaccgtggcgtccgctgcccagcgccggggaagagttggccgcaaccataataaggagggggatcagtacatctatatgggacagccccttaacaatgacgaggatcacgcccactggacagaagctaagatgctgctcgacaacattaatacccctgagggcatcattcccgccctgtttgaacctgagcgggaaaagagcgcggccatcgatggggagtacagactgcgcggagaggctagaaagacgttcgtggagctcatgcggcgcggcgaccttccggtctggctgtcttataaagtggcctccgaggggtttcaatacagcgatagacggtggtgcttcgacggcgaacgcaacaatcaggtcctggaggaaaacatggatgtggagatctggaccaaggagggagaacgcaaaaagctccggcccagatggctggacgctcgcacatattccgaccctcttgccctgcgggagtttaaagagttcgctgccggcagacgctctgttagcggggatctcattctggagatcggaaagctgccccagcatctcacccagcgggcgcaaaatgcccttgacaacctggtgatgctgcacaattccgaacagggcgggagagcttaccggcatgccatggaggagctccctgatacaattgaaaccctgatgcttctggctctcatcgccgtgctgacaggaggcgtcaccctgtttttcctctctggccgcgggcttggaaagacgagcattggcctgctgtgtgttatggcctccagcgtgctcctgtggatggcttctgtggagccccactggatcgcggcctccatcattcttgaatttttcctgatggtcctcctgatcccggagcctgacagacagcggacaccccaggataaccaactggcttatgtggttattgggctcctttttatgatcctgaccgtggccgccaatgagatgggactgctcgaaaccaccaaaaaggacctgggcattgggcacgtcgctgtggagaaccatcaccatgccgcgatgcttgatgtcgacctgcaccctgccagcgcttggaccctctacgccgtggctacaacgatcattacccccatgatgcgccatacaatcgaaaacaccacagccaatatctctctgaccgcgattgccaaccaggctgccatcctgatgggactcgataaaggctggcctatttccaagatggacatcggcgttccccttctggctctggggtgctacagccaggtgaatccgctcacgctgaccgccgctgtccttatgctggtggcccactatgcgattatcggacctggcctccaagccaaagctacaagagaggcccagaagcggaccgctgccgggatcatgaagaaccccacagttgatggaattgtggccatcgacctggatcccgtcgtgtacgacgcgaaattcgaaaagcagctgggccagattatgctccttatcctgtgtacctctcaaattctgctcatgcgcacgacatgggctctgtgcgagagcatcacccttgccacagggcctctgaccaccctctgggagggatccccgggcaaattttggaatacaacgatcgctgtgtctatggccaacattttcagaggcagctatctggccggggctggactggccttctccctcatgaaaagccttggcgggggacggcgcggcaccggggcgcagggagaaacactgggcgagaaatggaagagacagctgaatcagctctccaagtctgaatttaacacctacaaacggagcggcatcatggaggttgacagatccgaagccaaggaggggctgaaacgcggagagacaaccaagcacgctgtctctcggggcacggccaaacttagatggttcgtggaacgcaatctggtgaagcccgaggggaaggtcattgatctcggatgtggcagagggggatggagctattactgcgctggcctgaaaaaggttacagaagtgaaaggctataccaaagggggacctggccatgaggaacccatccctatggccacctacgggtggaacctggtgaaactccactccggaaaggacgtctttttcattccccctgagaaatgtgatacacttctgtgcgacatcggcgagtctagcccgaatcccaccattgaagaggggagaacactgcgcgtgctcaagatggttgaaccttggctgcggggaaaccaattttgtatcaagatccttaatccctacatgccttccgtggtcgagacgctggagcagatgcagagaaaacatggcggcatgctcgtgcgcaaccccctgagcagaaattctacccacgaaatgtattgggtttcctgcgggacaggaaacattgtgagcgcggtcaatatgacctctagaatgctgctcaaccgcttcacaatggcccaccggaagccgacctacgagagagatgtggacctgggcgctgggacgcgccatgtggccgtcgaacctgaggttgctaaccttgatatcattggacagagaatcgaaaatattaaacacgagcataagtccacctggcactatgacgaggataacccctacaaaacatgggcctatcatggcagctacgaagtgaagccctctgggtccgctagctccatggtgaatggagtcgtgaagctgctcaccaaaccttgggacgttatccccatggtgacacaaatcgccatgaccgatacaaccccttttggccagcagcgggtcttcaaggagaaagtggacacgcgcacaccgaaggcgaaaagaggcaccacccaaattatggaagttacagcccggtggctgtgggggtttcttagcagaaacaagaagccccggatctgtacgcgcgaggagttcaccagaaaagtgcggtctaatgctgccattggagctgtctttgtggacgagaaccagtggaatagcgccaaggaggccgttgaagatgagcgcttctgggacctggtgcacagagaacgggagctccacaaacagggcaagtgcgcgacatgcgtctataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgtggagggggagggactgcacaaactcggctacattctgagagacatctctaagatccctgggggaaatatgtatgccgatgacaccgctggctgggatacacggattaccgaagacgatcttcagaacgaggccaaaatcacagacattatggaacccgagcatgcgctgctcgccaaggctatctttaaactgacctaccaaaataaggtcgtgcgcgttcagagacctgccaagaacgggacggtgatggatgtcattagccggcgcgaccagagaggctccggacaggtgggcacctatgggctgaatacattcaccaacatggaagctcaactcatccggcagatggagtctgagggaatctttagcccctccgaactggagacaccgaaccttgccgaaagagtgctggattggctcgagaaatacggcgttgaacgcctgaagcggatggcgattagcggggacgactgtgtggtcaaacctatcgatgacagattcgccaccgctcttacggccctgaatgatatgggaaaggtgcgcaaagacattccccagtgggagccttctaagggctggaacgattggcagcaagttcccttttgctcccaccacttccatcagctcatcatgaaggacgggcgggagattgtggtcccttgtagaaatcaggatgaactggtgggccgcgctcgggtcagccagggagccggctggtctctgagagagacagcttgcctcgggaaatcctatgcccaaatgtggcagctgatgtactttcaccgccgggaccttagactggcggccaacgctatctgtagcgccgtgcccgttgattgggtgccgacctcccgcacaacctggtctattcatgcccaccatcagtggatgacgaccgaagacatgctcagcgtctggaatcgggtgtggatcgaggaaaacccttggatggaggataagacacacatctccagctgggaggacgttccctatctgggaaaaagagaagaccaatggtgcggctctcttattgggctgaccgctcgggccacatgggcgaccaatatccaggtggctattaaccaggtcagacgcctcatcggaaatgagaactacctggattacatgacatccatgaagcggttcaaaaatgaaagcgaccccgagggcgccctgtggtga

SEQ ID NO: 19391 - RNA, 9879 nt, synthetic construct
  misc_feature 1..9879: note = derived and/or modified CDS sequence (opt5) from DENV-1__KP406803__SS-prME
  source 1..9879: mol_type = other RNA
agcgtgaccatgctgcttatgctgcttcccaccgccctggctttccacctcacgaccagaggcggggaacctcatatgatcgtgtccaagcaggaacggggaaagtctctgctttttaagacaagcgccggcgttaacatgtgcaccctgattgcgatggacctcggggagctgtgtgaagatacaatgacctacaagtgcccccgcatcacagagaccgaacccgacgatgtggactgttggtgcaatgctacggagacctgggtgacatatggaacctgttcccaaacaggcgagcacagacgggataagcgctctgtcgccctggcccctcatgtggggctcggactggaaaccagaacggagacatggatgagctccgaaggcgcttggcggcagattcagaaagttgagacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggaaccgggactttgttgagggactctccggcgctacgtgggtggatgtcgtgctggaacacgggagctgtgtgaccacaatggccaaggacaaacccaccctggatatcgagctcctgaagacagaagtcaccaatcctgctgttcttcgcaaactgtgcattgaggccaagatctctaacacgacaaccgactccagatgtccgacccaaggagaagcgacactcgtggaggagcaggataccaatttcgtgtgccggcgcacatttgtcgacagaggctggggcaacgggtgtggactgttcggcaaagggagccttattacgtgcgccaagtttaagtgcgtgaccaaactggaaggaaagatcgttcagtacgagaatctcaaatattctgtgatcgtcacagtgcacaccggcgatcagcatcaagttgggaacgaaacaaccgagcacggaacgaccgctacaattacaccccaggcccctacatccgaaatccagctgaccgactacggcgctctgacgctcgactgtagcccccggacaggcctggatttcaatgagatggtgcttctgaccatgaaggagaaatcttggctcgtccataagcagtggtttctggaccttcctctgccctggacatccggggccagcacctcccaagaaacctggaaccgccaggatctcctggtgacattcaaaacggcccacgctaagaagcaggaggtcgtggttctgggatctcaagaaggcgcgatgcacaccgccctcacaggggctaccgagattcagacaagcggaaccacgacaatctttgccggccatctgaaatgcagacttaagatggacaaactgaccctcaagggggtgtcctatgtcatgtgtaccggcagcttcaaactggaaaaggaggtggccgagacacagcacggaaccgttctggtgcaggtcaagtacgaaggcacagatgctccgtgcaaaattcctttctcttcccaagacgagaagggggtgacgcagaatggacggcttatcaccgccaaccccatcgtgacagataaagaaaagcctgttaatattgaggcggagccgccctttggcgaaagctatctcgtcgtgggggctggagagaaagccctgaagctgtcttggttcaagaaaggcagctccatcgggaagatgtttgaagccaccgctagaggcgcccgccggatggctattctcggagacacagcctgggatttcggctctatcgggggagtgtttaccagcgtcggcaaactgattcatcagatcttcgggacggcgtacggagtgctcttttccggcgttagctggaccatgaagatcgggattggcatcctgctcacatggctgggactgaactctagatccaccagcctttctatgacatgtattgccgtgggcatggtcaccctctacctgggggtgatggttcaggctgactccggatgcgtgatcaattggaaaggccgcgagctgaagtgtgggagcggaattttcgtcacaaacgaagtgcacacctggacggagcaatataagtttcaggccgattcccctaaacggctctctgctgccatcggcaaggcgtgggaggaaggggtttgcggcattagaagcgccacacgcctggagaacatcatgtggaaacagatctccaatgaacttaaccatattctgctcgagaatgacatgaagttcaccgtggtcgtgggagacgtgaacggcatcctggctcaggggaaaaagatgattcggccgcaacccatggaacacaaatactcttggaaaagctggggaaaggccaaagtcatcggcgctgatgttcagaatattacctttatcatcgacgggcctaacacacccgagtgtcctgatgaccagagagcctggaatatttgggaggtggaagattatggattcggcatctttaccacgaacatttggctgaaacttcgcgactcctacacacaggtgtgcgatcaccggctcatgagcgccgctatcaaagactctaaggcggtccatgccgatatgggctattggattgagtccgagaagaatgagacctggaagctgacaagagctagcttcatcgaagtgaagacctgtgtttggcccaaatctcacacactgtggtccaacggggtgctcgagagcgagatgatcattccgaagatctacggaggccctatttctcaacataattatcgccccgggtacttcacccagacggccggaccttggcacctgggcaaacttgaactggactttgggctctgcgagggaaccacagtcgtggttgatgaacactgcggcaaccggggccccagcctgagaaccacaaccgtgacggggaagatcattcatgagtggtgttgccggtcctgtacactgcctccccttcgcttcaaaggagaggacggctgctggtacgggatggaaatcagaccggtcaaggagaaggaagagaatctcgtgaaaagcatggtttctgccggatccggcgaagtggatagcttttccctggggctgctctgtatctctattatgatcgaggaggtcatgcggagcagatggtcccgcaagatgctgatgaccggaacacttgctgtgttcctgctcctgattatgggccagctgacctggaacgaccttatccggctgtgcattatggtgggcgccaatgcgtctgacaaaatggggatgggaaccacatatctcgctctgatggccacgtttagaatgcgccctatgttcgccgtcggcctcctgtttagacggcttaccagccgcgaagttctgctcctgacagtggggctgtcccttgtggcttctgtcgagctgcccaacagcctcgaagaactgggagatggcctcgccatggggatcatgatgctgaaacttctgaccgacttccaatcccaccagctctgggcggctctgctgagccttacatttgtgaaaaccacgttctctctgcattacgcctggaagacaatggccatgattctctccatcgttagcctgtttcccctctgtctgtctaccacctcccagaagacaacctggcttcctgtgctgctgggaagcctcggctgcaaaccgctgacaatgttccttatcacggaaaacaagatttggggcagaaaatcttggcccctgaatgaggggatcatggctgtcggaattgtgtccatcctcctgagctccctcctgaagaacgatgttcctcttgccggccccctgattgctgggggaatgctgatcgcctgttatgtgatcagcggctctagcgcggacctctccctggagaaagccgctgaagtctcttgggaggaagaggccgaacacagcggggcttcccataatattcttgtggaggtccaggatgacggaaccatgaagatcaaagatgaggaacgggacgatacactgaccattctcctgaaggccacactcctggccatctctggcgtgtaccctatgagcattcccgctaccctttttgtttggtatttctggcaaaagaaaaagcagcgctccggcgtgctgtgggacacgccttctcccccggaggtcgaaagagcggtgctggatgacgggatctaccggatcctccagcgcggactgcttggcaaaagccaggttggggtgggagtcttccaagagggcgtgtttcacaccatgtggcacgtgacaagaggggccgttctgatgtatcagggaaagcggctcgagccttcctgggctagcgtcaaaaaggatctgatttcttacggcggcgggtggcgcttccagggatcctggaacaccggcgaagaggtccaggtgatcgccgtcgaacccgggaagaatcctaaaaacgtgcaaacagcccccggaacctttaagacaccggagggcgaagttggggctattgccctcgacttcaaacctggaacgagcggctctcccatcgtgaatagagagggcaagattgtcgggctgtacggaaacggcgtggttaccacatccgggacctatgtgagcgcgatcgctcaggccaaagcctcccaggagggacctcttcccgaaattgaggacgaagtctttcggaagagaaatctgaccatcatggatctgcatcccggctctgggaagacacgccggtacctccctgctatcgtgagagaggccattaaacgcaagctgcggacgcttgttctggcgccgaccagagtggtcgctagcgaaatggccgaggccctcaaaggcatccccattcgctatcaaacaaccgctgtgaagtccgagcacacaggaaaagaaatcgtggacctgatgtgccatgccaccttcacgatgcggctgctcagccctgtcagagttcccaactacaatatgattatcatggatgaggctcactttacagaccctgcctctatcgcggcccgcggctatatttccacccgggtggggatgggagaagctgccgctatcttcatgaccgccacaccccctggcagcatggaggcctttccgcagtctaacgctgcgattcaggatgaagagagagacatccccgagcggagctggaactccgggtacgattggattaccgacttccctggaaagacagtgtggtttgtcccctctatcaagagcggcaacgatatcgccaattgtcttcgcaaaaacgggaagagagtggttcagctgtcccggaaaaccttcgacacggaatatcaaaagaccaagaataatgattgggactacgtggtcaccacagacatttctgagatgggcgctaacttccgcgccgatagagtgatcgaccctcggagatgcctgaagcccgttattctcaaggatggaccggaacgcgtgatcctggccggccctatgcccgtcaccgtggctagcgccgcgcagcggagagggcgcattggacggaatcagaacaaagagggcgaccagtacatctatatggggcaaccccttaataacgatgaggaccatgctcactggacggaagccaagatgctgctcgataatattaacacccctgagggaatcatccccgccctgtttgaacctgagagagaaaaatccgctgccattgacggcgagtaccgcctgagaggggaagcgcggaagacattcgtcgaactcatgcgcagaggcgatcttccggtgtggctgagctataaagttgcctctgagggatttcagtactccgaccggcgctggtgcttcgatggcgaaagaaataaccaggtgctggaggaaaatatggacgtggagatctggaccaaggagggggaacggaaaaagctccgccccagatggctggatgctcggacatatagcgaccctcttgccctgagagagtttaaggagttcgctgccggacgccggtccgtctctggcgacctcattctggagatcgggaaactgccccagcacctcacccaaagagctcagaacgcccttgataatctggttatgctgcataacagcgaacagggaggcaaggcgtaccgccacgccatggaggagctccctgacacaattgaaaccctgatgcttctggctctcatcgccgtgctgacgggcggggtgacactgtttttcctctccggacggggccttgggaaaacctctatcggactgctgtgtgtcatggctagctccgccctcctgtggatggccagcgtggagccccattggattgctgcgtctatcattcttgaatttttcctgatggttctcctgatcccggagcctgatagacagcggacaccccaagacaatcagctggcctatgtggtcattggcctcctttttatgatcctgacagtggctgccaacgagatggggctgctcgaaaccacaaagaaagatctgggaatcggccacgtcgccgctgagtcccaccatcacgccgcgatgcttgacgtggatctgcatcctgccagcgcttggacgctctacgccgttgctaccacaattatcacccccatgatgcgccacacaattgaaaacaccacggccaatatctctctgaccgcgattgccaaccaggctgccatcctgatgggcctcgacaaggggtggcctatttccaagatggatatcggagtgccccttctggctctgggctgctacagccaagtcaatccgctcacactgaccgccgctgtgcttatgctggttgcccattatgcgatcattgggcctggactccaggccaaagctacaagagaggcccagaagcggaccgctgccggcatcatgaaaaaccccacggtggacgggattgtcgccatcgatctggaccccgtggtgtacgatgcgaagttcgaaaaacagctgggacaaattatgctccttatcctgtgtacatctcagatcctgctcatgcgcaccacatgggctctgtgcgagagcattacccttgccaccggccctctgacaacgctctgggagggctccccggggaagttttggaataccacaatcgctgtttctatggccaacattttcagaggaagctatctggccggcgctgggctggccttctccctcatgaaaagccttggaggcgggcggcgcggaaccggcgcgcagggcgaaacactgggggagaaatggaagagacagctgaatcaactctccaaatctgaatttaacacctacaagcggagcggaatcattgaggtcgaccgctccgaagccaaagagggcctgaagagaggggagacgacaaagcacgctgtgtctcggggaaccgccaaacttagatggttcgtggaacgcaatctggtcaagcccgagggcaaagttatcgacctcgggtgtggacggggcggctggagctattactgcgctgggctgaagaaagtgaccgaagtgaagggatatacaaaaggcgggcctggacacgaggaacccatccctatggccacctacggctggaacctggtcaagctctactccgggaaggatgtgtttttcacaccccctgagaaatgtgacacgcttctgtgcgatattggagagtctagcccgaatcccaccatcgaagagggcagaacactgcgcgttctccggatggtggaaccttggctgagaggcaaccagttttgtattaaggtccttaatccctatatgccttccgtggttgagaccctggagcagatgcagcgcaaacatgggggaatgctcgtgcggaaccccctgagcagaaattctacacacgaaatgtactgggtctcctgcggcaccgggaacatcgtgagcgcggtgaatatgacgtctcgcatgctgctcaaccggttcaccatggcccatagaaagccgacatatgagcgcgacgtcgatctgggagctggcacccggcacgttgccgtggaacctgaggtggctaaccttgacattatcgggcaaagaattgaaaatatcaaaaacgagcacaagtccacatggcattacgatgaggacaatccctataagacctgggcctaccacggaagctatgaagtcaaaccctctggctccgctagctccatggtgaacggcgttgtgcgcctgctcacaaagccttgggatgtcatccccatggtgacccagattgccatgacggacacaaccccttttgggcagcaaagagttttcaaagagaaggtggatacccggacaccgaaagcgaagcgcggaacggcccagatcatggaagtcaccgctagatggctgtggggctttcttagccggaataagaaacccagaatttgtacacgggaggagttcacccgcaaggtgagatctaacgccgctatcggggccgtttttgtggacgagaatcagtggaacagcgccaaagaggcggtcgaagacgagcggttctgggatctggtgcatcgcgaaagagagctccacaagcagggaaaatgcgctacatgcgtctacaatatgatgggcaagcgggaaaagaaactgggggagtttggcaaggccaaaggatcccgcgccatttggtacatgtggctgggcgctagattcctcgagttcgaagccctggggtttatgaacgaggaccattggttctctcgggaaaatagcctttccggagtggagggcgaggggctgcacaagctcggatatatcctgcgcgatatctctaaaattcctggcgggaacatgtacgctgacgataccgccggctgggacacaagaatcaccgaagatgaccttcaaaatgaggcgaagattacggatatcatggaacccgagcacgccctgctcgctaccagcatttttaaactgacatatcagaacaaggttgtgcgggtccagcgccctgccaagaatggaaccgtgatggacgtgatctccagacgggatcagcgcggctctgggcaagttggaacatacggcctgaacaccttcacgaacatggaagctcagctcatcagacagatggagagcgaggggatttttctgccctccgaacttgagacaccgaatctggccgaacgggtgctcgactggctggagaaatatggaatcgaaagacttaagcgcatggcgattagcggcgatgactgtgtcgtgaaacctatcgacgatcggttcgccaccgctctgacagccctcaacgacatggggaaggttagaaaagatattccccagtgggagccttctaagggctggaatgactggcaacaggtgcccttttgctcccatcacttccatcagctgatcatgaaggatggacgcgagatcgtcgtgccttgtcggaaccaggacgaactggtcggcagagctcgcgtgagccaaggggccggatggtctctccgggagaccgcttgcctgggcaaatcctacgcccagatgtggcagcttatgtattttcacagacgcgatctgcggctcgcggccaatgctatttgtagcgccgttcccgtggactgggtcccgacgtccagaaccacatggtctatccacgcccatcaccaatggatgaccacagaagatatgctgagcgtgtggaaccgcgtttggattgaggaaaatccttggatggaggacaagacccatgtgtccagctgggaggatgtcccctaccttgggaaacgggaagaccagtggtgcggatctctgatcggcctcacagctagagccacctgggcgacgaacattcaggtggctatcaatcaggtgcggagactgattgggaacgagaattacctggactatatgacatccatgaagcgcttcaaaaacgaaagcgatcccgagggcgccctctggtga

SEQ ID NO: 19392 - RNA, 9879 nt, synthetic construct
  misc_feature 1..9879: note = derived and/or modified CDS sequence (opt5) from DENV-1__KJ438293__SS-prME
  source 1..9879: mol_type = other RNA
agcgtgacaatgctgctgatgctgatgcccacagcccttgctttccacctgacgaccagaggcggggagcctcatatgatcgtgtccaagcaggaacggggaaaatctctcctgtttaagacaagcgccggcgttaacatgtgcacccttatcgcgatggacctgggggagctctgtgaagatacaatgacctacaaatgccccagaatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaggaacaggacgctaacttcgtgtgccggcgcacatttgtggatagaggctggggcaatgggtgtggactcttcggcaaagggtctctgatgacctgcgccaagtttaagtgcgtcacaaaacttgagggaaagatcgtgcagtacgaaaacctgaaatattccgttatcgtgacggtccacaccggcgaccagcatcaagtggggaatgagagcacagaacacggaaccacagctaccattacgccccaggcccctaccacagagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagatttcttggttcaagaaaggcagctccatcgggaagatgtttgaggccacagctagaggcgcccgccggatggcgatcctcggagataccgcctgggacttcggctctattgggggagtgtttacaagcgttggcaaactggtccatcagatcttcgggaccgcttacggagtgctgttttccggcgtgagctggacgatgaagattgggatcggcgtcctcctgacctggcttggactcaattctagatccacaagcctctctatgacctgtattgccgtgggcctggttacactgtaccttggggtgatggtccaggctgattccggatgcgtgatcaactggaaaggccgcgaactcaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctggaaaacattatgtggaaacagatctccaacgagctcaatcatattctgcttgaaaacgacatgaagttcacagtggttgtgggagatgtcgctggcatcctggcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctcaagctgcgcgattcctatacacaggtctgcgaccaccggctgatgagcgccgctatcaaagattctaaggccgttcacgccgacatgggctactggatcgaatccgagaaaaatgaaacctggaaacttgctagagccagcttcattgaggtgaagacatgtatctggcccaaatctcataccctctggtccaacggggtgctggaaagcgagatgattatcccgaagatttatggaggccctatctctcaacacaattaccgccccgggtacttcacacagaccgcgggaccttggcatctgggcaaactcgagctggattttgacctttgcgaagggacgaccgtcgtggttgatgagcactgcggaaaccggggccccagcctgagaacaaccacagtgaccggcaagatcattcacgaatggtgttgccggtcctgtacgctccctcccctgcgcttcagaggggaggacggatgctggtatggcatggagatccggccggtcaaagaaaaggaggaaaatctggtcaagagcatggtttctgctgggtccggagaggtggacagcttttcccttggcctcctgtgtatttctatcatgattgaagaggtcatgagaagccgctggtcccggaaaatgctgatgacagggaccctcgccgtgttctttctgcttatcatgggacagctgacatggaacgatctcattagactgtgcatcatggttggcgccaatgcttctgaccgcatgggcatggggaccacctacctggcccttatggcgacattcaagatgagacctatgtttgctgtgggactgctgttccggcgcctgacgagcagagaggtcctcctgcttaccatcggcctgtccctcgtggcctctgtggaactgcccaacagcctggaggaacttggggatggactggccatgggcattatgatcctcaaactgctcacagggtttcaatcccatcagctgtgggctacccttctgagcctcacattcattaagaccacgttttctctgcactatgcctggaaaacaatggctatggtcctgtccatcgttagccttttccccctgtgtctctctaccacctcccagaagacaacctggctgcctgtgctcctgggaagccttggctgcaagccgctgacaatgtttctgattacggagaataaaatctggggccggaagtcttggcccctcaacgaagggatcatggccgtgggaattgtctccatcctgcttagctccctgctcaaaaacgacgtgcctctggcgggccccctcattgccgggggaatgctgatcgcttgttacgttattagcggctctagcgccgatctttccctggagaaggctgccgaggtgtcttgggaagaggaagccgagcatagcggggcttcccacaatatcctggtcgaagtgcaggacgatggaaccatgaaaatcaaggacgaggagcgcgatgacacactcaccattctgcttaaagcgacactgctcgccgtttctggcgtgtatcctctgagcatccccgctaccctcttcgtctggtacttctggcaaaagaagaaacagagatccggcgtgctgtgggatacgccttctcccccggaagtcgagcgggccgtgcttgacgatgggatttatcgcatcatgcagagaggactgctgggccggagccaggttggggtgggagtctttcaagaaaacgtgttccataccatgtggcacgttacacgcggcgccgtgctcatgtaccaggggaagagactggagccttcctgggctagcgtcaaaaaggaccttatttcttacggaggcggctggcggctgcaggggtcctggaataccggagaggaagtccaggtgatcgccgttgagcccggcaaaaaccctaagaatgtccaaacagcgcccgggacctttaagacaccggaaggagaggtgggcgctattgccctcgacttcaaacctgggacgagcggatctcccatcgtgaacagagaaggcaagatcgtcggcctgtatgggaatggagtggttaccacatccggcacctacgtgagcgccattgctcaggccaaagcgtcccaggaggggcctctccccgagatcgaagatgaggtctttcgcaagcggaacctgaccattatggaccttcaccccggatctggcaaaacaagacgctatctgcctgctatcgtgcgggaagccattaagagaaagctgcgcacgctcatcctggccccgacccgggttgtggctagcgagatggccgaagctcttaaagggatgcccatcagataccaaacaaccgccgtcaagtccgagcatacaggcaaagagattgtggatctgatgtgccacgcgaccttcacgatgcgcctcctgagccctgttcgggtgcccaattataacatgatcattatggacgaagcccattttacagatccttcttccatcgctgccagaggatacattagcacccgggtcggcatgggggaggctgccgccatcttcatgaccgctacaccccctggatctgtggaagcgtttccgcagagcaatgccgtgatccaggacgaggaacgcgatattcccgagagatcctggaactctggctatgactggatcaccgatttccctgggaagacagtctggtttgttcccagcattaaatccggaaatgacatcgctaactgtctgcggaagaatggcaagcgcgtgattcagctctctagaaaaaccttcgatacggagtaccaaaagaccaagaacaacgactgggactacgtggtcaccacagatatcagcgaaatgggggccaatttccgggccgacagagtgattgatcctcgccggtgccttaagcccgttatcctgaaagacggcccggagagagtggtcctggctggacctatgcccgtgaccgttgcctccgcggctcagcgccggggcagaatcgggcgcaaccacaataaggaaggagatcagtatatttacatgggccagcccctcaacaatgacgaggatcatgcccactggacggaggccaagatgctgcttgacaacatcaatacccctgaagggattatccccgctctgtttgagcctgaacgggagaaaagcgccgcgattgatggagaatatagactccgcggcgaggccagaaagacattcgtggagctgatgcggcgcggggacctgccggtctggctctcttacaaagtggcttccgaaggctttcaatatagcgatagacggtggtgcttcgacggagagcgcaacaatcaggtccttgaagagaacatggatgtggaaatctggaccaaggagggcgagcgcaagaagctgcggcccagatggctggacgcccgcacatactccgaccctctcgctctgcgggaatttaaagagttcgccgctgggagacgctctgttagcggagatcttatcctggaaattggcaagctcccccagcacctgacccagcgggcccaaaatgcgctggacaacctcgtgatgcttcataattccgagcaagggggacgggcctatcggcacgctatggaggaactgcctgatacaatcgagaccctgatgctcctggcccttattgctgtgctgacgggcggcgtcacactctttttcctgtctgggcgcggactgggcaagaccagcatcgggctcctttgtgttatggcctccagcgtgctgctgtggattgcctctgtggaaccccattggatcgctgcgtccatcattctcgagtttttcctgatggtccttctgatcccggaacctgacagacagcggacaccccaggataaccaactcgcctacgtggttattggactgctgtttatgatcctcacagtggctgccaatgagatgggccttctggagaccaccaaaaaggacctggggattggacacgtcgccgtggaaaaccaccatcacgctgccatcctcgatgtcgacctgcatcctgcgagcgcctggacgctttacgctgtggccaccacaattatcacccccatgatgcgccacacaatcgagaacaccacggctaatatttctctgaccgccatcgcgaaccaggccgctattctcatgggcctggataaaggctggcctatctccaagatggacattggggttcccctgctcgcccttggatgctatagccaggtgaatccgctgacactgaccgctgccgtcctcatgctggtggctcattacgccatcatcggccctgggcttcaagcgaaagccacaagagaagctcagaagcggaccgccgctggaattatgaagaaccccacggttgatggcatcgtggccattgacctggatcccgtcgtgtatgacgccaaattcgagaagcagctcgggcagatcatgctgctgattctctgtacatctcaaatccttctgatgcgcaccacatgggcgctgtgcgaaagcatcaccctcgctaccggacctctgacaacgctttgggagggctccccgggcaaattttggaataccacaattgccgtgtctatggctaacatcttcagagggagctacctggccggagccggcctcgctttctccctgatgaaaagcctcgggggaggccggcgcgggaccggagcccagggcgagacactcggcgaaaaatggaagagacagcttaatcagctgtccaagtctgagtttaacacctataaacggagcgggattatggaagttgacagatccgaggcgaaggaaggactgaaacgcggcgagacgacaaagcacgccgtctctcgggggaccgctaaactcagatggttcgtggagcgcaatctggtgaagcccgaaggaaaggtcatcgatcttggctgtgggcggggaggctggagctactattgcgccggcctgaaaaaggttaccgaggtgaaagggtacacaaagggaggccctgggcacgaggaacccattcctatggctacctacggatggaacctcgtgaaactgtattccggcaaggacgtctttttcattccccctgaaaaatgtgatacactgctctgcgacattggggagtctagcccgaatcccacgatcgaggaaggaagaacccttcgcgtgctgaagatggttgagccttggctgcggggcaaccaattttgtatcaagattctcaatccctacatgccttccgtggtcgaaacactggagcagatgcagagaaaacatggcgggatgcttgtgcgcaaccccctgagcagaaattctacccacgagatgtattggatctcctgcggaacaggcaacattgttagcgccgtgaatatgacctctagaatgctcctgaaccgcttcacgatggcgcatcggaagccgacctacgaaagagatgtcgacctgggggccggaacacgccacgtggctgtggagcctgaagtcgccaacctcgatatcattggccagagaatcgagaatatcaaacacgaacataagtccacctggcactatgacgaggataacccctacaaaacatgggcttatcatgggagctacgaggttaagccctctggatccgccagctccatggtgaatggcgtggtcaagctgcttaccaaaccttgggacgtgattcccatggttacacaaatcgctatgaccgatacgacaccttttggccagcagcgggtgttcaaggaaaaagtcgacacccgcaccccgaaggccaaaagagggacagcgcaaattatggaggtgacggcccggtggctgtggggatttctcagcagaaacaagaagccccggatctgtacccgcgaagagttcacaagaaaagttcggtctaatgctgccattggcgctgtgtttgtcgacgaaaaccagtggaatagcgccaaggaggccgtggaggatgaacgcttctgggacctggttcacagagagcgggaacttcataaacaggggaagtgcgcgacctgcgtgtacaacatgatgggaaaacgcgagaagaagctgggcgaatttgggaaagctaagggctccagagccatctggtatatgtggctcggagcccggttcctggagttcgaggctctgggctttatgaatgaagatcactggttctctcgcgagaacagcctctccggggtcgaaggagagggcctgcacaaacttgggtacatcctgagagacatttctaagatccctggaggcaatatgtatgccgatgacacagctgggtgggatacccggattacagaggacgatctccagaacgaagccaaaatcaccgacattatggagcccgaacatgcgctgcttgccaaggctatctttaaactgacgtaccaaaataaggtggtccgcgtgcagagacctgccaagaacggcaccgttatggatgtgatcagccggcgcgaccagagaggatccggccaggtcgggacatatggactcaataccttcacaaacatggaggctcaactgattcggcagatggaatctgagggcatctttagcccctccgagctggaaaccccgaacctcgccgagagagtgctggattggcttgaaaaatacggggtggagcgcctgaagcggatggcgattagcggagacgactgtgttgtgaaacctatcgatgacagattcgccacggctctcacagccctgaatgatatgggcaaggtccgcaaagacattccccagtgggaaccttctaaggggtggaacgattggcagcaagtgcccttttgctcccaccatttccaccagcttatcatgaaggacggccgggagattgttgtgccttgtagaaatcaggatgagctggtcggacgcgctcgggtgagccagggcgccgggtggtctctcagagaaaccgcttgcctgggaaaatcctatgcccaaatgtggcagctgatgtactttcaccgccgggacctcagactggcggccaacgctatctgtagcgccgtccccgtggattgggttccgacatcccgcaccacgtggtctatccatgcccaccatcagtggatgaccacagaggacatgcttagcgtgtggaatcgggtctggattgaagagaacccttggatggaagataagacccacatctccagctgggaggacgtgccctacctgggcaaaagagaggaccaatggtgcgggtctctcattggactgacagctcgggccacctgggcgacaaatatccaggttgctattaaccaggtgagacgccttatcggcaatgaaaactatctggattacatgacctccatgaagcggttcaaaaatgagagcgaccccgaaggggccctctggtga

SEQ ID NO: 19393 - RNA, 9879 nt, synthetic construct
  misc_feature 1..9879: note = derived and/or modified CDS sequence (opt5) from DENV-1__KJ438296__SS-prME
  source 1..9879: mol_type = other RNA
agcgtgaccatgctgctcatgctgatgcccacagctcttgctttccacctgacgaccagaggaggggaacctcatatgatggtgtccaagcaggaacggggaaaatctctcctgtttaagaccagcgccggcgttaacatgtgcacccttatcgcgatggacctgggggaactctgtgaagatacaatgacctacaaatgccccagaattacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagatccagcgggttgaaacatgggctctgcgccaccccggcttcaccgtgattgccctttttctggcgcatgccatcgggacatctattacccagaagggaatcatcttcattctcctgatgcttgtcacccctagcatggctatgagatgcgtgggcatcgggtcccgggattttgttgagggactgagcggcgccacatgggtggacgtcgtgctcgagcacgggtcttgtgtgacgaccatggctaaggataaacccacactggacattgaactgctcaagaccgaggtcacaaaccctgccgttctgcgcaaactttgcatcgaagcgaagatttccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgatcacatgcgccaagtttaagtgcgtgacaaaacttgagggaaagattgttcagtacgaaaacctgaaatattccgtgatcgtcacggtgcacaccggcgaccagcatcaagttgggaatgagagcacagaacacggaaccacagctaccatcacgccccaggcccctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaattcctttctccacccaagatgaaaagggggtgacacagaacggacggctgatcacggctaatcccatcgtcaccgacaaagagaagcctgtgaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgattctgggagataccgcctgggacttcggctctatcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggccaagatcattggcgctgacgtgcagaataccacctttatcatcgatgggcctaacacacccgaatgtcctgacgatcagagagcgtggaatatttgggaggtcgaggactacggattcggcatctttaccacgaacatttggctgaagctgcgcgattcctatacacaggtttgcgaccaccggcttatgagcgccgctatcaaagattctaaggccgtgcacgccgacatgggctactggattgaatccgagaaaaatgaaacctggaagctcgctagagccagcttcatcgaggtgaagacatgtatctggcccaaatctcataccctgtggtccaacggggtcctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtggttgtggatgagcactgcggaaaccggggccccagcctcagaacaaccacagtcaccggcaagattatccacgaatggtgttgccggtcctgtacgctgcctcccctgcgcttcagaggggaggacggatgctggtatggcatggagatccggccggtgaaagaaaaggaggaaaatcttgttaagagcatggtgtctgctgggtccggagaggtcgacagcttttccctcggcctgctgtgtatttctatcatgattgaagaggtgatgagaagccgctggtcccggaaaatgctcatgatcgggacactggccgttttctttcttctgattatgggacagctcacctggaacgatctgatcagactgtgcattatggtgggcgccaatgcttctgaccgcatgggcatggggacaacctaccttgccctgatggcgaccttcaagatgagacctatgtttgctgtcggactcctgttccggcgcctcacaagcagagaggtgctgcttctgacgatcggcctctccctggtggcctctgccgaactgcccaacagccttgaggaactgggggatggactcgctatgggcatcatgattctgaaactcctgaccgactttcaatcccatcagctttgggccacactgctcagcctgaccttcatcaagacaaccttttctctgcactatgcttggaaaacgatggccatggtcctttccattgttagcctgatccccctctgtctgtctacaacctcccagaagaccacatggctccctgtgctgcttgggagcctgggatgcaagccgctgaccatgttcctcattgcggagaataaaatctggggccggaagtcttggcccctgaacgaaggcatcatggccgtggggattgtctccatccttctgagctccctcctgaaaaacgatgtgcctctcgctggacccctgattgccggcgggatgcttatcgcttgttacgttattagcggatctagcgccgacctgtccctggagaaggccgctgaggtgtcttgggaagaggaagcggagcatagcggcgcctcccacaatatcctcgtcgaagtgcaggatgacgggacaatgaaaatcaaggatgaggagcgcgacgatacgctgaccattcttctgaaagctacactcctggccgtttctggagtgtttcctctcagcatccccgccaccctgttcgtctggtatttctggcaaaagaagaaacagagatccggcgtgctttgggacacaccttctcccccggaagtcgagcgggctgtgctggatgacggcatttaccgcatcatgcagagagggctgctcggacggagccaggttggcgtgggggtctttcaagaaaacgtgttccataccatgtggcacgttacgcgcggagccgtgctgatgtatcagggcaagagacttgagccttcctgggcgagcgtcaaaaaggacctgatttcttacgggggaggctggcggctccagggctcctggaataccggggaggaagtccaggtgatcgctgttgagcccggcaagaaccctaagaatgtccaaacagcccccggcacctttaagacaccggaaggggaggtgggagccattgctctggatttcaaacctggcaccagcgggtctcccatcgtgaacagagaaggaaagatcgtcggcctctacggcaatggggtggttacaacgtccggaacctatgtgagcgccattgcgcaggctaaagcctcccaggagggccctctgcccgagatcgaagacgaggtctttcgcaagcggaaccttacaattatggatctgcaccccgggtctggaaaaaccagacgctacctgcctgccatcgtgcgggaagctattaagagaaagctccgcaccctgatccttgccccgacacgggttgtggctagcgagatggccgaagcgctgaaaggcatgcccatcagatatcaaacgaccgccgtcaagtccgagcatacagggaaagagattgtggacctcatgtgccacgctaccttcacaatgcgcctgctgagccctgttcgggtgcccaattacaacatgatcattatggatgaagcccattttaccgacccttcttccatcgctgccagaggctatattagcacgcgggtcggaatgggcgaggccgctgcgatcttcatgacagccacaccccctgggtctgtggaggcttttccgcagagcaatgccgtgatccaggatgaggaacgcgacattcccgagagatcctggaactctggatacgagtggatcaccgatttccctggcaagacagtctggtttgttcccagcattaaatccgggaatgacatcgccaactgtctccggaagaatggaaagcgcgtgattcagctttctagaaaaaccttcgatacagaatatcaaaagaccaaaaacaacgactgggactacgtggtcacgacagatatcagcgagatgggcgctaatttccgggccgacagagtgattgatcctcgccggtgcctgaagcccgttatcctgaaagacgggccggaaagagtgatcctcgcgggccctatgcccgtcaccgtggcttccgccgcccagcgccggggaagaattggccgcaaccacaataaggagggggatcagtacatctatatgggacagcccctgaacaatgacgaggatcatgctcactggacagaagccaagatgcttctggacaacattaatacccctgagggcatcattcccgcgctctttgaacctgagcgggaaaagagcgccgctatcgatggggagtacagactgcgcggagaggccagaaagacgttcgttgagctgatgcggcgcggcgacctcccggtgtggctttcttataaagtcgcttccgaggggtttcaatacagcgatagacggtggtgcttcgacggcgaacgcaacaatcaggtgctggaggaaaacatggatgtcgagatctggaccaaggagggagaacgcaagaagctgcggcccagatggctcgacgcccgcacatattccgaccctctggcccttcgggagtttaaagagttcgccgcgggcagacgctctgtgagcggggatctgattctcgagatcggaaagctgccccagcacctgacccagcgggcccaaaatgctctcgacaaccttgttatgctgcataattccgaacagggcgggagagcctaccggcacgctatggaggagctgcctgatacaattgaaaccctcatgctgcttgccctgatcgccgtgctcacaggaggcgtgaccctgtttttcctgtctggccgcgggctcggaaagacgagcattggccttctgtgtgtcatggcttccagcgttctgctctggatggcgtctgtggagccccattggatcgccgcttccatcattctggaatttttccttatggtgctgctcatcccggagcctgacagacagcggacaccccaggataaccaactggcctatgtcgtgattgggctgctctttatgatccttaccgttgccgctaatgagatgggactgctggaaaccaccaaaaaggacctcggcattgggcacgtggccgtcgagaaccaccatcacgcggccatgctggatgtggaccttcatcctgctagcgcctggaccctgtacgctgtcgccacaacgatcattacccccatgatgcgccacacaatcgaaaacaccacagcgaatatctctctcaccgccattgctaaccaggccgctatcctgatgggactggataaaggctggcctatttccaagatggacatcggcgtgcccctccttgccctggggtgctacagccaggttaatccgctgacgctcaccgctgccgtgctgatgcttgtcgcgcattatgccattatcggacctggcctgcaagctaaagccacaagagaggctcagaagcggaccgccgccgggatcatgaagaaccccacagtggatggaattgttgcgatcgacctcgatcccgtggtctacgacgctaaattcgaaaagcagctgggccagattatgctgctcatcctttgtacctctcaaattctgctgatgcgcacgacatgggccctctgcgagagcatcaccctggctacagggcctcttaccaccctgtgggagggatccccgggcaaattttggaatacaacgatcgccgtgtctatggccaacattttcagaggcagctatctcgctggggccggactggcgttctccctgatgaaaagcctcggcgggggacggcgcggcaccggggcccagggagaaacacttggcgagaaatggaagagacggctgaatcagctgtccaagtctgaatttaacacctacaaaagaagcggcatcatggaggtggaccgctccgaagctaaggaggggctcaaacggggagagacaaccaagcacgccgtttctagaggcacggctaaactgcgctggttcgtcgaacggaatcttgtgaagcccgaggggaaggtgattgatctgggatgtggcagagggggatggagctattactgcgccggcctcaaaaaggtcacagaagttaaaggctataccaaagggggacctggccacgaggaacccatccctatggcgacctacgggtggaacctggtgaaactgcattccggaaaggacgtgtttttcattccccctgagaaatgtgatacactcctttgcgacatcggcgagtctagcccgaatcccaccattgaagaggggcgcacactgcgggtcctgaagatggtggaaccttggctcagaggaaaccagttttgtatcaagatcctgaatccctacatgccttccgttgtggagacgcttgagcaaatgcagcgcaaacacggcggcatgctggtccggaaccccctcagcagaaattctacccatgaaatgtattgggtgtcctgcgggacaggaaacattgttagcgccgtgaatatgacctctcgcatgctgctgaaccggttcacaatggctcacagaaagccgacctacgagcgcgatgtcgacctcggcgccgggacgagacacgtggctgtggaacctgaggtcgccaacctggatatcattggacagcggatcgaaaatattaaacatgagcacaagtccacctggcattatgacgaggataacccctacaaaacatgggcttatcacggcagctacgaagttaagccctctgggtccgccagctccatggtgaatggagtggtcaaacttctgaccaaaccttgggacgtgatccccatggttacacagatcgcgatgaccgatacaaccccttttggccaacagcgcgtgttcaaggagaaagtcgacacgagaacaccgaaggccaaacggggcaccgctcagattatggaagtgaccgccagatggctctgggggtttctgagccggaacaagaagccccgcatctgtacaagagaggagttcacgcggaaagttcgctctaatgctgccattggagccgtgtttatcgacgagaaccaatggaatagcgcgaaggaggctgtcgaagatgagagattctgggaccttgtgcatcgggaacgcgagctgcacaaacagggcaagtgcgctacctgcgtttataacatgatggggaaaagagaaaagaagctcggagagtttggcaaagccaaggggtcccgggctatttggtacatgtggctgggcgcccgcttcctggagttcgaagctctcggatttatgaatgaggatcactggttctctagagaaaacagcctgtccggcgtggagggggagggacttcataaactgggctacatcctccgggacatctctaagattcctgggggaaatatgtatgccgatgacacagcgggctgggatacccgcatcacagaagacgatctgcagaacgaggccaaaattaccgacatcatggaacccgagcacgcccttctggccaaggctatttttaaactcacataccagaataaggtcgtgagagtccaacggcctgccaagaacgggaccgtgatggatgttatcagccgcagagaccagcggggctccggacaggtgggcacgtatgggctgaataccttcacaaacatggaagcgcagctgatcagacaaatggagtctgagggaatttttagcccctccgaactcgagaccccgaacctggccgaacgcgtccttgattggctgggcaaatacggggtggagcggctcaagagaatggctatcagcggagacgactgtgtggttaaacctattgatgaccgcttcgccacagctctgaccgcccttaatgatatgggcaaggtgcggaaagacatcccccagtgggaaccttctaaggggtggaacgattggcagcaggtccccttttgctcccatcacttccaccaactgattatgaaggacggcagagagatcgtggttccttgtcgcaatcaggatgagctcgtgggacgggctagagtcagccagggcgccgggtggtctctgcgcgaaacggcgtgcctgggaaaatcctatgcccagatgtggcaactcatgtactttcatcggagagacctgcgccttgctgccaacgccatttgtagcgctgtgcccgtcgattgggtgccgacatcccggaccacatggtctatccacgcccatcaccagtggatgaccacggaggacatgctgagcgtttggaatagagtgtggatcgaagagaacccttggatggaagataagacccatatttccaattgggaggacgtcccctatctcggcaaacgggaggaccagtggtgcgggagcctgatcggacttacagcgagagctacctgggccacaaacattcaagtggccatcaatcaggttcgccggctgattggcaacgaaaattacctcgattacatgacctctatgaagagattcaaaaacgagtccgaccccgaaggggctctgtggtga

SEQ ID NO: 19394 - RNA, 9879 nt, synthetic construct
  misc_feature 1..9879: note = derived and/or modified CDS sequence (opt5) from DENV-1__KC692495__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttttggcgggcctatcagccaacataattaccggcccggatatttcacccagacggccggcccttggcacctcgggaagctggaacttgattttgacctgtgcgagggaaccacagtggttgtggatgaacactgcggcaacagaggcccctctctccggaccacaaccgtcacggggaaaattatccatgagtggtgttgccgcagctgtacactgcctcccctgagattccggggagaggacggctgctggtacgggatggaaattagaccggtgaaggagaaagaagagaatcttgttcgctccatggtgagcgcgggatctggcgaagtcgattcctttagcctcgggatcctgtgtgtgtccatcatgattgaggaggttatgcggtctagatggagccgcaagatgctgatgaccggaacactcgctgtgttcctgcttctgatcatgggccagctcacctggaacgacctgattagactgtgcatcatggtcggcgccaatgcctccgaccggatggggatgggaaccacataccttgctctgatggccacgtttaagatgcgccctatgttcgcggtgggcctcctgtttagacggctcacctctcgcgaagtgctgcttctgacaattgggctcagcctggtcgcttccgttgagctgcccaactctcttgaagagctgggagatggcctcgccatggggatcatgatgctgaaactcctgaccgaattccaaccccaccagctttggacaaccctgctcagcctgacgtttgtgaagacaaccctgtcccttgactatgcctggaaaaccacagctatggtgctgagcattgtctctctcttccctctgtgtctctccaccacaagccagaagacgacctggctgccggtgcttctgggatcttttggctgcaaacccctgacaatgttcctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttacgtcatcagcggctccagcgccgacctgtctctggaaaaggctgccgaggtgagctgggaacaggaggctgaacattccggggcctctcacaatattctcgttgaggtgcaagatgacggaacaatgaaaatcaaggatgaggaacgggacgataccctgacgattcttctgaaagccaccctcctggctgtcagcggcgtgtatcccatgtccatccctgcgacactcttcgtctggtacttttggcagaagaaaaagcagcgctctggcgtgctgtgggacacccccagcccgcctgaggttgaaagagccgtgcttgatgacgggatttatcggatcctgcagcgcggactgctcggcagatcccaagtcggggtgggagttttccaggatggcgtgtttcatacaatgtggcacgtcacccggggggctgtgctgatgtaccagggaaagagacttgagccctcttgggccagcgtgaaaaaggacctgatctcctatggcggcgggtggcgcttccagggaagctggaacacaggcgaggaagttcaagtcattgccgtggagcctgggaaaaatcccaagaacgtgcagacgaccccgggaacatttaaaacccctgaaggcgaggtcggggctatcgccctcgacttcaagcccggaacctctggctcccctattgtgaatcgggaaggcaagatcgttgggctgtacggaaacggcgtggtcacaacgagcgggacctacgtgtctgcgattgctcaggccaaagcctcccaagagggacccctccccgagatcgaagatgaggtttttaagaaaagaaatctgacaattatggaccttcaccctggcagcgggaagacccgccggtatctgccggctatcgtgagagaagccatcaaacgcaagctgcggacactcattctggcgcccaccagagtcgtggcttccgagatggccgaagcccttaagggcatgcctatccgctaccagacgacagctgttaaatctgagcataccggacgggagattgtggatctgatgtgccacgccaccttcacaatgagactcctgagccccgtccgggtgcctaactataatatgatcattatggacgaagctcattttaccgatcccgcctccatcgcggcccgcggctacatcagcacaagagtggggatgggagaggctgccgctattttcatgaccgccacgcctccgggctctgtcgaagcctttccccagtccaacgctgttatccaggacgaggaacgggatattcctgagcgcagctggaattctgggtatgactggatcacagatttccccggaaagaccgtgtggttcgtgcctagcattaaatccggcaacgacatcgcgaattgtctgagaaagaacgggaaacgggtcatccaactctctagaaagacatttgataccgagtaccagaagacgaaaaacaatgactgggactatgtggttaccacagatattagcgaaatgggcgccaacttccgcgctgaccgggtgatcgatcccagacgctgccttaagccggtcattctgaaagacggacctgagcgggtgatcctggccggccccatgcccgttaccgtggcctccgctgcccagagacgcgggcggattggaagaaatcagaacaaggaaggcgatcaatacgtctacatggggcagcctctcaataacgacgaggatcacgcgcattggacagaggctaaaatgctgcttgacaatatcaacacccccgaaggaattatccctgccctgtttgagccggaacgcgagaagtctgccgctatcgatggcgaatatagactccggggggaggcccgcaagacattcgtggagctgatgagacggggcgacctgcccgtctggctcagctacaaagtggcgtccgaaggatttcagtatagcgatcgcagatggtgcttcgacggcgagcggaataaccaggttcttgaagagaatatggatgtggaaatttggaccaaggagggggagagaaaaaagctgcgccctcggtggctggacgccagaacgtactctgaccccctcgctctgcgcgaatttaaagagttcgccgctggacggagatccgtgagcggcgatcttatcctggaaattgggaagctccctcaacacctgacactgcgggcccagaacgctctcgacaatcttgtcatgctgcacaactccgagcagggaggcaaagcctatcgccatgcgatggaagagctgcccgataccatcgagaccctcatgctgcttgccctgattgctgttctcacaggcggggtgaccctgtttttcctgtctggaaagggcctcgggaagacaagcatcggacttctgtgtgtgacggcctcctctgctctgctctggatggccagcgtcgaaccgcactggatcgccgcttccattatcctggagtttttccttatggtgctgctcattcctgaacccgacagacagcggacccctcaagataatcagctggcgtacgttgtgatcggcctgctctttatgattcttacagtcgccgctaacgagatggggctgctggagaccacaaaaaaggacctcggaatcggctatgtggccgccgaaaaccatcagcacgctaccatgctggatgtcgaccttcaccccgccagcgcgtggacgctgtacgccgtggctaccacagttatcacccctatgatgcgccatacaattgagaataccacggccaacatctctctcacagctattgccaatcaagcggccatcctgatgggcctggataaagggtggcccatttccaagatggacatcggagtgccgctccttgctctgggctgctacagccaggtcaaccctctgaccctcacagccgctgtgctgatgcttgttgcccactatgctattatcgggcccggactgcaggccaaagcgaccagagaagcccagaagcggaccgctgccggcatcatgaagaatcccacagtggatgggattgtcgctatcgacctcgatcctgtggtgtacgacgccaaattcgagaagcaactgggacagattatgctgctcatcctttgtacgtctcagattctgctgatgcgcaccacatgggccctctgcgaatccatcaccctggcgacaggcccgcttaccacgctgtgggagggcagccccgggaaattctggaacacaaccatcgctgtttctatggccaatatttttagaggaagctatctcgctggcgccgggctggccttctccctgatgaagtctctcggaggcgggcggcgcggaaccggcgctcagggcgagacacttggggaaaaatggaagagacaactgaaccagctgagcaagtccgagtttaatacctacaaacggagcggaatcatggaagtcgacagatccgaggccaaggaaggcctcaaacgcggggagacaacgaagcatgcggtgtctcggggaaccgccaaactgagatggttcgtggagcgcaaccttgtcaagcctgaaggcaaggttattgatctggggtgtggacggggcggctggagctattactgcgctgggctcaaaaaggtgacagaggtgaaaggatataccaagggcgggcccggacacgaagagcctatccccatggccacatacggctggaatctggtcaaactgcattccgggaaggacgtgtttttcatgcctccggaaaaatgtgataccctcctttgcgacattggagagtctagccccaaccctacgatcgaggaaggcagaaccctgcgcgttctgaagatggtggagccctggctccggggcaatcagttttgtatcaagattctgaacccttacatgccctccgtcgtggaaacacttgagcagatgcaaagaaaacacgggggaatgctggttcgcaatccgctctctcggaacagcacccacgagatgtattgggtgtcctgcggcacagggaatatcgtcagcgctgtgaacatgacctctagaatgctgctgaaccgcttcacaatggcccatcggaagcctacctacgaaagagatgtggacctcggagcgggcacgcgccacgtcgccgttgagcccgaagtggctaatctggatattatcgggcagagaattgagaacatcaaaaatgaacataagtccacatggcactatgacgaggataacccctacaaaacctgggcctatcacggaagctacgaggtgaagccttctggctccgctagctctatggtcaatggcgtggttcggcttctgaccaagccctgggacgtgattcctatggtcacacagatcgccatgacggataccacaccgtttgggcaacagcgcgtgttcaaagaaaaggttgacaccagaacaccccgggctaaaagaggaaccacacagatcatggaggtgaccgccaagtggctctggggctttctgtcccggaacaaaaagcctcgcatttgtacgagagaagagttcacccggaaggtccgcagcaatgcggccatcggggctgtgtttgttgacgaaaaccagtggaattccgccaaagaggctgtggaggatgaaagattctgggaccttgtccatcgggagcgcgaactgcacaagcaaggaaaatgcgccacatgcgtgtataacatgatgggcaagagagagaaaaagctcggggaattcggcaaggccaaaggaagccgggcgatttggtacatgtggctgggcgctcgctttctggagttcgaggccctcgggtttatgaatgaagatcattggttctctagagagaacagcctgtccggagtcgaaggcgaggggcttcacaagctgggatacatcctccgggacatttctaaaatccccggcgggaatatgtatgccgatgacaccgctggctgggatacacgcatcaccgaggacgatctgcagaacgaagccaagattacggacatcatggagcctgaacatgctcttctggccacaagcatttttaaactcacctaccagaataaggtggttagagtgcagcggcccgcgaaaaacggaacagtcatggatgtgatctcccgcagagaccaacggggctctgggcaggtgggaacctatggcctgaacacgttcaccaatatggaggttcagctgattagacagatggaaagcgaggggatctttctcccgtccgagctggaaacacctaaccttgccgagcgcgctctggattggctcgaaaagcacggagccgagcggctgaagagaatggctatctctggcgacgactgtgtggtcaaacccattgatgaccgcttcgccaccgcgcttacagccctgaatgatatggggaaggtgcggaaagacatccctcaatgggaacccagcaagggctggaacgattggcagcaggttcctttttgctcccaccatttccaccagctcattatgaaagacggaagagagatcgtggtcccctgtcgcaatcaagatgagctggtgggccgggctagagtcagccagggggccggatggtctctgcgcgaaaccgcttgcctcggcaagtcctacgcccagatgtggcaactgatgtattttcatcggagagaccttcgcctggctgccaacgcgatttgtagcgccgtgccggttgattgggtgcctgcttctcggacaacctggtccatccacgcccaccatcagtggatgacgacagaggacatgctcagcgtctggaatagagtgtggatcgaagagaacccctggatggaagataagacccacgtttcctcttgggaggaggtgccctacctggggaaacgggaagaccagtggtgcggaagccttattggcctgaccgccagagctacatgggccaccaatatccaggtcgcgattaaccaagtgcgccggctcatcgggaatgagaactatctggactacatgacatccatgaagagattcaaaaatgaaagcgatcctgagggcgctctgtggtga

SEQ ID NO: 19395 - RNA, 9879 nt, synthetic construct
  misc_feature 1..9879: note = derived and/or modified CDS sequence (opt5) from DENV-1__KC692496__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcacaaaccctgccgttctgagaaagctttgcattgaggcgaaaatctctaataccacgacagattcccggtgtccgacccaaggagaagccaccctggtggaggagcaggacgctaactttgtgtgccgcagaacattcgtcgatcggggctggggcaatgggtgtggactctttggcaaggggagcctgcttacctgcgccaaattcaagtgcgtgacaaagctggaaggaaaaattgttcagtacgagaacctcaagtattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccgcacaggcctggactttaacgagatggtgcttctgaccatgaaagagaagtcttggctcgtccataaacagtggttcctggatcttcctctgccctggacgtccggggctagcacatcccaagaaacctggaatagacaggacctcctggtgacatttaagaccgcgcacgccaaaaagcaggaggtcgtggttctgggatctcaagaaggcgctatgcacaccgccctcacaggggccacggagattcagaccagcggaacaaccacaatcttcgctggccatctgaagtgccggcttaaaatggataagctgaccctcaaagggatgtcctatgtgatgtgtacgggcagcttcaagctggaaaaagaggtcgccgagacacagcacggaaccgtgctggttcaggtgaagtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatgtgcgaccaccgccttatgtccgcggccattaaagatagcaaggctgtgcatgccgacatggggtattggatcgagtctgaaaaaaatgagacctggaagctcgcccgggcttccttcattgaagtgaaaacatgtacctggcccaagagccacacactgtggtctaacggagtcctggagtccgagatgatcatcccgaagatttttggcgggcctatcagccaacataattacagacccggatatttcacccagacggccggcccttggcacctcgggaaactggaacttgattttgacctgtgcgagggaaccacagtggttgtggatgaacactgcggcaaccggggcccctctctccgcaccacaaccgtcacggggaagattatccatgagtggtgttgcagaagctgtacactgcctcccctgcggttcagaggagaggacggctgctggtacgggatggaaattcgcccggtgaaagagaaggaagagaatcttgttcggtccatggtgagcgcgggatctggcgaagtcgattcctttagcctcgggatcctgtgtgtgtccatcatgattgaggaggttatgagatctcgctggagcagaaaaatgctgatgaccggaacactcgctgtgttcctgcttctgatcatgggccagctcacctggaacgacctgattcggctgtgcatcatggtcggcgccaatgcctccgaccgcatggggatgggaaccacataccttgctctgatggccacgtttaagatgagacctatgttcgcggtgggcctcctgtttcggcgcctcacctctagagaagtgctgcttctgacaattgggctcagcctggtcgcttccgttgagctgcccaactctcttgaagagctgggagatggcctcgccatggggatcatgatgctgaagctcctgaccgaattccaaccccaccagctttggacaaccctgctcagcctgacgtttgtgaaaacaaccctgtcccttgactatgcctggaagaccacagctatggtgctgagcattgtctctctcttccctctgtgtctctccaccacaagccagaaaacgacctggctgccggtgcttctgggatcttttggctgcaagcccctgacaatgttcctcatcaccgagaacaaaatctggggccggaagtcctggcctctgaatgaggggattatggccatcggaattgttagcatccttctgtcttccctcctgaagaacgatgtgcccctcgctggccctctgcttgccgggggaatgctgattgcgtgttacgtcatcagcggctccagcgccgacctgtctctcgaaaaagctgccgaggtgagctgggaacaggaggctgaacattccggggcctctcacaatatcctggttgaggtgcaagatgacggaacaatgaagattaaagatgaggaacgcgacgatacccttacgatcctgctcaaggccaccctgctcgctgtcagcggcgtgtatcccatgtccattcctgcgacactgttcgtctggtacttttggcagaaaaagaaacagagatctggcgtgctttgggacacccccagcccgcctgaggttgaacgggccgtgctggatgacgggatctatcgcattctgcagagaggactcctgggccggtcccaagtcggggtgggagttttccaggatggcgtgtttcatacaatgtggcacgtcaccagaggggctgtgcttatgtaccagggaaagcgcctggagccctcttgggccagcgtgaagaaagacctcatctcctatggcggcgggtggcggttccagggaagctggaacacaggcgaggaagttcaagtcatcgccgtggagcctgggaagaatcccaaaaacgtgcagacgaccccgggaacatttaagacccctgaaggcgaggtcggggctattgccctggacttcaaacccggaacctctggctcccctatcgtgaatagagaaggcaagattgttgggctctacggaaacggcgtggtcacaacgagcgggacctacgtgtctgcgatcgctcaggccaaggcctcccaagagggacccctgcccgagattgaagatgaggtttttaaaaagcgcaatcttacaatcatggacctgcaccctggcagcgggaaaacccggagatatctgccggctattgtgcgcgaagccatcaagcggaaactcagaacactgatccttgcgcccacccgcgtcgtggcttccgagatggccgaagccctgaagggcatgcctattcggtaccagacgacagctgttaagtctgagcataccggaagagagatcgtggatctcatgtgccacgccaccttcacaatgcggctgctgagccccgtccgcgtgcctaactataatatgattatcatggacgaagctcattttaccgatcccgcctccattgcggccagaggctacatcagcacacgggtggggatgggagaggctgccgctatcttcatgaccgccacgcctccgggctctgtcgaagcctttccccagtccaacgctgttattcaggacgaggaacgcgatatccctgagagaagctggaattctgggtatgactggattacagatttccccggaaaaaccgtgtggttcgtgcctagcatcaagtccggcaacgacattgcgaattgtctccggaaaaacgggaagagagtcatccaactttctcgcaaaacatttgataccgagtaccagaagacgaagaacaatgactgggactatgtggttaccacagatatcagcgaaatgggcgccaacttccgggctgacagagtgattgatccccgccggtgcctgaaaccggtcatcctgaaggacggacctgagagagtgattctcgccggccccatgcccgttaccgtggcctccgctgcccagcgccgggggagaatcggacgcaatcagaacaaagaaggcgatcaatacgtctacatggggcagcctctgaataacgacgaggatcacgcgcattggacagaggctaagatgcttctggacaatattaacacccccgaaggaatcattcctgccctctttgagccggaaagagagaaatctgccgctatcgatggcgaatatcggctgcgcggggaggccagaaagacattcgtggagctgatgcggcgcggcgacctccccgtctggcttagctacaaggtggcgtccgaaggatttcagtatagcgatagacggtggtgcttcgacggcgagagaaataaccaggttctggaagagaatatggatgtggaaatctggaccaaagagggggagcgcaagaaactgcggcctagatggctcgacgcccgcacgtactctgaccccctggctcttcgggaatttaaggagttcgccgctggaagacggtccgtgagcggcgatctgattctcgaaatcgggaaactgcctcaacacctgacactccgcgcccagaacgctcttgacaatctggtcatgctgcacaactccgagcagggaggcaaggcctatagacatgcgatggaagagctccccgataccattgagaccctgatgcttctggccctcatcgctgttctgacaggcggggtgaccctgtttttcctctctggaaaaggccttgggaagacaagcattggactgctgtgtgtgacggcctcctctgctctcctgtggatggccagcgtcgaaccgcactggatcgccgcttccatcattcttgagtttttcctgatggtgctcctgatccctgaacccgaccggcagcgcacccctcaagataatcagctggcgtacgttgtgattggcctcctttttatgatcctgacagtcgccgctaacgagatggggctgctcgagaccacaaagaaagacctgggaattggctatgtggccgccgaaaaccatcagcacgctaccatgcttgatgtcgacctgcaccccgccagcgcgtggacgctctacgccgtggctaccacagttatcacccctatgatgagacatacaatcgagaataccacggccaacatttctctgacagctatcgccaatcaagcggccattctgatgggcctcgataaggggtggcccatctccaaaatggacattggagtgccgcttctggctctgggctgctacagccaggtcaaccctctcaccctgacagccgctgtgcttatgctggttgcccactatgctatcattgggcccggactccaggccaaggcgacccgggaagcccagaaacgcaccgctgccggcatcatgaagaatcccacagtggatgggatcgtcgctattgacctggatcctgtggtgtacgacgccaagttcgagaaacaactgggacagatcatgctccttattctgtgtacgtctcagatcctgctcatgagaaccacatgggccctgtgcgaatccattacccttgcgacaggcccgctgaccacgctctgggagggcagccccgggaagttctggaacacaaccatcgctgtttctatggccaatatctttcggggaagctatctggctggcgccgggctggccttctccctcatgaaatctcttggaggcgggcgcagaggaaccggcgctcagggcgagacactgggggaaaagtggaaacggcaactgaaccagctcagcaagtccgagtttaatacctacaagagaagcggaattatggaagtcgaccgctccgaggccaaagaaggcctgaagcggggggagacaacgaaacatgcggtgtctagaggaaccgccaagcttcgctggttcgtggagcggaacctggtcaaacctgaaggcaaggttatcgatctcgggtgtggaagaggcggctggagctattactgcgctgggctgaagaaagtgacagaggtgaagggatataccaaaggcgggcccggacacgaagagcctattcccatggccacatacggctggaatctggtcaagctccattccgggaaagacgtgtttttcatgcctccggaaaagtgtgatacccttctgtgcgacatcggagagtctagccccaaccctacgattgaggaaggccgcaccctgcgggttctcaaaatggtggagccctggctgagaggcaatcagttttgtatcaagatccttaacccttacatgccctccgtcgtggaaacactggagcagatgcaacgcaagcacgggggaatgctcgttcggaatccgctgtctagaaacagcacccacgagatgtattgggtgtcctgcggcacagggaatattgtcagcgctgtgaacatgacctctcgcatgctgctcaaccggttcacaatggcccatagaaaacctacctacgaacgcgatgtggacctgggagcgggcacgagacacgtcgccgttgagcccgaagtggctaatcttgatatcattgggcagcggatcgagaacattaagaatgaacataaatccacatggcactatgacgaggataacccctacaagacctgggcctatcacggaagctacgaggtgaaaccttctggctccgctagctctatggtcaatggcgtggttcgcctgctcaccaagccctgggacgtgatccctatggtcacacagattgccatgacggataccacaccgtttgggcaacagagagtgttcaaggaaaaagttgacacccggacacccagagctaagcggggaaccacacagatcatggaggtgaccgccaaatggctgtggggctttctttcccgcaacaagaaacctagaatctgtacgcgggaagagttcacccgcaaggtcagaagcaatgcggccattggggctgtgtttgttgacgaaaaccagtggaattccgccaaggaggctgtggaggatgaacggttctgggacctggtccatcgcgagagagaactccacaaacaaggaaagtgcgccacatgcgtgtataacatgatgggcaaacgggagaagaaactgggggaattcggcaaggccaagggaagccgcgcgatctggtacatgtggctgggcgctagatttctcgagttcgaggccctggggtttatgaatgaagatcattggttctctcgggagaacagcctttccggagtcgaaggcgaggggctgcacaaactcggatacattctgcgcgacatctctaagattcccggcgggaatatgtatgccgatgacaccgctggctgggatacaagaatcaccgaggacgatcttcagaacgaagccaaaatcacggacattatggagcctgaacatgctctgctcgccacaagcatctttaagctgacctaccagaataaagtggttcgggtgcagcgccccgcgaagaacggaacagtcatggatgtgatttccagacgggaccaaagaggctctgggcaggtgggaacctatggcctgaacacgttcaccaatatggaggttcagctcatccgccagatggaaagcgaggggatttttctgccgtccgagcttgaaacacctaacctggccgagcgggctctcgattggctggaaaaacacggagccgagagacttaagcgcatggctatctctggcgacgactgtgtggtcaagcccatcgatgaccggttcgccaccgcgctgacagccctcaatgatatggggaaagtgagaaaggacattcctcaatgggaacccagcaaaggctggaacgattggcagcaggttcctttttgctcccaccatttccaccagctgatcatgaaggacggacgcgagattgtggtcccctgtcggaatcaagatgagctggtgggcagagctcgcgtcagccagggggccggatggtctctccgggaaaccgcttgcctgggcaaatcctacgcccagatgtggcaacttatgtattttcatagacgcgacctgcggctcgctgccaacgcgatctgtagcgccgtgccggttgattgggtgcctgcttctagaacaacctggtccattcacgcccaccatcagtggatgacgacagaggacatgctgagcgtctggaatcgggtgtggatcgaagagaacccctggatggaagataagacccacgtttcctcttgggaggaggtgccctaccttgggaagagagaagaccagtggtgcggaagcctgatcggcctcaccgcccgcgctacatgggccaccaatattcaggtcgcgatcaaccaagtgcggagactgattgggaatgagaactatctggactacatgacatccatgaaacgcttcaagaatgaaagcgatcctgagggcgctctctggtga

SEQ ID NO: 19396 - RNA, 9879 nt, synthetic construct
  misc_feature 1..9879: note = derived and/or modified CDS sequence (opt5) from DENV-1__KC692497__SS-prME
  source 1..9879: mol_type = other RNA
agcgtgaccatgctgctcatgctgcttcccaccgctctggctttccacctcacgacccggggcggggagcctcatatgatcgtctccaagcaggaacggggaaaatctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcaccggcgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaatcgggactttgttgagggactctccggcgccacatgggtggatgtcgtgctggaacacgggagctgtgtgacgaccatggctaagaataaacccacactggacatcgagctcctgaagaccgaagtcacaaaccctgccgttcttcgcaaactgtgcattgaggcgaagatctctaataccacgacagattccagatgtccgacccaaggagaagccaccctcgtggaggagcaggacgctaacttcgtgtgccggcgcacatttgtcgatagaggctggggcaatgggtgtggactgttcggcaaagggagccttctgacctgcgccaagtttaagtgcgtgacaaaactcgaaggaaagattgttcagtacgagaacctgaaatattctgtgatcgtcacggtgcacaccggcgaccagcatcaagttgggaatgaaacaaccgagcacggaacaatcgctaccattacgccccaggcccctacctccgaaatccagctgacagattacggcgccctcaccctggactgtagcccccggacaggccttgacttcaacgagatggtgctgctcaccatgaaggagaaatcttggctggtccataagcagtggtttcttgatctgcctctcccctggacgtccggggctagcacatcccaagaaacctggaatcgccaggacctgctggtgacattcaaaaccgcgcacgccaagaagcaggaggtcgtggttctcggatctcaagaaggcgctatgcacaccgccctgacaggggccacggagattcagaccagcggaacaaccacaatctttgctggccatcttaaatgcagactgaagatggataaactcaccctgaaggggatgtcctatgtgatgtgtacgggcagcttcaaactggaaaaggaggtcgccgagacacagcacggaaccgtgcttgttcaggtgaagtacgaaggcaccgacgcgccgtgcaaaattcctttctctacacaagatgagaagggggtcacccagaacggacggctcatcacagctaatcccatcgtgacggacaaagaaaagcctgtgaacattgagaccgagccgccctttggcgaatcctatatcgttgtcggggccggagagaaagccctgaagctgagctggttcaagagaggctctagcattgggaaaatgtttgaagctacagcccgcggcgctcggagaatggccatcctcggagataccgcgtgggacttcggctccattgggggagtgtttacatctgtgggcaagctggtccatcaggtgttcgggaccgcctacggagttctttttagcggcgtgtcctggacgatgaaaatcgggatcggcattctgctcacctggctgggactgaatagccgctctacatcccttagcatgacctgtatcgctgtcggcatggtgacactctacctgggggttatggtgcaggccgattctggatgcgtcattaactggaagggccgggagctgaaatgtgggtccggaatcttcgtgaccaacgaagttcacacatggaccgagcaatataagtttcaggctgacagccctaagagactctccgccgcgattggcaaagcctgggaggaaggggtgtgcggcatccgctctgctacgcggctggagaatattatgtggaagcagatcagcaacgaacttaatcatatcctgctcgagaacgatatgaaattcacagtcgtggtgggagacgccaatggcattctggctcaggggaagaaaatgatcagaccgcaacccatggaacacaagtactcctggaaatcttggggaaaggccaagattatcggcgccgacattcagaacaccacctttatcatcgatgggcctgacacacccgagtgtcctgatggacagcgcgcttggaatatttgggaggtcgaagactatggcttcggcgtttttaccacgaacatctggctgaaacttcgggatagctacacacagatgtgcgaccacagactcatgtccgcggccattaaggatagcaaagctgtgcatgccgacatggggtattggatcgagtctgaaaagaatgagacctggaaactggcccgcgcttccttcattgaagtgaagacatgtacctggcccaagagccacacactgtggtctaacggagtcctcgagtccgagatgatcatcccgaaaattttcggcgggcctatcagccaacataattaccggcccggatattttacccagacggccggcccttggcacctggggaaacttgaactggatttcgacctctgcgagggaaccacagtggttgtggatgaacactgcggcaacagaggcccctctctgcggaccacaaccgtcacggggaaaattatccatgagtggtgttgccgcagctgtacactgcctccccttagatttcggggagaggacggctgctggtacgggatggaaattagaccggtgaaggagaaagaagagaatctcgttcgctccatggtgagcgcgggatctggcgaagtcgattccttcagcctggggatcctgtgtgtgtccatcatgattgaggaggttatgcggtctagatggagccgcaagatgctcatgaccggaacactggctgtgtttcttctgctcatcatgggccagctgacctggaacgacctgattagactttgcatcatggtcggcgccaatgcctccgaccggatggggaccggaacaacgtacctggctctcatggccaccttcaagatgcgccctatgtttgcggtgggcctcctgttcagacggctgacatctcgcgaagtgcttctgctcaccattgggctgagcctggtcgcttccgttgagcttcccaactctctggaagaactcggagatggcctggccatggggatcatgatgctcaaactgcttacagaatttcaaccccaccagctgtggaccacgctcctgagcctgacattcgtgaagaccaccctttccctggactatgcctggaaaacaaccgctatggtgctcagcattgtctctctgtttcctctctgtctgtccacaacgagccagaagaccacatggcttccggtgctgctgggatctttcggctgcaaacccctcaccatgtttctgatcacagagaacaagatctggggcagaaagtcctggcctcttaatgaggggattatggccatcggaattgttagcatcctgctctcttccctgctcaaaaacgatgtgcccctggctggccctcttattgccgggggaatgctgatcgcgtgttacgtcatcagcggctccagcgccgacctgtctctcgaaaaggctgccgaggtgagctgggaacaggaggctgaacattccggggcctctcacaatattctggttgaggtgcaagatgacggaaccatgaaaatcaaggatgaggaacgggacgatacgcttaccattctgctcaaagccacactgctcgctgtcagcggcgtgtatcccatgtccatccctgcgaccctgttcgtctggtacttctggcagaagaaaaagcagcgctctggcgtgctttgggacacacccagcccgcctgaggttgaaagagccgtgctggatgacgggatttatcggatcctgcagcgcggactcctgggcagatcccaagtcggggtgggagtttttcaggatggcgtgttccataccatgtggcacgtcacaagaggggctgtgcttatgtaccagggaaagagactggagccctcttgggccagcgtgaaaaaggacctcatctcctatggcggcgggtggcgctttcagggaagctggaacacgggcgaggaagttcaagtcattgccgtggagcctgggaaaaatcccaagaacgtgcagaccacaccgggaaccttcaaaacccctgaaggcgaggtcggggctatcgccctggactttaagcccggaacatctggctcccctattgtgaatcgggaaggcaagatcgttgggctctacggaaacggcgtggtcacgaccagcgggacatacgtgtctgcgattgctcaggccaaagcctcccaagagggacccctgcccgagatcgaagatgaggttttcaagaaaagaaatcttaccattatggacctgcaccctggcagcgggaagacacgccggtatctgccggctatcgtgagagaagccatcaaacgcaagctccggaccctgattcttgcgcccacgagagtcgtggcttccgagatggccgaagccctgaagggcatgcctatccgctaccagacaaccgctgttaaatctgagcataccggacgggagattgtggatctcatgtgccacgccacatttaccatgagactgctgagccccgtccgggtgcctaactataatatgatcattatggacgaagctcatttcacagatcccgcctccatcgcggcccgcggctacatcagcaccagagtggggatgggagaggctgccgctatttttatgacggccacacctccgggctctgtcgaagccttcccccagtccaacgctgttatccaggacgaggaacgggatattcctgagcgcagctggaactctgggtatgactggatcaccgattttcccggaaagacagtgtggttcgtgcctagcattaaatccggcaacgacatcgcgaattgtctcagaaagaacgggaaacgggtcatccaactttctagaaagaccttcgatacggagtaccagaagaccaaaaacaatgactgggactatgtggttacaaccgatattagcgaaatgggcgccaactttcgcgctgaccgggtgatcgatcccagacgctgcctgaagccggtcattctgaaagacggacctgagcgggtgatcctcgccggccccatgcccgttacagtggcctccgctgcccagagacgcgggcggattggaagaaatcagaacaaggaaggcgatcaatacgtctacatggggcagcctctgaataacgacgaggatcacgcgcattggaccgaggctaaaatgcttctggacaatatcaacacacccgaaggaattatccctgccctcttcgagccggaacgcgagaagtctgccgctatcgatggcgaatatagactgagaggggaagcccgcaagacctttgtggagctgatgagacggggcgacctccccgtctggcttagctacaaagtggcgtccgaaggattccagtatagcgatcgcagatggtgctttgacggcgagcggaataaccaggttctggaagagaatatggatgtggaaatttggacgaaggagggggagcgcaagaagctgcgccctcggtggctcgacgccagaacatactctgaccccctggcccttcgcgagttcaaagagtttgccgctggacggagatccgtgagcggcgatctgatcctcgaaattgggaagctgcctcaacacctgaccctccgggcccagaacgctcttgacaatctggtcatgctgcacaactccgagcagggaggcaaagcctatcgccatgcgatggaggaactccccgataccatcgagacactgatgcttctggccctcattgctgttctgaccggcggggtgacactgttctttctctctggaaagggccttgggaagacgagcatcggactgctgtgtgtgaccgcctcctctgctctcctgtggatggccagcgtcgaaccgcactggatcgccgcttccattatccttgagttctttctgatggtgctcctgattcctgaacccgacagacagcggacacctcaagataatcagctggcgtacgttgtgatcggcctccttttcatgattctgaccgtcgccgctaacgagatggggctgctcgagacaaccaaaaaggacctgggaatcggctatgtggccgccgaaaaccatcagcacgctacgatgcttgatgtcgacctgcaccccgccagcgcgtggaccctctacgccgtggctacaaccgttatcacacctatgatgcgccataccattgagaatacgacagccaacatctctctgaccgctattgccaatcaagcggccatcctgatgggcctcgataaagggtggcccatttccaagatggacatcggagtgccgcttctggctctgggctgctacagccaggtcaaccctctcacactgaccgccgctgtgcttatgctggttgcccactatgctattatcgggcccggactccaggccaaagcgaccagagaagcccagaagcggacagctgccggcatcatgaagaatcccacggtggatgggattgtcgctatcgacctggatcctgtggtgtacgacgccaaatttgagaagcaactgggacagattatgctccttatcctgtgtacctctcagattctgctcatgcgcacaacctgggccctgtgcgaatccatcacacttgcgaccggcccgctgacgacactctgggagggcagccccgggaaattctggaacaccaccatcgctgtttctatggccaatattttcagaggaagctatctggctggcgccgggctggccttttccctcatgaagtctcttggaggcgggcggcgcggaacaggcgctcagggcgagaccctgggggaaaaatggaagagacaactgaaccagctcagcaagtccgagttcaatacatacaaacggagcggaatcatggaagtcgacagatccgaggccaaggaaggcctgaaacgcggggagacgaccaagcatgcggtgtctcggggaacagccaaacttagatggtttgtggagcgcaacctggtcaagcctgaaggcaaggttattgatctcgggtgtggacggggcggctggagctattactgcgctgggctgaaaaaggtgaccgaggtgaaaggatatacaaagggcgggcccggacacgaggaacctatccccatggccacctacggctggaatctggtcaaactccattccgggaaggacgtgttctttatgcctccggaaaaatgtgatacgcttctgtgcgacattggagagtctagccccaaccctaccatcgaggaaggcagaacactgcgcgttctcaagatggtggagccctggctgcggggcaatcagttctgtatcaagattcttaacccttacatgccctccgtcgtggaaaccctggagcagatgcaaagaaaacacgggggaatgctcgttcgcaatccgctgtctcggaacagcacacacgagatgtattgggtgtcctgcggcaccgggaatatcgtcagcgctgtgaacatgacatctagaatgctgctcaaccgctttaccatggcccatcggaagcctacgtacgaaagagatgtggacctgggagcgggcacacgccacgtcgccgttgagcccgaagtggctaatcttgatgtgattgggcagagaatcgagaacattaaaaatgaacataagtccacctggcactatgacgaggataacccctacaaaacctgggcctatcacggaagctacgaggtcaagccttctggctccgctagctctatggtgaatggcgttgtgcggctgctcacaaagccctgggacgtcatccctatggtgacgcagattgccatgaccgatacaaccccgttcgggcaacagcgcgtttttaaagaaaaggtggacacaagaacaccccgggctaaaagaggaacaacccagatcatggaggtcacggccaagtggctgtggggcttcctttcccggaacaaaaagcctcgcatctgtaccagagaagagtttacacggaaggtgcgcagcaatgcggccattggggctgttttcgtggacgaaaaccagtggaactccgccaaagaggctgtcgaggatgaaagattttgggacctggtgcatcgggagcgcgaactccacaagcaaggaaaatgcgcgacctgcgtctataacatgatgggcaagagagagaaaaagctgggggagttcggcaaggccaaaggaagccgggccatctggtacatgtggctgggcgctcgcttcctcgagtttgaggccctggggttcatgaatgaagatcattggttttctagagagaacagcctttccggagtggaaggcgaggggctgcacaagctcggatacattctgcgggacatctctaaaattcccggcgggaatatgtatgccgatgacacagctggctgggatacccgcatcacggaggacgatcttcagaacgaagccaagatcacagacattatggagcctgaacatgctctgctcgccaccagcatcttcaaactgacataccagaataaggttgtgagagtccagcggcccgcgaaaaacggaaccgtgatggatgtgatttcccgcagagaccaacggggctctgggcaggttggaacgtatggcctgaacacctttacaaatatggaggtgcagctcatcagacagatggaaagcgaggggattttcctgccgtccgagcttgaaacccctaacctggccgagcgcgctctcgattggctggaaaagcacggagccgagcggcttaagagaatggctatctctggcgacgactgtgtcgtgaaacccatcgatgaccgctttgccacagcgctgaccgccctcaatgatatggggaaggttcggaaagacattcctcaatgggaacccagcaagggctggaacgattggcaacaggtgcctttctgctcccaccattttcaccagctgatcatgaaagacggaagagagattgtcgtgccctgtcgcaatcaagatgagctggtcggccgggctagagtgagccagggggccggatggtctctccgcgaaacagcttgcctgggcaagtcctacgcccagatgtggcaacttatgtatttccatcggagagacctgcgcctcgctgccaacgcgatctgtagcgccgttccggtggattgggtccctgcttctcggaccacgtggtccattcacgcccaccatcagtggatgacaaccgaggacatgctgagcgtgtggaatagagtttggatcgaagagaacccctggatggaagataagacccacgtgtcctcttgggaggaggtcccctaccttgggaaacgggaagaccagtggtgcggaagcctgatcggcctcacagccagagctacctgggccacaaatattcaggtggcgatcaaccaagtgcgccggctgattgggaatgagaactatctggactacatgacgtccatgaagagatttaaaaatgaaagcgatcctgagggcgctctctggtga

SEQ ID NO: 19397 - RNA, 9879 nt, synthetic construct
  misc_feature 1..9879: note = derived and/or modified CDS sequence (opt5) from DENV-1__KC692498__SS-prME
  source 1..9879: mol_type = other RNA
agcgtgaccatgctgctcatgctgcttcccacagctctggctttccacctcacgacccggggcggggagcctcatatgatcgtctccaagcaggaacggggaaagtctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcaccggcgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggactttgttgagggactctccggcgccacatgggtggatgtcgtgctggaacacgggagctgtgtgacgaccatggctaagaataaacccacactggacatcgagctcctgaagaccgaagtcacaaaccctgccgttcttcgcaaactgtgcattgaggcgaagatctctaataccacgacagattccagatgtccgacccaaggagaagccaccctcgtggaggagcaggacgctaacttcgtgtgccggcgcacatttgtcgatagaggctggggcaatgggtgtggactgttcggcaaagggagccttctgacctgcgccaagtttaagtgcgtgacaaaactcgaaggaaagattgttcagtacgagaacctgaaatattctgtgatcgtcacggtgcacaccggcgaccagcatcaagttgggaatgaaacaaccgagcacggaacaatcgctaccattacgccccaggcccctacctccgaaatccagctgacagattacggcgccctcaccctggactgtagcccccggacaggccttgacttcaacgagatggtgctgctcaccatgaaggagaaatcttggctggtccataagcagtggtttcttgatctgcctctcccctggacgtccggggctagcacatcccaagaaacctggaatcgccaggacctgctggtgacattcaaaaccgcgcacgccaagaagcaggaggtcgtggttctcggatctcaagaaggcgctatgcacaccgccctgacaggggccacggagattcagaccagcggaacaaccacaatctttgctggccatcttaaatgcagactgaagatggataaactcaccctgaaggggatgtcctatgtgatgtgtacgggcagcttcaaactggaaaaggaggtcgccgagacacagcacggaaccgtgcttgttcaggtgaagtacgaaggcaccgacgcgccgtgcaaaattcctttctctacacaagatgagaagggggtcacccagaacggacggctcatcacagctaatcccatcgtgacggacaaagaaaagcctgtgaacattgagaccgagccgccctttggcgaatcctatatcgttgtcggggccggagagaaagccctgaagctgagctggttcaagagaggctctagcattgggaaaatgtttgaagctacagcccgcggcgctcggagaatggccatcctcggagataccgcgtgggacttcggctccattgggggagtgtttacatctgtgggcaagctggtccatcaggtgttcgggaccgcctacggagttctttttagcggcgtgtcctggacgatgaaaatcgggatcggcattctgctcacctggctgggactgaatagccgctctacatcccttagcatgacctgtatcgctgtcggcatggtgacactctacctgggggttatggtgcaggccgattctggatgcgtcattaactggaagggccgggagctgaaatgtgggtccggaatcttcgtgaccaacgaagttcacacatggaccgagcaatataagtttcaggctgacagccctaagagactctccgccgcgattggcaaagcctgggaggaaggggtgtgcggcatccgctctgctacgcggctggagaatattatgtggaagcagatcagcaacgaacttaatcatatcctgctcgagaacgatatgaaattcacagtcgtggtgggagacgccaatggcattctggctcaggggaagaaaatgatcagaccgcaacccatggaacacaagtactcctggaaatcttggggaaaggccaagattatcggcgccgacattcagaacaccacctttatcatcgatgggcctgacacacccgagtgtcctgatggacagcgcgcttggaatatttgggaggtcgaagactatggcttcggcgtttttaccacgaacatctggctgaaacttcgggatagctacacacagatgtgcgaccacagactcatgtccgcggccattaaggatagcaaagctgtgcatgccgacatggggtattggatcgagtctgaaaagaatgagacctggaaactggcccgcgcttccttcattgaagtgaagacatgtacctggcccaagagccacacactgtggtctaacggagtcctcgagtccgagatgatcatcccgaaaattttcggcgggcctatcagccaacataattaccggcccggatattttacccagacggccggcccttggcacctggggaaacttgaactggatttcgacctctgcgagggaaccacagtggttgtggatgaacactgcggcaacagaggcccctctctgcggaccacaaccgtcacggggaaaattatccatgagtggtgttgccgcagctgtacactgcctccccttagatttcggggagaggacggctgctggtacgggatggaaattagaccggtgaaggagaaagaagagaatctcgttcgctccatggtgagcgcgggatctggcgaagtcgattccttcagcctggggatcctgtgtgtgtccatcatgattgaggaggttatgcggtctagatggagccgcaagatgctcatgaccggaacactggctgtgtttcttctgctcatcatgggccagctgacctggaacgacctgattagactttgcatcatggtcggcgccaatgcctccgaccggatggggaccggaacaacgtacctggctctcatggccaccttcaagatgcgccctatgtttgcggtgggcctcctgttcagacggctgacatctcgcgaagtgcttctgctcaccattgggctgagcctggtcgcttccgttgagcttcccaactctctggaagaactcggagatggcctggccatggggatcatgatgctcaaactgcttacagaatttcaaccccaccagctgtggaccacgctcctgagcctgacattcgtgaagaccaccctttccctggactatgcctggaaaacaaccgctatggtgctcagcattgtctctctgtttcctctctgtctgtccacaacgagccagaagaccacatggcttccggtgctgctgggatctttcggctgcaaacccctcaccatgtttctgatcacagagaacaagatctggggcagaaagtcctggcctcttaatgaggggattatggccatcggaattgttagcatcctgctctcttccctgctcaaaaacgatgtgcccctggctggccctcttattgccgggggaatgctgatcgcgtgttacgtcatcagcggctccagcgccgacctgtctctcgaaaaggctgccgaggtgagctgggaacaggaggctgaacattccggggcctctcacaatattctggttgaggtgcaagatgacggaaccatgaaaatcaaggatgaggaacgggacgatacgcttaccattctgctcaaagccacactgctcgctgtcagcggcgtgtatcccatgtccatccctgcgaccctgttcgtctggtacttctggcagaagaaaaagcagcgctctggcgtgctttgggacacacccagcccgcctgaggttgaaagagccgtgctggatgacgggatttatcggatcctgcagcgcggactcctgggcagatcccaagtcggggtgggagtttttcaggatggcgtgttccataccatgtggcacgtcacaagaggggctgtgcttatgtaccagggaaagagactggagccctcttgggccagcgtgaaaaaggacctcatctcctatggcggcgggtggcgctttcagggaagctggaacacgggcgaggaagttcaagtcattgccgtggagcctgggaaaaatcccaagaacgtgcagaccacaccgggaaccttcaaaacccctgaaggcgaggtcggggctatcgccctggactttaagcccggaacatctggctcccctattgtgaatcgggaaggcaagatcgttgggctctacggaaacggcgtggtcacgaccagcgggacatacgtgtctgcgattgctcaggccaaagcctcccaagagggacccctgcccgagatcgaagatgaggttttcaagaaaagaaatcttaccattatggacctgcaccctggcagcgggaagacacgccggtatctgccggctatcgtgagagaagccatcaaacgcaagctccggaccctgattcttgcgcccacgagagtcgtggcttccgagatggccgaagccctgaagggcatgcctatccgctaccagacaaccgctgttaaatctgagcataccggacgggagattgtggatctcatgtgccacgccacatttaccatgagactgctgagccccgtccgggtgcctaactataatatgatcattatggacgaagctcatttcacagatcccgcctccatcgcggcccgcggctacatcagcaccagagtggggatgggagaggctgccgctatttttatgacggccacacctccgggctctgtcgaagccttcccccagtccaacgctgttatccaggacgaggaacgggatattcctgagcgcagctggaactctgggtatgactggatcaccgattttagcggaaagacagtgtggttcgtgccctccattaaatctggcaacgacatcgcgaattgtctcagaaagaacgggaaacgggtcatccaacttagcagaaagaccttcgatacggagtaccagaagaccaaaaacaatgactgggactatgtggttacaaccgatatttccgaaatgggcgccaactttcgcgctgaccgggtgatcgatcctagacgctgcctgaagcccgtcattctgaaagacggaccggagcgggtgatcctcgccggccctatgcccgttacagtggcctctgctgcccagagacgcgggcggattggaagaaatcagaacaaggaaggcgatcaatacgtctacatggggcagcccctgaataacgacgaggatcacgcgcattggaccgaggctaaaatgcttctggacaatatcaacacacctgaaggaattatccccgccctcttcgagcctgaacgcgaaaagagcgccgctatcgatggcgaatatagactgagaggggaagcccgcaagacctttgtggagctgatgagacggggcgacctcccggtctggctttcctacaaagtggcgagcgaaggattccagtattctgatcgcagatggtgctttgacggcgagcggaataaccaggttctggaagagaatatggatgtggaaatttggacgaaggagggggagcgcaagaagctgcgcccccggtggctcgacgccagaacatactccgaccctctggcccttcgcgagttcaaagagtttgccgctggacggagaagcgtgtccggcgatctgatcctcgaaattgggaagctgccccaacacctgaccctccgggcccagaacgctcttgacaatctggtcatgctgcacaactctgagcagggaggcaaagcctatcgccatgcgatggaggaactccctgataccatcgagacactgatgcttctggccctcattgctgttctgaccggcggggtgacactgttctttctcagcggaaagggccttgggaagacgtccatcggactgctgtgtgtgaccgcctctagcgctctcctgtggatggcctccgtcgaaccccactggatcgccgctagcattatccttgagttctttctgatggtgctcctgattccggaacctgacagacagcggacaccccaagataatcagctggcgtacgttgtgatcggcctccttttcatgattctgaccgtcgccgctaacgagatggggctgctcgagacaaccaaaaaggacctgggaatcggctatgtggccgccgaaaaccatcagcacgctacgatgcttgatgtcgacctgcaccctgcctctgcgtggaccctctacgccgtggctacaaccgttatcacacccatgatgcgccataccattgagaatacgacagccaacatctccctgaccgctattgccaatcaagcggccatcctgatgggcctcgataaagggtggcctattagcaagatggacatcggagtgccccttctggctctgggctgctactctcaggtcaacccgctcacactgaccgccgctgtgcttatgctggttgcccactatgctattatcgggcctggactccaggccaaagcgaccagagaagcccagaagcggacagctgccggcatcatgaagaatcccacggtggatgggattgtcgctatcgacctggatcccgtggtgtacgacgccaaatttgagaagcaactgggacagattatgctccttatcctgtgtacctcccagattctgctcatgcgcacaacctgggccctgtgcgaaagcatcacacttgcgaccggccctctgacgacactctgggagggctctccggggaaattctggaacaccaccatcgctgttagcatggccaatattttcagaggatcctatctggctggcgccgggctggccttttctctcatgaaaagccttggaggcgggcggcgcggaacaggcgctcagggcgagaccctgggggaaaaatggaagagacaactgaaccagctctccaagagcgagttcaatacatacaaacggtccggaatcatggaagtcgacagatctgaggccaaggaaggcctgaaacgcggggagacgaccaagcatgcggtgagccggggaacagccaaacttagatggtttgtggagcgcaacctggtcaagcccgaaggcaaggttattgatctcgggtgtggacggggcggctggtcctattactgcgctgggctgaaaaaggtgaccgaggtgaaaggatatacaaagggcgggcctggacacgaggagcccatccctatggccacctacggctggaatctggtcaaactccattctgggaaggacgtgttctttatgccccctgaaaaatgtgatacgcttctgtgcgacattggagagagctccccgaaccccaccatcgaggaaggcagaacactgcgcgttctcaagatggtggagccttggctgcggggcaatcagttctgtatcaagattcttaacccctacatgccttctgtcgtggaaaccctggagcagatgcaaagaaaacacgggggaatgctcgttcgcaatcccctgagccggaactccacacacgagatgtattgggtgagctgcggcaccgggaatatcgtctctgctgtgaacatgacatccagaatgctgctcaaccgctttaccatggcccatcggaagccgacgtacgaaagagatgtggacctgggagcgggcacacgccacgtcgccgttgagcctgaagtggctaatcttgatgtgattgggcagagaatcgagaacattaaaaatgaacataagagcacctggcactatgacgaggataacccctacaaaacctgggcctatcacggatcttacgaggtcaagccctccggcagcgcttcttccatggtgaatggcgttgtgcggctgctcacaaagccttgggacgtcatccccatggtgacgcagattgccatgaccgatacaacccctttcgggcaacagcgcgtttttaaagaaaaggtggacacaagaaccccgcgggctaaaagaggaacaacccagatcatggaggtcacggccaagtggctgtggggcttccttagccggaacaaaaagccccgcatctgtaccagagaagagtttacacggaaggtgcgctccaatgcggccattggggctgttttcgtggacgaaaaccagtggaatagcgccaaagaggctgtcgaggatgaaagattttgggacctggtgcatcgggagcgcgaactccacaagcaaggaaaatgcgcgacctgcgtctataacatgatgggcaagagagagaaaaagctgggggagttcggcaaggccaaaggatctcgggccatctggtacatgtggctgggcgctcgcttcctcgagtttgaggccctggggttcatgaatgaagatcattggtttagcagagagaactccctttctggagtggaaggcgaggggctgcacaagctcggatacattctgcgggacatcagcaaaattcctggcgggaatatgtatgccgatgacacagctggctgggatacccgcatcacggaggacgatcttcagaacgaagccaagatcacagacattatggagcccgaacatgctctgctcgccacctccatcttcaaactgacataccagaataaggttgtgagagtccagcggcctgcgaaaaacggaaccgtgatggatgtgatttctcgcagagaccaacggggcagcgggcaggttggaacgtatggcctgaacacctttacaaatatggaggtgcagctcatcagacagatggaatccgaggggattttcctgccctctgagcttgaaaccccgaacctggccgagcgcgctctcgattggctggaaaagcacggagccgagcggcttaagagaatggctatcagcggcgacgactgtgtcgtgaaacctatcgatgaccgctttgccacagcgctgaccgccctcaatgatatggggaaggttcggaaagacattccccaatgggaaccttccaagggctggaacgattggcaacaggtgcccttctgcagccaccattttcaccagctgatcatgaaagacggaagagagattgtcgtgccttgtcgcaatcaagatgagctggtcggccgggctagagtgtctcagggggccggatggtccctccgcgaaacagcttgcctgggcaagagctacgcccagatgtggcaacttatgtatttccatcggagagacctgcgcctcgctgccaacgcgatctgttctgccgttcccgtggattgggtcccggcttcccggaccacgtggagcattcacgcccaccatcagtggatgacaaccgaggacatgctgtccgtgtggaatagagtttggatcgaagagaacccttggatggaagataagacccacgtgtctagctgggaggaggtcccctaccttgggaaacgggaagaccagtggtgcggatccctgatcggcctcacagccagagctacctgggccacaaatattcaggtggcgatcaaccaagtgcgccggctgattgggaatgagaactatctggactacatgacgagcatgaagagatttaaaaatgaatctgatcccgagggcgctctctggtga

SEQ ID NO: 19398 - RNA, 9879 nt, synthetic construct
  misc_feature 1..9879: note = derived and/or modified CDS sequence (opt5) from DENV-1__KC692499__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgtgaactttgtctgccggcgcacattcgtggatagaggctggggcaatgggtgtggactctttggcaaagggagcctgcttacctgcgctaagttcaagtgcgttacaaaactggaaggaaagattgtgcagtacgagaacctcaaatattctgtcatcgtgacggttcacaccggcgaccagcatcaagtggggaatgaaacaaccgagcacggaacaatcgccaccattacgccccaggctcctacctccgaaatccagctgacagattacggcgccctgaccctcgactgtagcccccggacaggcctggactttaacgagatggtccttctgaccatgaaggagaaatcttggctcgtgcataagcagtggttcctggatcttcctctgccctggacgtccggggccagcacatcccaagaaacctggaatcgccaggacctcctggtcacatttaaaaccgctcacgcgaagaagcaggaggtggttgtgctgggatctcaagaaggcgccatgcacaccgctctcacaggggccacggagattcagaccagcggaacaaccacaatcttcgccggccatctgaaatgcagacttaagatggataaactgaccctcaaggggatgtcctatgtcatgtgtacgggcagcttcaaactggaaaaggaggtggctgagacacagcacggaaccgttctggtgcaggtcaagtacgaaggcaccgacgccccgtgcaaaattcctttttctacacaagatgagaagggggtgacccagaacggacggcttatcacagcgaatcccatcgtgacggacaaagaaaagcctgttaacattgagaccgagccccccttcggcgaatcctatatcgtcgtgggggctggagagaaagccctcaagctgagctggtttaagagaggctctagcattgggaaaatgttcgaagccacagctcgcggcgcccggagaatggctatcctgggagataccgcctgggactttggctccattgggggagtgttcacatctgtcggcaagctcgtgcatcaggtttttgggaccgcgtacggagtgctgttcagcggcgtctcctggacgatgaaaatcgggatcggcattcttctgacctggctcggactgaatagccgctctacatccctgagcatgacctgtatcgccgtgggcatggttacactttacctcggggtgatggtccaggctgattctggatgcgtgattaactggaagggccgggagctgaaatgtgggtccggaatctttgttaccaacgaagtgcacacatggaccgagcaatataagttccaggccgacagccctaagagactgtccgctgccattggcaaagcgtgggaggaaggggtctgcggcatccgctctgccacgcggctcgagaatattatgtggaagcagatcagcaacgaactgaatcatatccttctggagaacgatatgaaatttacagtggtggtcggagacgctaatggcattctcgcccaggggaagaaaatgatcagaccgcaacccatggaatacaagtattcctggaaatcttggggaaaggctaagattatcggcgccgacattcagaacaccaccttcatcatcgatgggcctgacacacccgagtgtcctgatggacagcgcgcctggaatatttgggaggttgaagactacggctttggcgtgttcaccacgaacatctggctgaaactgcgggatagctatacacagatgtgcgaccacagacttatgtccgctgcgattaaggatagcaaagccgtgcacgctgacatggggtactggatcgagtctgaaaagaatgagacctggaaactcgcccgcgcctccttcattgaagtcaagacatgtacctggcccaagagccatacactgtggtctaacggagtgctggagtccgagatgatcatcccgaaaatttttggcgggcctatcagccaacacaattatcggcccggatacttcacccagacggctggcccttggcatctcgggaagctggaacttgattttgacctgtgcgagggaaccacagttgtggtcgatgaacactgcggcaacagaggcccctctctccggaccacaaccgtgacggggaaaattatccacgagtggtgttgccgcagctgtacactgcctcccctgagattccggggagaggacggctgctggtacgggatggaaattagaccggttaaggagaaagaagagaatcttgtgcgctccatggtcagcgccggatctggcgaagtggattcctttagcctcgggatcctgtgtgtttccatcatgattgaggaggtgatgcggtctagatggagccgcaagatgctgatgaccggaacactcgcggtcttcctgcttctgatcatgggccagctcacctggaacgacctgattagactgtgcatcatggtgggcgctaatgcctccgaccggatggggatgggaaccacatatcttgccctgatggctacgtttaagatgcgccctatgttcgccgtgggcctcctgtttagacggctcacctctcgcgaagtcctgcttctgacaattgggctcagcctggttgcgtccgtggagctgcccaactctcttgaagagctgggagatggcctcgctatggggatcatgatgctgaaactcctgaccgaattccaaccccatcagctttggacaaccctgctcagcctgacgtttgtgaagacaaccctgtcccttgactacgcctggaaaaccacagccatggtcctgagcattgtgtctctcttccctctgtgtctctccaccacaagccagaagacgacctggctgccggttcttctgggatcttttggctgcaaacccctgacaatgttcctcatcaccgagaacaagatctggggcagaaagtcctggcctctgaatgaggggattatggctatcggaattgtgagcatccttctgtcttccctcctgaaaaacgatgtccccctcgccggccctctgattgctgggggaatgcttatcgcctgttatgtgatcagcggctccagcgcggacctgtctctggaaaaggccgctgaggttagctgggaacaggaggccgaacactccggggcttctcataatattctcgtggaggtccaagatgacggaacaatgaaaatcaaggatgaggaacgggacgataccctgacgattcttctgaaagccaccctcctggccgtgagcggcgtctaccccatgtccatccctgctacactcttcgtgtggtatttttggcagaagaaaaagcagcgctctggcgttctgtgggacacccccagcccgcctgaggtggaaagagcggtccttgatgacgggatttaccggatcctgcagcgcggactgctcggcagatcccaagtgggggttggagtgttccaggatggcgtctttcacacaatgtggcatgtgacccggggggccgtgctgatgtatcagggaaagagacttgagccctcttgggctagcgttaaaaaggacctgatctcctacggcggcgggtggcgcttccagggaagctggaacacaggcgaggaagtccaagtgattgccgtggagcctgggaaaaatcccaagaacgtccagacgaccccgggaacatttaaaacccctgaaggcgaggtgggggccatcgctctcgacttcaagcccggaacctctggctcccctattgttaatcgggaaggcaagatcgtggggctgtacggaaacggcgtcgtgacaacgagcgggacctatgtttctgccattgcgcaggctaaagcctcccaagagggacccctccccgagatcgaagatgaggtgtttaagaaaagaaatctgacaattatggaccttcaccctggcagcgggaagacccgccggtacctgccggccatcgtcagagaagctatcaaacgcaagctgcggacactcattctggcccccaccagagtggttgcgtccgagatggctgaagcccttaagggcatgcctatccgctatcagacgacagccgtgaaatctgagcacaccggacgggagattgtcgatctgatgtgccatgctaccttcacaatgagactcctgagccccgtgcgggtgcctaactacaatatgatcattatggacgaagcccactttaccgatcccgcttccatcgccgcgcgcggctatatcagcacaagagtcgggatgggagaggccgctgccattttcatgaccgctacgcctccgggctctgttgaagcctttccccagtccaacgccgtgatccaggacgaggaacgggatattcctgagcgcagctggaattctgggtacgactggatcgctgatttccccggaaagacagtgtggttcgtccctagcattaaatccggcaacgacatcgcgaattgtctgagaaagaacgggaaacgggtgatccaactctctagaaagacctttgatacagagtatcagaagaccaaaaacaatgactgggactacgttgtgacgaccgatattagcgaaatgggcgccaacttccgcgctgaccgggtcatcgatcccagacgctgccttaagccggtgattctgaaagacggacctgagcgggttatcctggccggccccatgcccgtgacagtcgcctccgctgcccagagacgcgggcggattggaagaaatcagaacaaggaaggcgatcaatacgtgtatatggggcagcctctcaataacgacgaggatcatgcgcactggaccgaggctaaaatgctgcttgacaatatcaacacacccgaaggaattatccctgccctgtttgagccggaacgcgagaagtctgccgctatcgatggcgaatacagactccggggggaggcccgcaagaccttcgtcgagctgatgagacggggcgacctgcccgtgtggctcagctataaagttgcgtccgaaggatttcagtacagcgatcgcagatggtgcttcgacggcgagcggaataaccaggtgcttgaagagaatatggatgtggaaatttggacaaaggagggggagagaaaaaagctgcgccctcggtggctggacgccagaacctattctgaccccctcgctctgcgcgaatttaaagagttcgccgctggacggagatccgtcagcggcgatcttatcctggaaattgggaagctccctcaacatctgacgctgcgggcccagaacgctctcgacaatcttgttatgctgcacaactccgagcagggaggcaaagcctaccgccacgcgatggaagagctgcccgatacaatcgagaccctcatgctgcttgccctgattgctgtgctcaccggcggggtgacactgtttttcctgtctggaaagggcctcgggaagaccagcatcggacttctgtgtgtcacagcctcctctgctctgctctggatggccagcgtggaaccgcattggatcgccgcttccattatcctggagtttttccttatggttctgctcattcctgaacccgacagacagcggacgcctcaagataatcagctggcgtatgtggtcatcggcctgctctttatgattcttaccgtggccgctaacgagatggggctgctggagacaaccaaaaaggacctcggaatcggctacgtcgccgccgaaaaccaccagcatgctacaatgctggatgtggaccttcaccccgccagcgcgtggaccctgtacgccgttgctacgaccgtgatcacacctatgatgcgccacaccattgagaatacaaccgccaacatctctctcacggctattgccaatcaagcggccatcctgatgggcctggataaagggtggcccatttccaagatggacatcggagtcccgctccttgctctgggctgctatagccaggtgaaccctctgacactcaccgccgctgttctgatgcttgtggcccattacgctattatcgggcccggactgcaggccaaagcgacaagagaagcccagaagcggaccgctgccggcatcatgaagaatcccaccgtcgatgggattgtggctatcgacctcgatcctgtggtttatgacgccaaattcgagaagcaactgggacagattatgctgctcatcctttgtacatctcagattctgctgatgcgcacgacctgggccctctgcgaatccatcacactggcgaccggcccgcttacaaccctgtgggagggcagccccgggaaattctggaacacgacaatcgctgtctctatggccaatatttttagaggaagctacctcgctggcgccgggctggccttctccctgatgaagtctctcggaggcgggcggcgcggaaccggcgctcagggcgagacccttggggaaaaatggaagagacaactgaaccagctgagcaagtccgagtttaatacatataaacggagcggaatcatggaagtggacagatccgaggccaaggaaggcctcaaacgcggggagaccacaaagcacgcggtgtctcggggaacggccaaactgagatggttcgtcgagcgcaaccttgttaagcctgaaggcaaggtgattgatctggggtgtggacggggcggctggagctactattgcgctgggctcaaaaaggtgaccgaggtcaaaggatacacaaagggcgggcccggacatgaagagcctatccccatggccacctacggctggaatctggtgaaactgcactccgggaaggacgtttttttcatgcctccggaaaaatgtgatacactcctttgcgacattggagagtctagccccaaccctaccatcgaggaaggcagaacgctgcgcgtgctgaagatggtcgagccctggctccggggcaatcagttttgtatcaagattctgaacccttatatgccctccgtggttgaaacccttgagcagatgcaaagaaaacatgggggaatgctggtgcgcaatccgctctctcggaacagcacacacgagatgtactgggtctcctgcggcaccgggaatatcgtgagcgctgtgaacatgacatctagaatgctgctgaaccgcttcaccatggcccaccggaagcctacatatgaaagagatgtcgacctcggagcgggcacccgccatgttgccgtggagcccgaagtggctaatctggatattatcgggcagagaattgagaacatcaaaaatgaacacaagtccacgtggcattacgacgaggataacccctataaaacatgggcctaccacggaagctatgaggtcaagccttctggctccgctagctctatggtgaatggcgttgtgcggcttctgaccaagccctgggacgtcattcctatggtgacccagatcgccatgacagatacgaccccgtttgggcaacagcgcgttttcaaagaaaaggtggacacaagaaccccccgggctaaaagaggaacaacccagatcatggaggtcacagccaagtggctctggggctttctgtcccggaacaaaaagcctcgcatttgtaccagagaagagttcacgcggaaggtgcgcagcaatgcggccatcggggctgtttttgtggacgaaaaccagtggaattccgccaaagaggctgtcgaggatgaaagattctgggaccttgtgcaccgggagcgcgaactgcataagcaaggaaaatgcgccacctgcgtctacaacatgatgggcaagagagagaaaaagctcggggaattcggcaaggccaaaggaagccgggcgatttggtacatgtggctgggcgctcgctttctggagttcgaggccctcgggtttatgaatgaagatcactggttctctagagagaacagcctgtccggagtggaaggcgaggggcttcataagctgggatatatcctccgggacatttctaaaatccccggcgggaatatgtacgccgatgacacagctggctgggatacccgcatcacagaggacgatctgcagaacgaagccaagattaccgacatcatggagcctgaacacgctcttctggccacgagcatttttaaactcacatatcagaataaggttgtgagagtccagcggcccgcgaaaaacggaaccgtgatggatgtgatctcccgcagagaccaacggggctctgggcaggttggaacatacggcctgaacaccttcacgaatatggaggtgcagctgattagacagatggaaagcgaggggatctttctcccgtccgagctggaaacccctaaccttgccgagcgcgctctggattggctcgaaaagcatggagccgagcggctgaagagaatggctatctctggcgacgactgtgtcgtgaaacccattgatgaccgcttcgccacagcgcttaccgccctgaatgatatggggaaggttcggaaagacatccctcaatgggaacccagcaagggctggaacgattggcagcaggtgcctttttgctcccaccacttccatcagctcattatgaaagacggaagagagatcgtcgtgccctgtcgcaatcaagatgagctggtcggccgggctagagtgagccagggggccggatggtctctgcgcgaaacagcttgcctcggcaagtcctatgcccagatgtggcaactgatgtactttcaccggagagaccttcgcctggctgccaacgcgatttgtagcgccgttccggtggattgggtccctgcttctcggaccacatggtccatccatgcccaccaccagtggatgaccacggaggacatgctcagcgtgtggaatagagtttggatcgaagagaacccctggatggaagataagacacatgtgtcctcttgggaggaggtcccctatctggggaaacgggaagaccagtggtgcggaagccttattggcctgaccgccagagctacctgggccacaaatatccaggtggcgattaaccaagtgcgccggctcatcgggaatgagaactacctggactacatgacctccatgaagagattcaaaaatgaaagcgatcctgagggcgctctgtggtga

SEQ ID NO: 19399 - RNA, 9879 nt, synthetic construct
  misc_feature 1..9879: note = derived and/or modified CDS sequence (opt5) from DENV-1__KC692500__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggggaaatcttggctcgtccataagcagtggttcctggatcttcctctgccctggacgtccggagctagcacatcccaagagacctggaatcgccaggacctcctggtgacatttaaaaccgcgcacgccaagaagcaggaagtcgtggttctgggctctcaagagggggctatgcacaccgccctcacaggagccacggaaattcagaccagcggcacaaccacaatcttcgctgggcatctgaaatgcagacttaagatggataaactgaccctcaagggcatgtcctatgtgatgtgtacgggaagcttcaaactggagaaggaagtcgccgagacacagcacggcaccgtgctggttcaggtgaagtacgaggggaccgacgcgccgtgcaaaattcctttttctacacaagatgaaaagggagtcacccagaacggccggcttatcacagctaatcccatcgtgacggacaaagagaagcctgtgaacattgaaaccgagccccccttcggggagtcctatatcgttgtcggagccggcgaaaaagccctcaagctgagctggtttaagagagggtctagcattggcaaaatgttcgaggctacagcccgcggagctcggagaatggccatcctgggcgataccgcgtgggactttgggtccattggaggcgtgttcacatctgtggggaagctcgtccatcaggtgtttggaaccgcctacggcgttctgttcagcggggtgtcctggacgatgaaaatcggcatcggaattcttctgacctggctcggcctgaatagccgctctacatccctgagcatgacctgtatcgctgtcgggatggtgacactttacctcggagttatggtgcaggccgattctggctgcgtcattaactggaaggggcgggaactgaaatgtggatccggcatctttgtgaccaacgaggttcacacatggaccgaacaatataagttccaggctgacagccctaagagactgtccgccgcgattgggaaagcctgggaggagggcgtgtgcggaatccgctctgctacgcggctcgaaaatattatgtggaagcagatcagcaacgagctgaatcatatccttctggaaaacgatatgaaatttacagtcgtggtgggcgacgccaatgggattctcgctcagggaaagaaaatgatcagaccgcaacccatggagcacaagtactcctggaaatcttggggcaaggccaagattatcggggccgacattcagaacaccaccttcatcatcgatggacctgacacacccgaatgtcctgatggccagcgcgcttggaatatttgggaggtcgaggactatggctttggggttttcaccacgaacatctggctgaaactgcgggatagctacacacagatgtgcgaccacagacttatgtccgcggccattaaggatagcaaagctgtgcatgccgacatgggatattggatcgaatctgagaagaatgaaacctggaaactcgcccgcgcttccttcattgaggtgaagacatgtacctggcccaagagccacacactgtggtctaacggcgtcctggaatccgagatgatcatcccgaaaatttttgggggacctatcagccaacataattaccggcccggctatttcacccagacggccgggccttggcacctcggaaagctggagcttgattttgacctgtgcgaaggcaccacagtggttgtggatgagcactgcggcaacagagggccctctctccggaccacaaccgtcacgggaaaaattatccatgaatggtgttgccgcagctgtacactgcctcccctgagattccggggcgaggacgggtgctggtacggaatggagattagaccggtgaaggaaaaagaggaaaatcttgttcgctccatggtgagcgcgggctctggggaggtcgattcctttagcctcggaatcctgtgtgtgtccatcatgattgaagaggttatgcggtctagatggagccgcaagatgctgatgaccggcacactcgctgtgttcctgcttctgatcatgggccagctcacctggaacgacctgattagactgtgcatcatggtcggggccaatgcctccgaccggatgggaatgggcaccacataccttgctctgatggccacgtttaagatgcgccctatgttcgcggtggggctcctgtttagacggctcacctctcgcgaggtgctgcttctgacaattggactcagcctggtcgcttccgttgaactgcccaactctcttgaggaactgggcgatgggctcgccatgggaatcatgatgctgaaactcctgaccgagttccaaccccaccagctttggacaaccctgctcagcctgacgtttgtgaagacaaccctgtcccttgactatgcctggaaaaccacagctatggtgctgagcattgtctctctcttccctctgtgtctctccaccacaagccagaagacgacctggctgccggtgcttctgggctcttttggctgcaaacccctgacaatgttcctcatcaccgaaaacaagatctgggggagaaagtcctggcctctgaatgagggaattatggccatcggcattgttagcatccttctgtcttccctcctgaaaaacgatgtgcccctcgctgggcctctgattgccggaggcatgcttatcgcgtgttacgtcatcagcgggtccagcgccgacctgtctctggagaaggctgccgaagtgagctgggagcaggaagctgagcattccggagcctctcacaatattctcgttgaagtgcaagatgacggcacaatgaaaatcaaggatgaggagcgggacgataccctgacgattcttctgaaagccaccctcctggctgtcagcggcgtgtatcccatgtccatccctgcgacactcttcgtctggtacttttggcagaagaaaaagcagcgctctggggtgctgtgggacacccccagcccgcctgaagttgagagagccgtgcttgatgacggaatttatcggatcctgcagcgcggcctgctcgggagatcccaagtcggagtgggcgttttccaggatggggtgtttcatacaatgtggcacgtcacccggggagctgtgctgatgtaccagggcaagagacttgaaccctcttgggccagcgtgaaaaaggacctgatctcctatggcgggggatggcgcttcaaaggcagctggaacacaggggaggaggttcaggtcattgccgtggaacctggaaagaatcccaaaaacgtgcaaacgaccccgggcacatttaagacccctgagggggaagtcggagctatcgccctcgacttcaagcccggcacctctggctcccctattgtgaatcgggaggggaaaatcgttggactgtacggcaacggggtggtcacaacgagcggaacctacgtgtctgcgattgctcaggccaaggcctcccaggaaggccccctccccgagatcgaggatgaagtttttaaaaagagaaatctgacaattatggaccttcaccctgggagcggcaaaacccgccggtatctgccggctatcgtgagagaggccatcaagcgcaagctgcggacactcattctggcgcccaccagagtcgtggcttccgaaatggccgaggcccttaaaggaatgcctatccgctaccaaacgacagctgttaagtctgaacataccggccgggagattgtggatctgatgtgccacgccaccttcacaatgagactcctgagccccgtccgggtgcctaactataatatgatcattatggacgaggctcattttaccgatcccgcctccatcgcggcccgcgggtacatcagcacaagagtgggaatgggcgaagctgccgctattttcatgaccgccacgcctccggggtctgtcgaggcctttccccagtccaacgctgttatccaggacgaagagcgggatattcctgaacgcagctggaattctggatatgactggatcacagatttccccggcaaaaccgtgtggttcgtgcctagcattaagtccgggaacgacatcgcgaattgtctgagaaaaaacggcaagcgggtcatccagctctctagaaagacatttgataccgagtaccaaaaaacgaagaacaatgactgggactatgtggttaccacagatattagcgagatgggagccaacttccgcgctgaccgggtgatcgatcccagacgctgccttaaaccggtcattctgaaggacggccctgaacgggtgatcctggccgggcccatgcccgttaccgtggcctccgctgcccagagacgcggacggattggcagaaatcagaacaaagagggggatcagtacgtctacatgggacaacctctcaataacgacgaagatcacgcgcattggacagaggctaagatgctgcttgacaatatcaacacccccgagggcattatccctgccctgtttgaaccggagcgcgaaaagtctgccgctatcgatggggagtatagactccggggcgaagcccgcaaaacattcgtggagctgatgagacggggagacctgcccgtctggctcagctacaaggtggcgtccgagggctttcagtatagcgatcgcagatggtgcttcgacggggaacggaataaccaggttcttgaggaaaatatggatgtggagatttggaccaaagaaggagagagaaagaaactgcgccctcggtggctggacgccagaacgtactctgaccccctcgctctgcgcgagtttaaggaattcgccgctggccggagatccgtgagcggggatcttatcctggagattggaaaactccctcagcacctgacactgcgggcccaaaacgctctcgacaatcttgtcatgctgcacaactccgaacagggcggcaaggcctatcgccatgcgatggaggaactgcccgataccatcgagaccctcatgctgcttgccctgattgctgttctcacagggggagtgaccctgtttttcctgtctggcaaggggctcggaaaaacaagcatcggccttctgtgtgtgacggcctcctctgctctgctctggatggccagcgtcgagccgcactggatcgccgcttccattatcctggaatttttccttatggtgctgctcattcctgagcccgacagacagcggacccctcaggataatcaactggcgtacgttgtgatcgggctgctctttatgattcttacagtcgccgctaacgaaatgggactgctggagaccacaaagaaagacctcggcatcggctatgtggccgccgagaaccatcagcacgctaccatgctggatgtcgaccttcaccccgccagcgcgtggacgctgtacgccgtggctaccacagttatcacccctatgatgcgccatacaattgaaaataccacggccaacatctctctcacagctattgccaatcaggcggccatcctgatggggctggataagggatggcccatttccaaaatggacatcggcgtgccgctccttgctctggggtgctacagccaagtcaaccctctgaccctcacagccgctgtgctgatgcttgttgcccactatgctattatcggacccggcctgcaggccaaggcgaccagagaggcccagaagcggaccgctgccgggatcatgaaaaatcccacagtggatggaattgtcgctatcgacctcgatcctgtggtgtacgacgccaagttcgaaaaacagctgggccaaattatgctgctcatcctttgtacgtctcagattctgctgatgcgcaccacatgggccctctgcgagtccatcaccctggcgacaggcccgcttaccacgctgtgggaagggagccccggaaagttctggaacacaaccatcgctgtttctatggccaatatttttagaggcagctatctcgctggggccggactggccttctccctgatgaaatctctcggcgggggacggcgcggcaccggcgctcagggggagacacttggagagaagtggaagagacagctgaaccaactgagcaaatccgaatttaatacctacaagcggagcggcatcatggaggtcgacagatccgaagccaaagaggggctcaagcgcggagaaacaacgaaacatgcggtgtctcggggcaccgccaagctgagatggttcgtggagcgcaaccttgtcaagcctgaggggaaagttattgatctgggatgtggccggggcgggtggagctattactgcgctggactcaagaaagtgacagaagtgaagggctataccaaagggggacccggccacgaggaacctatccccatggccacatacgggtggaatctggtcaagctgcattccggaaaagacgtgtttttcatgcctccggagaagtgtgataccctcctttgcgacattggcgaatctagccccaaccctacgatcgaggagggcagaaccctgcgcgttctgaagatggtggaaccctggctccgggggaatcagttttgtatcaaaattctgaacccttacatgccctccgtcgtggagacacttgaacagatgcagagaaagcacggaggcatgctggttcgcaatccgctctctcggaacagcacccacgagatgtattgggtgtcctgcgggacaggaaatatcgtcagcgctgtgaacatgacctctagaatgctgctgaaccgcttcacaatggcccatcggaaacctacctacgagagagatgtggacctcggcgcggggacgcgccacgtcgccgttgaacccgaggtggctaatctggatattatcggacaaagaattgaaaacatcaagaatgagcataaatccacatggcactatgacgaagataacccctacaagacctgggcctatcacggcagctacgaggtgaagccttctggctccgctagctctatggtcaatggggtggttcggcttctgaccaaaccctgggacgtgattcctatggtcacacagatcgccatgacggataccacaccgtttggacagcaacgcgtgttcaaggagaaagttgacaccagaacaccccgggctaagagaggcaccacacagatcatggaagtgaccgccaaatggctctgggggtttctgtcccggaacaagaagcctcgcatttgtacgagagaggaattcacccggaaagtccgcagcaatgcggccatcggagctgtgtttgttgacgagaaccagtggaattccgccaaggaagctgtggaggatgagagattctgggaccttgtccatcgggaacgcgagctgcacaaacagggcaagtgcgccacatgcgtgtataacatgatggggaaaagagaaaagaagctcggcgagttcggaaaagccaagggcagccgggcgatttggtacatgtggctgggggctcgctttctggaattcgaggccctcggatttatgaatgaggatcattggttctctagagaaaacagcctgtccggcgtcgagggggaaggacttcacaaactgggctacatcctccgggacatttctaagatccccgggggcaatatgtatgccgatgacaccgctggatgggatacacgcatcaccgaggacgatctgcaaaacgaggccaaaattacggacatcatggaacctgagcatgctcttctggccacaagcatttttaagctcacctaccagaataaagtggttagagtgcagcggcccgcgaagaacggcacagtcatggatgtgatctcccgcagagaccagcgggggtctggacaagtgggcacctatgggctgaacacgttcaccaatatggaagttcagctgattagacagatggagagcgaaggaatctttctcccgtccgagctggagacacctaaccttgccgaacgcgctctggattggctcgagaagcacggcgccgaacggctgaaaagaatggctatctctggggacgactgtgtggtcaagcccattgatgaccgcttcgccaccgcgcttacagccctgaatgatatgggcaaagtgcggaaggacatccctcagtgggagcccagcaaaggatggaacgattggcaacaggttcctttttgctcccaccatttccaccagctcattatgaaggacggcagagaaatcgtggtcccctgtcgcaatcaggatgagctggtggggcgggctagagtcagccaaggagccggctggtctctgcgcgagaccgcttgcctcgggaagtcctacgcccagatgtggcagctgatgtattttcatcggagagaccttcgcctggctgccaacgcgatttgtagcgccgtgccggttgattgggtgcctgcttctcggacaacctggtccatccacgcccaccatcaatggatgacgacagaagacatgctcagcgtctggaatagagtgtggatcgaggaaaacccctggatggaggataaaacccacgtttcctcttgggaagaggtgccctacctgggaaagcgggaggaccagtggtgcggcagccttattgggctgaccgccagagctacatgggccaccaatatccaggtcgcgattaaccaggtgcgccggctcatcggcaatgaaaactatctggactacatgacatccatgaaaagattcaagaatgagagcgatcctgaaggagctctgtggtga

SEQ ID NO: 19400 - RNA, 9879 nt, synthetic construct
  misc_feature 1..9879: note = derived and/or modified CDS sequence (opt5) from DENV-1__KC692501__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttttggcgggcctatcagccaacataattaccggcccggatatttcacccagacggccggcccttggcacctcgggaagctggaacttgattttgacctgtgcgagggaaccacagtggttgtggatgaacactgcggcaacagaggcccctctctccggaccacaaccgtcacggggaaaattatccatgagtggtgttgccgcagctgtacactgcctcccctgagattccggggagaggacggctgctggtacgggatggaaattagaccggtgaaggagaaagaagagaatcttgttcgctccatggtgagcgcgggatctggcgaagtcgattcctttagcctcgggatcctgtgtgtgtccatcatgattgaggaggttatgcggtctagatggagccgcaagatgctgatgaccggaacactcgctgtgttcctgcttctgatcatgggccagctcacctggaacgacctgattagactgtgcatcatggtcggcgccaatgcctccgaccggatggggatgggaaccacataccttgctctgatggccacgtttaagatgcgccctatgttcgcggtgggcctcctgtttagacggctcacctctcgcgaagtgctgcttctgacaattgggctcagcctggtcgcttccgttgagctgcccaactctcttgaagagctgggagatggcctcgccatggggatcatgatgctgaaactcctgaccgaattccaaccccaccagctttggacaaccctgctcagcctgacgtttgtgaagacaaccctgtcccttgactatgcctggaaaaccacagctatggtgctgagcattgtctctctcttccctctgtgtctctccaccacaagccagaagacgacctggctgccggtgcttctgggatcttttggctgcaaacccctgacaatgttcctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttacgtcatcagcggctccagcgccgacctgtctctggaaaaggctgccgaggtgagctgggaacaggaggctgaacattccggggcctctcacaatattctcgttgaggtgcaagatgacggaacaatgaaaatcaaggatgaggaacgggacgataccctgacgattcttctgaaagccaccctcctggctgtcagcggcgtgtatcccatgtccatccctgcgacactcttcgtctggtacttttggcagaagaaaaagcagcgctctggcgtgctgtgggacacccccagcccgcctgaggttgaaagagccgtgcttgatgacgggatttatcggatcctgcagcgcggactgctcggcagatcccaagtcggggtgggagttttccaggatggcgtgtttcatacaatgtggcacgtcacccggggggctgtgctgatgtaccagggaaagagacttgagccctcttgggccagcgtgaaaaaggacctgatctcctatggcggcgggtggcgcttccagggaagctggaacacaggcgaggaagttcaagtcattgccgtggagcctgggaaaaatcccaagaacgtgcagacgaccccgggaacatttaaaacccctgaaggcgaggtcggggctatcgccctcgacttcaagcccggaacctctggctcccctattgtgaatcgggaagagaagatcgttggcctgtacgggaacggagtggtcacaacgagcggcacctacgtgtctgcgattgctcaggccaaagcctcccaagaggggcccctccccgaaatcgaggatgaagtttttaagaaaagaaatctgacaattatggaccttcaccctggaagcggcaagacccgccggtatctgccggctatcgtgagagaggccatcaaacgcaagctgcggacactcattctggcgcccaccagagtcgtggcttccgaaatggccgaggcccttaaggggatgcctatccgctaccagacgacagctgttaaatctgagcataccggccgggaaattgtggatctgatgtgccacgccaccttcacaatgagactcctgagccccgtccgggtgcctaactataatatgatcattatggacgaggctcattttaccgatcccgcctccatcgcggcccgcggatacatcagcacaagagtgggcatgggggaagctgccgctattttcatgaccgccacgcctccgggatctgtcgaggcctttccccagtccaacgctgttatccaggacgaagagcgggatattcctgagcgcagctggaattctggctatgactggatcacagatttccccgggaagaccgtgtggttcgtgcctagcattaaatccggaaacgacatcgcgaattgtctgagaaagaacggcaaacgggtcatccaactctctagaaagacatttgataccgaataccagaagacgaaaaacaatgactgggactatgtggttaccacagatattagcgagatgggggccaacttccgcgctgaccgggtgatcgatcccagacgctgccttaagccggtcattctgaaagacggccctgaacgggtgatcctggccggacccatgcccgttaccgtggcctccgctgcccagagacgcggccggattgggagaaatcagaacaaggagggagatcaatacgtctacatgggccagcctctcaataacgacgaggatcacgcgcattggacagaagctaaaatgctgcttgacaatatcaacacccccgaggggattatccctgccctgtttgaaccggagcgcgaaaagtctgccgctatcgatggagagtatagactccggggcgaggcccgcaagacattcgtggaactgatgagacggggggacctgcccgtctggctcagctacaaagtggcgtccgagggctttcagtatagcgatcgcagatggtgcttcgacggagaacggaataaccaggttcttgaggaaaatatggatgtggagatttggaccaaggagggcgaaagaaaaaagctgcgccctcggtggctggacgccagaacgtactctgaccccctcgctctgcgcgagtttaaagaattcgccgctgggcggagatccgtgagcggagatcttatcctggagattggcaagctccctcaacacctgacactgcgggcccagaacgctctcgacaatcttgtcatgctgcacaactccgaacaggggggaaaagcctatcgccatgcgatggaggagctgcccgataccatcgaaaccctcatgctgcttgccctgattgctgttctcacaggcggcgtgaccctgtttttcctgtctgggaagggactcggcaagacaagcatcgggcttctgtgtgtgacggcctcctctgctctgctctggatggccagcgtcgagccgcactggatcgccgcttccattatcctggaatttttccttatggtgctgctcattcctgagcccgacagacagcggacccctcaagataatcagctggcgtacgttgtgatcggactgctctttatgattcttacagtcgccgctaacgagatgggcctgctggaaaccacaaaaaaggacctcgggatcggatatgtggccgccgagaaccatcagcacgctaccatgctggatgtcgaccttcaccccgccagcgcgtggacgctgtacgccgtggctaccacagttatcacccctatgatgcgccatacaattgaaaataccacggccaacatctctctcacagctattgccaatcaagcggccatcctgatgggcctggataaaggctggcccatttccaagatggacatcggggtgccgctccttgctctgggatgctacagccaggtcaaccctctgaccctcacagccgctgtgctgatgcttgttgcccactatgctattatcggccccgggctgcaggccaaagcgaccagagaggcccagaagcggaccgctgccggaatcatgaagaatcccacagtggatggcattgtcgctatcgacctcgatcctgtggtgtacgacgccaaattcgaaaagcaactggggcagattatgctgctcatcctttgtacgtctcagattctgctgatgcgcaccacatgggccctctgcgagtccatcaccctggcgacaggaccgcttaccacgctgtgggagggcagccccggcaaattctggaacacaaccatcgctgtttctatggccaatatttttagagggagctatctcgctggagccggcctggccttctccctgatgaagtctctcgggggaggccggcgcgggaccggagctcagggcgaaacacttggcgagaaatggaagagacaactgaaccagctgagcaagtccgaatttaatacctacaaacggagcgggatcatggaggtcgacagatccgaagccaaggagggactcaaacgcggcgagacaacgaagcatgcggtgtctcgggggaccgccaaactgagatggttcgtggaacgcaaccttgtcaagcctgagggaaaggttattgatctgggctgtgggcggggaggctggagctattactgcgctggcctcaaaaaggtgacagaagtgaaagggtataccaagggaggccccgggcacgaggaacctatccccatggccacatacggatggaatctggtcaaactgcattccggcaaggacgtgtttttcatgcctccggagaaatgtgataccctcctttgcgacattggggagtctagccccaaccctacgatcgaagagggaagaaccctgcgcgttctgaagatggtggaaccctggctccggggcaatcagttttgtatcaagattctgaacccttacatgccctccgtcgtggagacacttgagcagatgcaaagaaaacacggcgggatgctggttcgcaatccgctctctcggaacagcacccacgaaatgtattgggtgtcctgcggaacaggcaatatcgtcagcgctgtgaacatgacctctagaatgctgctgaaccgcttcacaatggcccatcggaagcctacctacgagagagatgtggacctcggggcgggaacgcgccacgtcgccgttgaacccgaggtggctaatctggatattatcggccagagaattgaaaacatcaaaaatgagcataagtccacatggcactatgacgaggataacccctacaaaacctgggcctatcacgggagctacgaagtgaagccttctggatccgctagctctatggtcaatggcgtggttcggcttctgaccaagccctgggacgtgattcctatggtcacacagatcgccatgacggataccacaccgtttggccaacagcgcgtgttcaaagagaaggttgacaccagaacaccccgggctaaaagagggaccacacagatcatggaagtgaccgccaagtggctctggggatttctgtcccggaacaaaaagcctcgcatttgtacgagagaggaattcacccggaaggtccgcagcaatgcggccatcggcgctgtgtttgttgacgagaaccagtggaattccgccaaagaggctgtggaagatgagagattctgggaccttgtccatcgggaacgcgagctgcacaagcaagggaaatgcgccacatgcgtgtataacatgatgggaaagagagaaaaaaagctcggcgagttcgggaaggccaaaggcagccgggcgatttggtacatgtggctgggagctcgctttctggagttcgaagccctcggctttatgaatgaggatcattggttctctagagaaaacagcctgtccggggtcgagggagagggccttcacaagctggggtacatcctccgggacatttctaaaatccccggaggcaatatgtatgccgatgacaccgctgggtgggatacacgcatcaccgaagacgatctgcagaacgaggccaagattacggacatcatggaacctgagcatgctcttctggccacaagcatttttaaactcacctaccagaataaggtggttagagtgcagcggcccgcgaaaaacggcacagtcatggatgtgatctcccgcagagaccaacggggatctggccaggtggggacctatggactgaacacgttcaccaatatggaagttcagctgattagacagatggagagcgagggcatctttctcccgtccgaactggagacacctaaccttgccgaacgcgctctggattggctcgagaagcacggggccgaacggctgaagagaatggctatctctggagacgactgtgtggtcaaacccattgatgaccgcttcgccaccgcgcttacagccctgaatgatatgggcaaggtgcggaaagacatccctcaatgggagcccagcaaggggtggaacgattggcagcaggttcctttttgctcccaccatttccaccagctcattatgaaagacggcagagagatcgtggtcccctgtcgcaatcaagatgaactggtgggacgggctagagtcagccagggcgccgggtggtctctgcgcgagaccgcttgcctcggaaagtcctacgcccagatgtggcaactgatgtattttcatcggagagaccttcgcctggctgccaacgcgatttgtagcgccgtgccggttgattgggtgcctgcttctcggacaacctggtccatccacgcccaccatcagtggatgacgacagaagacatgctcagcgtctggaatagagtgtggatcgaggaaaacccctggatggaggataagacccacgtttcctcttgggaggaagtgccctacctgggcaaacgggaggaccagtggtgcgggagccttattggactgaccgccagagctacatgggccaccaatatccaggtcgcgattaaccaagtgcgccggctcatcggcaatgaaaactatctggactacatgacatccatgaagagattcaaaaatgagagcgatcctgagggggctctgtggtga

SEQ ID NO: 19401 - RNA, 9879 nt, synthetic construct
  misc_feature 1..9879: note = derived and/or modified CDS sequence (opt5) from DENV-1__KC692502__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaagggggtgtcctatgtcatgtgtacgggcagcttcaaactggaaaaggaggtggccgagacacagcacggaaccgttctggtgcaggtcaagtacgaaggcaccgacgcgccgtgcaaaattcctttttctacacaagatgagaagggggtgacccagaacggacggcttatcacagctaatcccatcgtgacggacaaagaaaagcctgttaacattgagaccgagccccccttcggcgaatcctatatcgtcgtgggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtcggcaagctcgtgcatcaggtttttgggaccgcctacggagtgctgttcagcggcgtctcctggacgatgaaaatcgggatcggcattcttctgacctggctcggactgaatagccgctctacatccctgagcatgacctgtatcgctgtgggcatggttacactttacctcggggtgatggtccaggccgattctggatgcgtgattaactggaagggccgggagctgaaatgtgggtccggaatctttgttaccaacgaagtgcacacatggaccgagcaatataagttccaggctgacagccctaagagactgtccgccgcgattggcaaagcctgggaggaaggggtctgcggcatccgctctgctacgcggctcgagaatattatgtggaagcagatcagcaacgaactgaatcatatccttctggagaacgatatgaaatttacagtggtggtcggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggttgaagactatggctttggcgtgttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtcaagacatgtacctggcccaagagccacacactgtggtctaacggagtgctggagtccgagatgatcatcccgaaaatttttggcgggcctatcagccaacataattaccggcccggatatttcacccagacggccggcccttggcacctcgggaagctggaacttgattttgacctgtgcgagggaaccacagttgtggtcgatgaacactgcggcaacagaggcccctctctccggaccacaaccgtgacggggaaaattatccatgagtggtgttgccgcagctgtacactgcctcccctgagattccggggagaggacggctgctggtacgggatggaaattagaccggttaaggagaaagaagagaatcttgtgcgctccatggtcagcgcgggatctggcgaagtggattcctttagcctcgggatcctgtgtgtttccatcatgattgaggaggtgatgcggtctagatggagccgcaagatgctgatgaccggaacactcgctgtcttcctgcttctgatcatgggccagctcacctggaacgacctgattagactgtgcatcatggtgggcgccaatgcctccgaccggatggggatgggaaccacataccttgctctgatggccacgtttaagatgcgccctatgttcgcggtgggcctcctgtttagacggctcacctctcgcgaagtcctgcttctgacaattgggctcagcctggttgcttccgtggagctgcccaactctcttgaagagctgggagatggcctcgccatggggatcatgatgctgaaactcctgaccgaattccaaccccaccagctttggacaaccctgctcagcctgacgtttgtgagaacaaccctgtcccttgactatgcctggaagaccacagctatggtcctgagcattgtgtctctcttccctctgtgtctctccaccacaagccagaaaacgacctggctgccggttcttctgggatcttttggctgcaagcccctgacaatgttcctcatcaccgagaacaaaatctggggccggaagtcctggcctctgaatgaggggattatggccatcggaattgtgagcatccttctgtcttccctcctgaagaacgatgtccccctcgctggccctctgattgccgggggaatgcttatcgcgtgttacgtgatcagcggctccagcgccgacctgtctctggaaaaagctgccgaggttagctgggaacaggaggctgaacattccggggcctctcacaatattctcgtggaggtccaagatgacggaacaatgaagatcaaagatgaggaacgcgacgataccctgacgattcttctgaaggccaccctcctggctgtgagcggcgtctatcccatgtccatccctgcgacactcttcgtgtggtacttttggcagaaaaagaaacagagatctggcgttctgtgggacacccccagcccgcctgagatggaacgggccgtgcttgatgacgggatttatcgcatcctgcagagaggactgctcggccggtcccaagtcggggtgggagttttccaggatggcgtgtttcatacaatgtggcacgtcaccagaggggctgtgctgatgtaccagggaaagcgccttgagccctcttgggccagcgtgaagaaagacctgatctcctatggcggcgggtggcggttccagggaagctggaacacaggcgaggaagttcaagtcattgccgtggagcctgggaagaatcccaaaaacgtgcagacgaccccgggaacatttaagacccctgaaggcgaggtcggggctatcgccctcgacttcaaacccggaacctctggctcccctattgtgaatagagaaggcaagatcgttgggctgtacggaaacggcgtggtcacaacgagcgggacctacgtgtctgcgattgctcaggccaaggcctcccaagagggacccctccccgagatcgaagatgaggtttttaaaaagcgcaatctgacaattatggaccttcaccctggcagcgggaaaacccggagatatctgccggctatcgtgcgcgaagccatcaagcggaaactgagaacactcattctggcgcccacccgcgtcgtggcttccgagatggccgaagcccttaagggcatgcctatccggtaccagacgacagctgttaagtctgagcataccggaagagagattgtggatctgatgtgccacgccaccttcacaatgcggctcctgagccccgtccgcgtgcctaactataatatgatcattatggacgaagctcattttaccgatcccgcctccatcgcggccagaggctacatcagcacacgggtggggatgggagaggctgccgctattttcatgaccgccacgcctccgggctctgtcgaagcctttccccagtccaacgctgttatccaggacgaggaacgcgatattcctgagagaagctggaattctgggtatgactggatcacagatttccccggaaaaaccgtgtggttcgtgcctagcattaagtccggcaacgacatcgcgaattgtctgcggaaaaacgggaagagagtcatccaactctctcgcaaaacatttgataccgagtaccagaagacgaagaacaatgactgggactatgtggttaccacagatattagcgaaatgggcgccaacttccgggctgacagagtgatcgatccccgccggtgccttaaaccggtcattctgaaggacggacctgagagagtgatcctggccggccccatgcccgttaccgtggcctccgctgcccagcgccgggggagaattggacgcaatcagaacaaagaaggcgatcaatacgtctacatggggcagcctctcaataacgacgaggatcacgcgcattggacagaggctaagatgctgcttgacaatatcaacacccccgaaggaattatccctgccctgtttgagccggaaagagagaaatctgccgctatcgatggcgaatatcggctccgcggggaggccagaaagacattcgtggagctgatgcggcgcggcgacctgcccgtctggctcagctacaaggtggcgtccgaaggatttcagtatagcgatagacggtggtgcttcgacggcgagagaaataaccaggttcttgaagagaatatggatgtggaaatttggaccaaagagggggagcgcaagaaactgcggcctagatggctggacgcccgcacgtactctgaccccctcgctctgcgggaatttaaggagttcgccgctggaagacggtccgtgagcggcgatcttatcctggaaattgggaaactccctcaacacctgacactgcgcgcccagaacgctctcgacaatcttgtcatgctgcacaactccgagcagggaggcaaggcctatagacatgcgatggaagagctgcccgataccatcgagaccctcatgctgcttgccctgattgctgttctcacaggcggggtgaccctgtttttcctgtctggaaaaggcctcgggaagacaagcatcggacttctgtgtgtgacggcctcctctgctctgctctggatggccagcgtcgaaccgcactggatcgccgcttccattatcctggagtttttccttatggtgctgctcattcctgaacccgaccggcagcgcacccctcaagataatcagctggcgtacgttgtgatcggcctgctctttatgattcttacagtcgccgctaacgagatggggctgctggagaccacaaagaaagacctcggaatcggctatgtggccgccgaaaaccatcagcacgctaccatgctggatgtcgaccttcaccccgccagcgcgtggacgctgtacgccgtggctaccacagttatcacccctatgatgagacatacaattgagaataccacggccaacatctctctcacagctattgccaatcaagcggccatcctgatgggcctggataaggggtggcccatttccaaaatggacatcggagtgccgctccttgctctgggctgctacagccaggtcaaccctctgaccctcacagccgctgtgctgatgcttgttgcccactatgctattatcgggcccggactgcaggccaaggcgacccgggaagcccagaaacgcaccgctgccggcatcatgaagaatcccacagtggatgggattgtcgctatcgacctcgatcctgtggtgtacgacgccaagttcgagaaacaactgggacagattatgctgctcatcctttgtacgtctcagattctgctgatgagaaccacatgggccctctgcgaatccatcaccctggcgacaggcccgcttaccacgctgtgggagggcagccccgggaagttctggaacacaaccatcgctgtttctatggccaatatttttcggggaagctatctcgctggcgccgggctggccttctccctgatgaaatctctcggaggcgggcgcagaggaaccggcgctcagggcgagacacttggggaaaagtggaaacggcaactgaaccagctgagcaagtccgagtttaatacctacaagagaagcggaatcatggaagtcgaccgctccgaggccaaagaaggcctcaagcggggggagacaacgaaacatgcggtgtctagaggaaccgccaagctgcgctggttcgtggagcggaaccttgtcaaacctgaaggcaaggttattgatctggggtgtggaagaggcggctggagctattactgcgctgggctcaagaaagtgacagaggtgaagggatataccaaaggcgggcccggacacgaagagcctatccccatggccacatacggctggaatctggtcaagctgcattccgggaaagacgtgtttttcatgcctccggaaaagtgtgataccctcctttgcgacattggagagtctagccccaaccctacgatcgaggaaggccgcaccctgcgggttctgaaaatggtggagccctggctcagaggcaatcagttttgtatcaagattctgaacccttacatgccctccgtcgtggaaacacttgagcagatgcaacgcaagcacgggggaatgctggttcggaatccgctctctagaaacagcacccacgagatgtattgggtgtcctgcggcacagggaatatcgtcagcgctgtgaacatgacctctcgcatgctgctgaaccggttcacaatggcccatagaaaacctacctacgaacgcgatgtggacctcggagcgggcacgagacacgtcgccgttgagcccgaagtggctaatctggatattatcgggcagcggattgagaacatcaagaatgaacataaatccacatggcactatgacgaggataacccctacaagacctgggcctatcacggaagctacgaggtgaaaccttctggctccgctagctctatggtcaatggcgtggttcgccttctgaccaagccctgggacgtgattcctatggtcacacagatcgccatgacggataccacaccgtttgggcaacagagagtgttcaaggaaaaagttgacacccggacacccagagctaagcggggaaccacacagatcatggaggtgaccgccaaatggctctggggctttctgtcccgcaacaagaaacctagaatttgtacgcgggaagagttcacccgcaaggtcagaagcaatgcggccatcggggctgtgtttgttgacgaaaaccagtggaattccgccaaggaggctgtggaggatgaacggttctgggaccttgtccatcgcgagagagaactgcacaaacaaggaaagtgcgccacatgcgtgtataacatgatgggcaaacgggagaagaaactcggggaattcggcaaggccaagggaagccgcgcgatttggtacatgtggctgggcgctagatttctggagttcgaggccctcgggtttatgaatgaagatcattggttctctcgggagaacagcctgtccggagtcgaaggcgaggggcttcacaaactgggatacatcctccgcgacatttctaagatccccggcgggaatatgtatgccgatgacaccgctggctgggatacaagaatcaccgaggacgatctgcagaacgaagccaaaattacggacatcatggagcctgaacatgctcttctggccatgagcatttttaagctcacataccagaataaagtggttcgggtgcagcgccccgcgaagaacggaaccgtcatggatgtgatctccagacgggaccaaagaggctctgggcaggtgggaacatatggcctgaacaccttcacgaatatggaggttcagctgattcgccagatggaaagcgaggggatctttctcccgtccgagctggaaacccctaaccttgccgagcgggctctggattggctcgaaaaacacggagccgagagactgaagcgcatggctatctctggcgacgactgtgtggtcaagcccattgatgaccggttcgccacagcgcttaccgccctgaatgatatggggaaagtgagaaaggacatccctcaatgggaacccagcaaaggctggaacgattggcagcaggttcctttttgctcccaccatttccaccagctcattatgaaggacggacgcgagatcgtggtcccctgtcggaatcaagatgagctggtgggcagagctcgcgtcagccagggggccggatggtctctgcgggaaacagcttgcctcggcaaatcctacgcccagatgtggcaactgatgtattttcatagacgcgaccttcggctggctgccaacgcgatttgtagcgccgtgccggttgattgggtgcctgcttctagaaccacatggtccatccacgcccaccatcagtggatgaccacggaggacatgctcagcgtctggaatcgggtgtggatcgaagagaacccctggatggaagataagacacacgtttcctcttgggaggaggtgccctacctggggaagagagaagaccagtggtgcggaagccttattggcctgaccgcccgcgctacctgggccacaaatatccaggtcgcgatttcccaagtgcggagactcatcgggaacgagaattatctggactacatgaccagcatgaaacgcttcaagaacgaatctgatcctgagggcgctctgtggtga

SEQ ID NO: 19402 - RNA, 9879 nt, synthetic construct
  misc_feature 1..9879: note = derived and/or modified CDS sequence (opt5) from DENV-1__KC692503__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggatcggctgaccctcaaagggatgtcctatgtgatgtgtacgggcagcttcaagctggaaaaagaggtcgccgagacacagcacggaaccgtgctggttcaggtgaagtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatttgcgaccaccgccttatgtccgcggccatcaaagatagcaaggctgtgcatgccgacatggggtattggattgagtctgaaaaaaatgagacctggaagctcgcccgggcttccttcatcgaagtgaaaacatgtacctggcccaagagccacacactgtggtctaacggagtcctggagtccgagatgatcattccgaagatctttggcgggcctattagccaacataattacagacccggatatttcacccagacggccggcccttggcacctcgggaaactggaacttgattttgacctgtgcgagggaaccacagtggttgtggatgaacactgcggcaaccggggcccctctctccgcaccacaaccgtcacggggaagatcattcatgagtggtgttgcagaagctgtacactgcctcccctgcggttcagaggagaggacggctgctggtacgggatggaaatccgcccggtgaaagagaaggaagagaatcttgttcggtccatggtgagcgcgggatctggcgaagtcgattcctttagcctcgggatcctgtgtgtgtccattatgatcgaggaggttatgagatctcgctggagcagaaaaatgctgatgattggaaccctcgctgtgttcctgcttctgatcatgggccagctcacatggaacgacctgattcggctgtgcatcatggtcggcgccaatgcctccgaccgcatggggatgggaaccacctaccttgctctgatggccacatttaagatgagacctatgttcgcggtgggcctcctgtttcggcgcctcacgtctagagaagtgctgcttctgaccattgggctcagcctggtcgcttccgttgagctgcccaactctcttgaagagctgggagatggcctcgccatggggatcatgatgctgaagctcctgacagaattccaaccccaccagctttggaccacactgctcagcctgacctttgtgaaaacgacactgtcccttgactatgcctggaagaccaccgctatggtgctgagcatcgtctctctcttccctctgtgtctctccacaaccagccagaaaacaacgtggctgccggtgcttctgggatcttttggctgcaagcccctgaccatgttcctcattacagagaacaaaatctggggccggaagtcctggcctctgaatgaggggattatggccatcggaattgttagcatccttctgtcttccctcctgaagaacgatgtgcccctcgctggccctctgatcgccgggggaatgcttattgcgtgttacgtcatcagcggctccagcgccgacctgtctctggaaaaagctgccgaggtgagctgggaacaggaggctgaacattccggggcctctcacaatattctcgttgaggtgcaagatgacggaaccatgaagatcaaagatgaggaacgcgacgatacactgaccattcttctgaaggccacgctcctggctgtcagcggcgtgtatcccatgtccatccctgcgaccctcttcgtctggtacttttggcagaaaaagaaacagagatctggcgtgctgtgggacacacccagcccgcctgaggttgaacgggccgtgcttgatgacgggatctatcgcattctgcagagaggactgctcggccggtcccaagtcggggtgggagttttccaggatggcgtgtttcataccatgtggcacgtcacaagaggggctgtgctgatgtaccagggaaagcgccttgagccctcttgggccagcgtgaagaaagacctgatctcctatggcggcgggtggcggttccagggaagctggaacaccggcgaggaagttcaagtcattgccgtggagcctgggaagaatcccaaaaacgtgcagacaacgccgggaacctttaagacacctgaaggcgaggtcggggctatcgccctcgacttcaaacccggaacctctggctcccctattgtgaatagagaagagaagatcgttggcctgtacgggaacggagtggtcaccacaagcggcacgtacgtgtctgcgattgctcaggccaaggcctcccaagaggggcccctccccgaaatcgaggatgaagtttttaaaaagcgcaatctgaccatcatggaccttcaccctggaagcggcaaaacacggagatatctgccggctattgtgcgcgaggccatcaagcggaaactgagaaccctcattctggcgcccacacgcgtcgtggcttccgaaatggccgaggcccttaaggggatgcctatccggtaccagaccacggctgttaagtctgagcatacaggcagagaaattgtggatctgatgtgccacgccaccttcaccatgcggctcctgagccccgtccgcgtgcctaactataatatgatcatcatggacgaggctcattttacagatcccgcctccattgcggccagaggatacatcagcacccgggtgggcatgggggaagctgccgctattttcatgacagccacccctccgggatctgtcgaggcctttccccagtccaacgctgttatccaggacgaagagcgcgatattcctgagagaagctggaattctggctatgactggatcacggatttccccgggaaaacagtgtggttcgtgcctagcatcaagtccggaaacgacattgcgaattgtctgcggaaaaacggcaagagagtcatccaactctctcgcaaaacctttgatacagaataccagaagaccaagaacaatgactgggactatgtggttacgaccgatattagcgagatgggggccaacttccgggctgacagagtgatcgatccccgccggtgccttaaaccggtcattctgaaggacggccctgaaagagtgatcctggccggacccatgcccgttacagtggcctccgctgcccagcgccggggcagaattgggcgcaatcagaacaaagagggagatcaatacgtctacatgggccagcctctcaataacgacgaggatcacgcgcattggaccgaagctaagatgctgcttgacaatatcaacacacccgaggggatcattcctgccctgtttgaaccggagagagaaaaatctgccgctatcgatggagagtatcggctccgcggcgaggccagaaagaccttcgtggaactgatgcggcgcggggacctgcccgtctggctcagctacaaggtggcgtccgagggctttcagtatagcgatagacggtggtgcttcgacggagaaagaaataaccaggttcttgaggaaaatatggatgtggagatttggacaaaagagggcgaacgcaagaaactgcggcctagatggctggacgcccgcacctactctgaccccctcgctctgcgggagtttaaggaattcgccgctgggagacggtccgtgagcggagatcttatcctggagattggcaaactccctcaacacctgacgctgcgcgcccagaacgctctcgacaatcttgtcatgctgcacaactccgaacaggggggaaaggcctatagacatgcgatggaggagctgcccgatacaatcgaaaccctcatgctgcttgccctgatcgctgttctcaccggcggcgtgacactgtttttcctgtctgggaaaggactcggcaagaccagcattgggcttctgtgtgtgacagcctcctctgctctgctctggatggccagcgtcgagccgcactggatcgccgcttccattatcctggaatttttccttatggtgctgctcattcctgagcccgaccggcagcgcacgcctcaagataatcagctggcgtacgttgtgatcggactgctctttatgatccttaccgtcgccgctaacgagatgggcctgctggaaacaaccaagaaagacctcgggattggatatgtggccgccgagaaccatcagcacgctacaatgctggatgtcgaccttcaccccgccagcgcgtggaccctgtacgccgtggctacgaccgttatcacacctatgatgagacataccattgaaaatacaaccgccaacatctctctcacggctattgccaatcaagcggccatcctgatgggcctggataagggctggcccatttccaaaatggacatcggggtgccgctccttgctctgggatgctacagccaggtcaaccctctgacactcaccgccgctgtgctgatgcttgttgcccactatgctatcattggccccgggctgcaggccaaggcgacacgggaggcccagaaacgcaccgctgccggaatcatgaagaatcccaccgtggatggcattgtcgctatcgacctcgatcctgtggtgtacgacgccaagttcgaaaaacaactggggcagattatgctgctcatcctttgtacatctcagatcctgctgatgagaacgacctgggccctctgcgagtccattacactggcgaccggaccgcttacaaccctgtgggagggcagccccggcaagttctggaacacgacaatcgctgtttctatggccaatatttttcgggggagctatctcgctggagccggcctggccttctccctgatgaaatctctcgggggaggccgcagagggaccggagctcagggcgaaacccttggcgagaagtggaaacggcaactgaaccagctgagcaagtccgaatttaatacatacaagagaagcgggatcatggaggtcgaccgctccgaagccaaagagggactcaagcggggcgagaccacaaaacatgcggtgtctagagggacggccaagctgcgctggttcgtggaacggaaccttgtcaaacctgagggaaaggttattgatctgggctgtgggagaggaggctggagctattactgcgctggcctcaagaaagtgaccgaagtgaaggggtatacaaaaggaggccccgggcacgaggaacctatccccatggccacctacggatggaatctggtcaagctgcattccggcaaagacgtgtttttcatgcctccggagaagtgtgatacactcctttgcgacatcggggagtctagccccaaccctaccattgaagagggacgcacgctgcgggttctgaaaatggtggaaccctggctcagaggcaatcagttttgtatcaagattctgaacccttacatgccctccgtcgtggagacccttgagcagatgcaacgcaagcacggcgggatgctggttcggaatccgctctctagaaacagcacacacgaaatgtattgggtgtcctgcggaaccggcaatatcgtcagcgctgtgaacatgacatctcgcatgctgctgaaccggttcaccatggcccatagaaaacctacatacgagcgcgatgtggacctcggggcgggaaccagacacgtcgccgttgaacccgaggtggctaatctggatattatcggccagcggattgaaaacatcaagaatgagcataaatccacgtggcactatgacgaggataacccctacaagacatgggcctatcacgggagctacgaagtgaaaccttctggatccgctagctctatggtcaatggcgtggttcgccttctgaccaagccctgggacgtgatccctatggtcacccagattgccatgacagatacgaccccgtttggccaacagagagtgttcaaggagaaagttgacacacggacccccagagctaagcgggggacaacccagatcatggaagtgacagccaaatggctctggggatttctgtcccgcaacaagaaacctagaatttgtacccgggaggaattcacgcgcaaggtcagaagcaatgcggccatcggcgctgtgtttgttgacgagaaccagtggaattccgccaaggaggctgtggaagatgagcggttctgggaccttgtccatcgcgaaagagagctgcacaaacaagggaagtgcgccacctgcgtgtataacatgatgggaaaacgggaaaagaaactcggcgagttcgggaaggccaagggcagccgcgcgatttggtacatgtggctgggagctagatttctggagttcgaagccctcggctttatgaatgaggatcattggttctctcgggaaaacagcctgtccggggtcgagggagagggccttcacaaactggggtacatcctccgcgacatctctaagattcccggaggcaatatgtatgccgatgacacagctgggtgggataccagaatcacagaagacgatctgcagaacgaggccaaaattaccgacatcatggaacctgagcatgctcttctggccacgagcatttttaagctcacataccagaataaagtggttcgggtgcagcgccccgcgaagaacggcaccgtcatggatgtgatctccagacgggaccaaagaggatctggccaggtggggacatatggactgaacaccttcacgaatatggaagttcagctgatccgccagatggagagcgagggcatttttctcccgtccgaactggagacccctaaccttgccgaacgggctctggattggctcgagaaacacggggccgaaagactgaagcgcatggctatctctggagacgactgtgtggtcaagcccattgatgaccggttcgccacagcgcttaccgccctgaatgatatgggcaaagtgagaaaggacatccctcaatgggagcccagcaaagggtggaacgattggcagcaggttcctttttgctcccaccatttccaccagctcattatgaaggacggccgcgagatcgtggtcccctgtcggaatcaagatgaactggtgggaagagctcgcgtcagccagggcgccgggtggtctctgcgggagacagcttgcctcggaaaatcctacgcccagatgtggcaactgatgtattttcatagacgcgaccttcggctggctgccaacgcgatctgtagcgccgtgccggttgattgggtgcctgcttctagaaccacatggtccattcacgcccaccatcagtggatgaccacggaagacatgctcagcgtctggaatcgggtgtggatcgaggaaaacccctggatggaggataagacacacgtttcctcttgggaggaagtgccctacctgggcaagagagaggaccagtggtgcgggagccttattggactgaccgcccgcgctacctgggccacaaatatccaggtcgcgattaaccaagtgcggagactcatcggcaatgaaaactatctggactacatgacctccatgaaacgcttcaagaatgagagcgatcctgagggggctctgtggtga

SEQ ID NO: 19403 - RNA, 9879 nt, synthetic construct
  misc_feature 1..9879: note = derived and/or modified CDS sequence (opt5) from DENV-1__KC692504__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcatgaaccctgccgttctgagaaagctttgcattgaggcgaaaatctctaatacaaccacggattcccggtgtccgacacaaggagaagccaccctggtggaggagcaggacgctaactttgtgtgccgcagaaccttcgtcgatcggggctggggcaatgggtgtggactctttggcaaggggagcctgcttacatgcgccaaattcaagtgcgtgaccaagctggaaggaaaaattgttcagtacgagaacctcaagtattctgtgatcgtcacagtgcacacgggcgaccagcatcaagttgggaatgaaaccacagagcacggaaccatcgctacaattaccccccaggcccctacgtccgaaatccagctgaccgattacggcgccctgacactcgactgtagcccccgcaccggcctggactttaacgagatggtgcttctgacaatgaaagagaagtcttggctcgtccataaacagtggttcctggatcttcctctgccctggacctccggggctagcacgtcccaagaaacatggaatagacaggacctcctggtgacctttaagacagcgcacgccaaaaagcaggaggtcgtggttctgggatctcaagaaggcgctatgcacaccgccctcaccggggccacagagattcagacgagcggaaccacaaccatcttcgctggccatctgaagtgccggcttaaaatggataagctgacactcaaagggatgtcctatgtgatgtgtaccggcagcttcaagctggaaaaagaggtcgccgagacgcagcacggaacagtgctggttcaggtgaagtacgaaggcaccgacgcgccgtgcaagattcctttttctacccaagatgagaaaggggtcacacagaacggaagacttatcaccgctaatcccatcgtgacagacaaggaaaaacctgtgaacattgagacggagccccccttcggcgaatcctatatcgttgtcggggccggagagaaggccctcaaactgagctggtttaagcgcggctctagcattgggaagatgttcgaagctaccgcccggggcgctagacgcatggccatcctgggagatacagcgtgggactttggctccattgggggagtgttcacctctgtgggcaaactcgtccatcaggtgtttgggacagcctacggagttctgttcagcggcgtgtcctggaccatgaagatcgggatcggcattcttctgacgtggctcggactgaatagccggtctacctccctgagcatgacatgtatcgctgtcggcatggtgaccctttacctcggggttatggtgcaggccgattctggatgcgtcattaactggaaaggcagagagctgaagtgtgggtccggaatctttgtgacaaacgaagttcacacctggacagagcaatataaattccaggctgacagccctaagcgcctgtccgccgcgattggcaaggcctgggaggaaggggtgtgcggcatccggtctgctaccagactcgagaatattatgtggaaacagatcagcaacgaactgaatcatatccttctggagaacgatatgaagtttacggtcgtggtgggagacgccaatggcattctcgctcaggggaaaaagatgatccgcccgcaacccatggaacacaaatactcctggaagtcttggggaaaagccaagattatcggcgccgacattcagaacacaaccttcatcatcgatgggcctgacacccccgagtgtcctgatggacagcgggcttggaatatttgggaggtcgaagactatggctttggcgttttcacaaccaacatctggctgaagctgagagatagctacacgcagatgtgcgaccaccgccttatgtccgcggccattaaagatagcaaggctgtgcatgccgacatggggtattggatcgagtctgaaaaaaatgagacatggaagctcgcccgggcttccttcattgaagtgaaaacctgtacatggcccaagagccacaccctgtggtctaacggagtcctggagtccgagatgatcatcccgaagatttttggcgggcctatcagccaacataattacagacccggatatttcacacagaccgccggcccttggcacctcgggaaactggaacttgattttgacctgtgcgagggaacgaccgtggttgtggatgaacactgcggcaaccggggcccctctctccgcacaaccacagtcaccgggaagattatccatgagtggtgttgcagaagctgtacgctgcctcccctgcggttcagaggagaggacggctgctggtacgggatggaaattcgcccggtgaaagagaaggaagagaatcttgttcggtccatggtgagcgcgggatctggcgaagtcgattcctttagcctcgggatcctgtgtgtgtccatcatgattgaggaggttatgagatctcgctggagcagaaaaatgctgatgacaggaaccctcgctgtgttcctgcttctgatcatgggccagctcacatggaacgacctgattcggctgtgcatcatggtcggcgccaatgcctccgaccgcatggggatgggaaccacctaccttgctctgatggccacatttaagatgagacctatgttcgcggtgggcctcctgtttcggcgcctcacgtctagagaagtgctgcttctgaccattgggctcagcctggtcgcttccgttgagctgcccaactctcttgaagagctgggagatggcctcgccatggggatcatgatgctgaagctcctgacagaattccaaccccaccagctttggaccacactgctcagcctgacctttgtgaaaacgacactgtcccttgactatgcctggaagaccaccgctatggtgctgagcattgtctctctcttccctctgtgtctctccacaaccagccagaaaacaacgtggctgccggtgcttctgggatcttttggctgcaagcccctgaccatgttcctcatcacagagaacaaaatctggggccggaagtcctggcctctgaatgaggggattatggccatcggaattgttagcatccttctgtcttccctcctgaagaacgatgtgcccctcgctggccctctgattgccgggggaatgcttatcgcgtgttacgtcatcagcggctccagcgccgacctgtctctggaaaaagctgccgaggtgagctgggaacaggaggctgaacattccggggcctctcacaatattctcgttgaggtgcaagatgacggaaccatgaagatcaaagatgaggaacgcgacgatacactgaccattcttctgaaggccacgctcctggctgtcagcggcgtgtatcccatgtccatccctgcgaccctcttcgtctggtacttttggcagaaaaagaaacagagatctggcgtgctgtgggacacacccagcccgcctgaggttgaacgggccgtgcttgatgacgggatttatcgcatcctgcagagaggactgctcggccggtcccaagtcggggtgggagttttccaggatggcgtgtttcataccatgtggcacgtcacaagaggggctgtgctgatgtaccagggaaagcgccttgagccctcttgggccagcgtgaagaaagacctgatctcctatggcggcgggtggcggttccagggaagctggaacaccggcgaggaagttcaagtcattgccgtggagcctgggaagaatcccaaaaacgtgcagacaacgccgggaacctttaagacacctgaaggcgaggtcggggctatcgccctcgacttcaaacccggaacctctggctcccctattgtgaatagagaaggcaagatcgttgggctgtacggaaacggcgtggtcaccacaagcgggacgtacgtgtctgcgattgctcaggccaaggcctcccaagagggacccctccccgagatcgaagatgaggtttttaaaaagcgcaatctgaccattatggaccttcaccctggcagcgggaaaacacggagatatctgccggctatcgtgcgcgaagccatcaagcggaaactgagaaccctcattctggcgcccacacgcgtcgtggcttccgagatggccgaagcccttaagggcatgcctatccggtaccagaccacggctgttaagtctgagcatacaggaagagagattgtggatctgatgtgccacgccaccttcaccatgcggctcctgagccccgtccgcgtgcctaactataatatgatcattatggacgaagctcattttacagatcccgcctccatcgcggccagaggctacatcagcacccgggtggggatgggagaggctgccgctattttcatgacagccacccctccgggctctgtcgaagcctttccccagtccaacgctgttatccaggacgaggaacgcgatattcctgagagaagctggaattctgggtatgactggatcacggatttccccggaaaaacagtgtggttcgtgcctagcattaagtccggcaacgacatcgcgaattgtctgcggaaaaacgggaagagagtcatccaactctctcgcaaaacctttgatacagagtaccagaagaccaagaacaatgactgggactatgtggttacgaccgatattagcgaaatgggcgccaacttccgggctgacagagtgatcgatccccgccggtgccttaaaccggtcattctgaaggacggacctgagagagtgatcctggccggccccatgcccgttacagtggcctccgctgcccagcgccgggggagaattggacgcaatcagaacaaagaaggcgatcaatacgtctacatggggcagcctctcaataacgacgaggatcacgcgcattggaccgaggctaagatgctgcttgacaatatcaacacacccgaaggaattatccctgccctgtttgagccggaaagagagaaatctgccgctatcgatggcgaatatcggctccgcggggaggccagaaagaccttcgtggagctgatgcggcgcggcgacctgcccgtctggctcagctacaaggtggcgtccgaaggatttcagtatagcgatagacggtggtgcttcgacggcgagagaaataaccaggttcttgaagagaatatggatgtggaaatttggacaaaagagggggagcgcaagaaactgcggcctagatggctggacgcccgcacctactctgaccccctcgctctgcgggaatttaaggagttcgccgctggaagacggtccgtgagcggcgatcttatcctggaaattgggaaactccctcaacacctgacgctgcgcgcccagaacgctctcgacaatcttgtcatgctgcacaactccgagcagggaggcaaggcctatagacatgcgatggaagagctgcccgatacaatcgagaccctcatgctgcttgccctgattgctgttctcaccggcggggtgacactgtttttcctgtctggaaaaggcctcgggaagaccagcatcggacttctgtgtgtgacagcctcctctgctctgctctggatggccagcgtcgaaccgcactggatcgccgcttccattatcctggagtttttccttatggtgctgctcattcctgaacccgaccggcagcgcacgcctcaagataatcagctggcgtacgttgtgatcggcctgctctttatgattcttaccgtcgccgctaacgagatggggctgctggagacaaccaagaaagacctcggaatcggctatgtggccgccgaaaaccatcagcacgctacaatgctggatgtcgaccttcaccccgccagcgcgtggaccctgtacgccgtggctacgaccgttatcacacctatgatgagacataccattgagaatacaaccgccaacatctctctcacggctattgccaatcaagcggccatcctgatgggcctggataaggggtggcccatttccaaaatggacatcggagtgccgctccttgctctgggctgctacagccaggtcaaccctctgacactcaccgccgctgtgctgatgcttgttgcccactatgctattatcgggcccggactgcaggccaaggcgacacgggaagcccagaaacgcaccgctgccggcatcatgaagaatcccaccgtggatgggattgtcgctatcgacctcgatcctgtggtgtacgacgccaagttcgagaaacaactgggacagattatgctgctcatcctttgtacatctcagattctgctgatgagaacgacctgggccctctgcgaatccatcacactggcgaccggcccgcttacaaccctgtgggagggcagccccgggaagttctggaacacgacaatcgctgtttctatggccaatgtctttcggggaagctatctcgctggcgccgggctggccttctccctgatgaaatctctcggaggcgggcgcagaggaaccggcgctcagggcgagacccttggggaaaagtggaaacggcaactgaaccagctgagcaagtccgagtttaatacatacaagagaagcggaattatggaagtggaccgctccgaggccaaagaaggcctcaagcggggggagaccacaaaacatgcggtgtctagaggaacggccaagctgcgctggttcgtcgagcggaaccttgttaaacctgaaggcaaggtgatcgatctggggtgtggaagaggcggctggagctattactgcgctgggctcaagaaagtgaccgaggtcaagggatatacaaaaggcgggcccggacacgaagagcctattcccatggccacctacggctggaatctggtgaagctgcattccgggaaagacgtttttttcatgcctccggaaaagtgtgatacactcctttgcgacatcggagagtctagccccaaccctaccattgaggaaggccgcacgctgcgggtgctgaaaatggtcgagccctggctcagaggcaatcagttttgtatcaagatcctgaacccttacatgccctccgtggttgaaacccttgagcagatgcaacgcaagcacgggggaatgctggtgcggaatccgctctctagaaacagcacacacgagatgtattgggtctcctgcggcaccgggaatattgtgagcgctgtgaacatgacatctcgcatgctgctgaaccggttcaccatggcccatagaaaacctacatacgaacgcgatgtcgacctcggagcgggcaccagacacgttgccgtggagcccgaagtggctaatctggatatcattgggcagcggatcgagaacattaagaatgaacataaatccacgtggcactatgacgaggataacccctacaagacatgggcctatcacggaagctacgaggtcaaaccttctggctccgctagctctatggtgaatggcgttgtgcgccttctgaccaagccctgggacgtcatccctatggtgacccagattgccatgacagatacgaccccgtttgggcaacagagagttttcaaggaaaaagtggacacacggacccccagagctaagcggggaacaacccagatcatggaggtcacagccaaatggctctggggctttctgtcccgcaacaagaaacctagaatctgtacccgggaagagttcacgcgcaaggtgagaagcaatgcggccattggggctgtttttgtggacgaaaaccagtggaattccgccaaggaggctgtcgaggatgaacggttctgggaccttgtgcatcgcgagagagaactgcacaaacaaggaaagtgcgccacctgcgtctataacatgatgggcaaacgggagaagaaactcggggaattcggcaaggccaagggaagccgcgcgatctggtacatgtggctgggcgctagatttctggagttcgaggccctcgggtttatgaatgaagatcattggttctctcgggagaacagcctgtccggagtggaaggcgaggggcttcacaaactgggatacattctccgcgacatctctaagattcccggcgggaatatgtatgccgatgacacagctggctgggataccagaatcacagaggacgatctgcagaacgaagccaaaatcaccgacattatggagcctgaacatgctcttctggccacgagcatctttaagctcacataccagaataaagttgtgcgggtccagcgccccgcgaagaacggaaccgtgatggatgtgatttccagacgggaccaaagaggctctgggcaggttggaacatatggcctgaacaccttcacgaatatggaggtgcagctgatccgccagatggaaagcgaggggatttttctcccgtccgagctggaaacccctaaccttgccgagcgggctctggattggctcgaaaaacacggagccgagagactgaagcgcatggctatctctggcgacgactgtgtcgtgaagcccatcgatgaccggttcgccacagcgcttaccgccctgaatgatatggggaaagttagaaaggacattcctcaatgggaacccagcaaaggctggaacgattggcagcaggtgcctttttgctcccaccatttccaccagctcatcatgaaggacggacgcgagattgtcgtgccctgtcggaatcaagatgagctggtcggcagagctcgcgtgagccagggggccggatggtctctgcgggaaacagcttgcctcggcaaatcctacgcccagatgtggcaactgatgtattttcatagacgcgaccttcggctggctgccaacgcgatctgtagcgccgttccggtggattgggtccctgcttctagaaccacatggtccattcacgcccaccatcagtggatgaccacggaggacatgctcagcgtgtggaatcgggtttggatcgaagagaacccctggatggaagataagacacacgtgtcctcttgggaggaggtcccctacctggggaagagagaagaccagtggtgcggaagccttatcggcctgaccgcccgcgctacctgggccacaaatattcaggtggcgatcaaccaagtgcggagactcattgggaatgagaactatctggactacatgacctccatgaaacgcttcaagaatgaaagcgatcctgagggcgctctgtggtga

SEQ ID NO: 19404 - RNA, 9879 nt, synthetic construct
  misc_feature 1..9879: note = derived and/or modified CDS sequence (opt5) from DENV-1__KC692508__SS-prME
  source 1..9879: mol_type = other RNA
agcgtgacaatgctgctcatgctgcttcccacagctctggctttccacctcacgacccggggcggggaacctcatatgatcgtctccaagcaggaacggggaaaatctctgctttttaagacaagcgccggcgttaatatgtgcaccctgattgcgatggacctcggggaactgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttttggcgggcctatcagccaacataattaccggcccggatatttcacccagacggccggcccttggcacctcgggaagctggaacttgattttgacctgtgcgagggaaccacagtggttgtggatgaacactgcggcaacagaggcccctctctccggaccacaaccgtcacggggaaaattatccatgagtggtgttgccgcagctgtacactgcctcccctgagattccggggagaggacggctgctggtacgggatggaaattagaccggtgaaggagaaagaagagaatcttgttcgctccatggtgagcgcgggatctggcgaagtcgattcctttagcctcgggatcctgtgtgtgtccatcatgattgaggaggttatgcggtctagatggagccgcaagatgctgatgaccggaacactcgctgtgttcctgcttctgatcatgggccagctcacctggaacgacctgattagactgtgcatcatggtcggcgccaatgcctccgaccggatggggatgggaaccacataccttgctctgatggccacgtttaagatgcgccctatgttcgcggtgggcctcctgtttagacggctcacctctcgcgaagtgctgcttctgacaattgggctcagcctggtcgcttccgttgagctgcccaactctcttgaagaactgggagatggcctcgccatggggatcatgatgctgaaactcctgaccgagttccaaccccaccagctttggacaaccctgctcagcctgacgtttgtgaagacaaccctgtcccttgactatgcctggaaaaccacagctatggtgctgagcattgtctctctcttccctctgtgtctctccaccacaagccagaagacgacctggctgccggtgcttctgggatcttttggctgcaaacccctgacaatgttcctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttacgtcatcagcggctccagcgccgacctgtctctggaaaaggctgccgaggtgagctgggaacaggaggctgaacattccggggcctctcacaatattctcgttgaggtgcaagatgacggaacaatgaaaatcaaggatgaggaacgggacgataccctgacgattcttctgaaagccaccctcctggctgtcagcggcgtgtatcccatgtccatccctgcgacactcttcgtctggtacttttggcagaagaaaaagcagcgctctggcgtgctgtgggacacccccagcccgcctgaggttgaaagagccgtgcttgatgacgggatttatcggatcctgcagcgcggactgctcggcagatcccaagtcggggtgggagttttccaggatggcgtgtttcatacaatgtggcacgtcaccagaggggctgtgctgatgtaccagggaaagagacttgagccctcttgggccagcgtgaaaaaggacctgatctcctatggcggcgggtggcgcttccagggaagctggaacacaggcgaggaagttcaagtcattgccgtggagcctgggaaaaatcccaagaacgtgcagacgaccccgggaacatttaaaacccctgaaggcgaggtcggggctatcgccctcgacttcaagcccggaacctctggctcccctattgtgaatcgggaaggcaagatcgttgggctgtacggaaacggcgtggtcacaacgagcgggacctacgtgtctgcgattgctcaggccaaagcctcccaagagggacccctccccgagatcgaagatgaggtttttaagaaaagaaatctgacaattatggaccttcaccctggcagcgggaagacccgccggtatctgccggctatcgtgagagaagccatcaaacgcaagctgcggacactcattctggcgcccaccagagtcgtggcttccgagatggccgaagcccttaagggcatgcctatccgctaccagacgacagctgttaaatctgagcataccggacgggagattgtggatctgatgtgccacgccaccttcacaatgagactcctgagccccgtccgggtgcctaactataatatgatcattatggacgaagctcattttaccgatcccgcctccatcgcggcccgcggctacatcagcacaagagtggggatgggagaggctgccgctattttcatgaccgccacgcctccgggctctgtcgaagcctttccccagtccaacgctgttatccaggacgaggaacgggatattcctgagcgcagctggaactctgggtatgactggatcacagatttccccggaaagaccgtgtggttcgtgcctagcattaaatccggcaacgacatcgcgaattgtctgagaaagaacgggaaacgggtcatccaactctctagaaagacatttgataccgagtaccagaagacgaaaaacaatgactgggactatgtggttaccacagatattagcgaaatgggcgccaacttccgcgctgaccgggtgatcgatcccagacgctgccttaagccggtcattctgaaagacggacctgagcgggtgatcctggccggccccatgcccgttaccgtggcctccgctgcccagagacgcgggcggattggaagaaatcagaacaaggaaggcgatcaatacgtctacatggggcagcctctcaataacgacgaggagcacgcgcattggacagaagctaaaatgctgcttgataatatcaacacccccgagggaattatccctgccctgtttgaaccggagcgcgaaaagtctgccgctatcgacggcgagtatagactccgcggggaagcccggaagacattcgtggaactgatgagacggggcgatctgcccgtctggctcagctacaaagtggcgtccgagggatttcagtatagcgaccgcagatggtgcttcgatggcgaacggaataaccaggttcttgaggaaaatatggacgtggagatttggaccaaggagggggaacgcaaaaagctgcgccctcggtggctggatgccagaacgtactctgaccccctcgctctgcgcgagtttaaagagttcgccgctggacggagatccgtgagcggcgaccttatcctggagattgggaagctccctcaacacctgacactgcgggcccagaacgctctcgataatcttgtcatgctgcacaactccgaacagggaggcaaagcctatcgccatgcgatggaggagctgcccgacaccatcgaaaccctcatgctgcttgccctgattgctgttctcacaggcggggtgaccctgtttttcctgtctggaaagggcctcgggaagacaagcatcggacttctgtgtgtgacggcctcctctgctctgctctggatggccagcgtcgagccgcactggatcgccgcttccattatcctggaatttttccttatggtgctgctcattcctgagcccgatagacagcggacccctcaagacaatcagctggcgtacgttgtgatcggcctgctctttatgattcttacagtcgccgctaacgagatggggctgctggaaaccaccaaaaaggatctcggaatcggctatgtggccgccgagaaccatcagcacgctaccatgctggacgtcgatcttcaccccgccagcgcgtggacgctgtacgccgtggctaccacagttatcacccctatgatgcgccatacaattgaaaataccacggccaacatctctctcacagctattgccaatcaagcggccatcctgatgggcctggacaaagggtggcccatttccaagatggatatcggagtgccgctccttgctctgggctgctacagccaggtcaaccctctgaccctcacagccgctgtgctgatgcttgttgcccactatgctattatcgggcccggactgcaggccaaagcgaccagagaggcccagaagcggaccgctgccggcatcatgaagaatcccacagtggacgggattgtcgctatcgatctcgaccctgtggtgtacgatgccaaattcgaaaagcaactgggacagattatgctgctcatcctttgtacgtctcagattctgctgatgcgcaccacatgggccctctgcgagtccatcaccctggcgacaggcccgcttaccacgctgtgggagggcagccccgggaaattctggaacacaaccatcgctgtttctatggccaatatttttagaggaagctatctcgctggcgccgggctggccttctccctgatgaagtctctcggaggcgggcggcgcggaaccggcgctcagggcgaaacacttggggagaaatggaagagacaactgaaccagctgagcaagtccgaatttaatacctacaaacggagcggaatcatggaggtcgacagatccgaagccaaggagggcctcaaacgcggggagacaacgaagcatgcggtgtctcggggaaccgccaaactgagatggttcgtggaacgcaaccttgtcaagcctgagggcaaggttattgacctggggtgtggacggggcggctggagctattactgcgctgggctcaaaaaggtgacagaagtgaaaggatataccaagggcgggcccggacacgaggaacctatccccatggccacatacggctggaatctggtcaaactgcattccgggaaggatgtgtttttcatgcctccggagaaatgtgacaccctcctttgcgatattggagagtctagccccaaccctacgatcgaagagggcagaaccctgcgcgttctgaagatggtggaaccctggctccggggcaatcagttttgtatcaagattctgaacccttacatgccctccgtcgtggagacacttgagcagatgcaaagaaaacacgggggaatgctggttcgcaatccgctctctcggaacagcacccacgaaatgtattgggtgtcctgcggcacagggaatatcgtcagcgctgtgaacatgacctctagaatgctgctgaaccgcttcacaatggcccatcggaagcctacctacgagagagacgtggatctcggagcgggcacgcgccacgtcgccgttgaacccgaggtggctaatctggacattatcgggcagagaattgaaaacatcaaaaatgagcataagtccacatggcactatgatgaggacaacccctacaaaacctgggcctatcacggaagctacgaagtgaagccttctggctccgctagctctatggtcaatggcgtggttcggcttctgaccaagccctgggatgtgattcctatggtcacacagatcgccatgacggacaccacaccgtttgggcaacagcgcgtgttcaaagagaaggttgataccagaacaccccgggctaaaagaggaaccacacagatcatggaagtgaccgccaagtggctctggtcctttctgagccggaacaaaaagcctcgcatttgtacgagagaggagttcacccggaaggtccgctccaatgcggccatcggcgctgtgtttgttgacgagaaccagtggaatagcgccaaagaggctgtggaagacgagagattctgggatcttgtccatcgggaacgcgagctgcacaagcaagggaaatgcgccacatgcgtgtataacatgatgggaaagagagagaaaaagctcggcgagttcgggaaggccaaaggctctcgggcgatttggtacatgtggctgggagctcgctttctggagttcgaagccctcggctttatgaatgaggaccattggttcagcagagaaaactccctgtctggggtcgagggagagggccttcacaagctggggtacatcctccgggatattagcaaaatccccggaggcaatatgtatgccgacgataccgctgggtgggacacacgcatcaccgaagatgacctgcagaacgaggccaagattacggatatcatggaacctgagcatgcccttctggccacatccatttttaaactcacctaccagaataaggtggttagagtgcagcggcccgcgaaaaacggcacagtcatggacgtgatctctcgcagagatcaacggggaagcggccaggtggggacctatggactgaacacgttcaccaatatggaagttcagctgattagacagatggagtccgagggcatctttctcccgtctgaactggagacacctaaccttgccgaacgcgctctggactggctcgagaagcacggggccgaacggctgaagagaatggctatcagcggagatgactgtgtggtcaaacccattgacgatcgcttcgccaccgcgcttacagccctgaatgacatgggcaaggtgcggaaagatatccctcaatgggagccctccaaggggtggaacgactggcagcaggttcctttttgcagccaccatttccaccagctcattatgaaagatggcagagagatcgtggtcccctgtcgcaatcaagacgaactggtgggacgggctagagtctctcagggcgccgggtggtccctgcgcgagaccgcttgcctcggaaagagctacgcccagatgtggcaactgatgtattttcatcggagagatcttcgcctggctgccaacgcgatttgttctgccgtgccggttgactgggtgcctgcttcccggacaacctggagcatccacgcccaccatcagtggatgacgacagaagatatgctctccgtctggaatagagtgtggatcgaggaaaacccctggatggaggacaagacccacgtttctagctgggaggaagtgccctacctgggcaaacgggaggatcagtggtgcgggtcccttattggactgaccgccagagctacatgggccaccaatatccaggtcgcgattaaccaagtgcgccggctcatcggcaatgaaaactatctggactacatgacaagcatgaagagattcaaaaatgagtctgaccctgagggggctctgtggtga

SEQ ID NO: 19405 - RNA, 9879 nt, synthetic construct
  misc_feature 1..9879: note = derived and/or modified CDS sequence (opt5) from DENV-1__KC692509__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaagggggtgtcctatgtcatgtgtacgggcagcttcaaactggaaaaggaggtggccgagacacagcacggaaccgttctggtgcaggtcaagtacgaaggcaccgacgcgccgtgcaaaattcctttttctacacaagatgagaagggggtgacccagaacggacggcttatcacagctaatcccatcgtgacggacaaagaaaagcctgttaacattgagaccgagccccccttcggcgaatcctatatcgtcgtgggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtcggcaagctcgtgcatcaggtttttgggaccgcctacggagtgctgttcagcggcgtctcctggacgatgaaaatcgggatcggcattcttctgacctggctcggactgaatagccgctctacatccctgagcatgacctgtatcgctgtgggcatggttacactttacctcggggtgatggtccaggccgattctggatgcgtgattaactggaagggccgggagctgaaatgtgggtccggaatctttgttaccaacgaagtgcacacatggaccgagcaatataagttccaggctgacagccctaagagactgtccgccgcgattggcaaagcctgggaggaaggggtctgcggcatccgctctgctacgcggctcgagaatattatgtggaagcagatcagcaacgaactgaatcatatccttctggagaacgatatgaaatttacagtggtggtcggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggttgaagactatggctttggcgtgttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtcaagacatgtacctggcccaagagccacacactgtggtctaacggagtgctggagtccgagatgatcatcccgaaaatttttggcgggcctatcagccaacataattaccggcccggatatttcacccagacggccggcccttggcacctcgggaagctggaacttgattttgacctgtgcgagggaaccacagttgtggtcgatgaacactgcggcaacagaggcccctctctccggaccacaaccgtgacggggaaaattatccatgagtggtgttgccgcagctgtacactgcctcccctgagattccggggagaggacggctgctggtacgggatggaaattagaccggttaaggagaaagaagagaatcttgtgcgctccatggtcagcgcgggatctggcgaagtggattcctttagcctcgggatcctgtgtgtttccatcatgattgaggaggtgatgcggtctagatggagccgcaagatgctgatgaccggaacactcgctgtcttcctgcttctgatcatgggccagctcacctggaacgacctgattagactgtgcatcatggtgggcgccaatgcctccgaccggatggggatgggaaccacataccttgctctgatggccacgtttaagatgcgccctatgttcgcggtgggcctcctgtttagacggctcacctctcgcgaagtcctgcttctgacaattgggctcagcctggttgcttccgtggagctgcccaactctcttgaagagctgggagatggcctcgccatggggatcatgatgctgaaactcctgaccgaattccaaccccaccagctttggacaaccctgctcagcctgacgtttgtgagaacaaccctgtcccttgactatgcctggaagaccacagctatggtcctgagcattgtgtctctcttccctctgtgtctctccaccacaagccagaaaacgacctggctgccggttcttctgggatcttttggctgcaagcccctgacaatgttcctcatcaccgagaacaaaatctggggccggaagtcctggcctctgaatgaggggattatggccatcggaattgtgagcatccttctgtcttccctcctgaagaacgatgtccccctcgctggccctctgattgccgggggaatgcttatcgcgtgttacgtgatcagcggctccagcgccgacctgtctctggaaaaagctgccgaggttagctgggaacaggaggctgaacattccggggcctctcacaatattctcgtggaggtccaagatgacggaacaatgaagatcaaagatgaggaacgcgacgataccctgacgattcttctgaaggccaccctcctggctgtgagcggcgtctatcccatgtccatccctgcgacactcttcgtgtggtacttttggcagaaaaagaaacagagatctggcgttctgtgggacacccccagcccgcctgagatggaacgggccgtgcttgatgacgggatttatcgcatcctgcagagaggactgctcggccggtcccaagtcggggtgggagttttccaggatggcgtgtttcatacaatgtggcacgtcaccagaggggctgtgctgatgtaccagggaaagcgccttgagccctcttgggccagcgtgaagaaagacctgatctcctatggcggcgggtggcggttccagggaagctggaacacaggcgaggaagttcaagtcattgccgtggagcctgggaagaatcccaaaaacgtgcagacgaccccgggaacatttaagacccctgaaggcgaggtcggggctatcgccctcgacttcaaacccggaacctctggctcccctattgtgaatagagaaggcaagatcgttgggctgtacggaaacggcgtggtcacaacgagcgggacctacgtgtctgcgattgctcaggccaaggcctcccaagagggacccctccccgagatcgaagatgaggtttttaaaaagcgcaatctgacaattatggaccttcaccctggcagcgggaaaacccggagatatctgccggctatcgtgcgcgaagccatcaagcggaaactgagaacactcattctggcgcccacccgcgtcgtggcttccgagatggccgaagcccttaagggcatgcctatccggtaccagacgacagctgttaagtctgagcataccggaagagagattgtggatctgatgtgccacgccaccttcacaatgcggctcctgagccccgtccgcgtgcctaactataatatgatcattatggacgaagctcattttaccgatcccgcctccatcgcggccagaggctacatcagcacacgggtggggatgggagaggctgccgctattttcatgaccgccacgcctccgggctctgtcgaagcctttccccagtccaacgctgttatccaggacgaggaacgcgatattcctgagagaagctggaattctgggtatgactggatcacagatttccccggaaaaaccgtgtggttcgtgcctagcattaagtccggcaacgacatcgcgaattgtctgcggaaaaacgggaagagagtcatccaactctctcgcaaaacatttgataccgagtaccagaagacgaagaacaatgactgggactatgtggttaccacagatattagcgaaatgggcgccaacttccgggctgacagagtgatcgatccccgccggtgccttaaaccggtcattctgaaggacggacctgagagagtgatcctggccggccccatgcccgttaccgtggcctccgctgcccagcgccgggggagaattggacgcaatcagaacaaagaaggcgatcaatacgtctacatggggcagcctctcaataacgacgaggatcacgcgcattggacagaggctaagatgctgcttgacaatatcaacacccccgaaggaattatccctgccctgtttgagccggaaagagagaaatctgccgctatcgatggcgaatatcggctccgcggggaggccagaaagacattcgtggagctgatgcggcgcggcgacctgcccgtctggctcagctacaaggtggcgtccgaaggatttcagtatagcgatagacggtggtgcttcgacggcgagagaaataaccaggttcttgaagagaatatggatgtggaaatttggaccaaagagggggagcgcaagaaactgcggcctagatggctggacgcccgcacgtactctgaccccctcgctctgcgggaatttaaggagttcgccgctggaagacggtccgtgagcggcgatcttatcctggaaattgggaaactccctcaacacctgacactgcgcgcccagaacgctctcgacaatcttgtcatgctgcacaactccgagcagggaggcaaggcctatagacatgcgatggaagagctgcccgataccatcgagaccctcatgctgcttgccctgattgctgttctcacaggcggggtgaccctgtttttcctgtctggaaaaggcctcgggaagacaagcatcggacttctgtgtgtgacggcctcctctgctctgctctggatggccagcgtcgaaccgcactggatcgccgcttccattatcctggagtttttccttatggtgctgctcattcctgaacccgaccggcagcgcacccctcaagataatcagctggcgtacgttgtgatcggcctgctctttatgattcttacagtcgccgctaacgagatggggctgctggagaccacaaagaaagacctcggaatcggctatgtggccgccgaaaaccatcagcacgctaccatgctggatgtcgaccttcaccccgccagcgcgtggacgctgtacgccgtggctaccacagttatcacccctatgatgagacatacaattgagaataccacggccaacatctctctcacagctattgccaatcaagcggccatcctgatgggcctggataaggggtggcccatttccaaaatggacatcggagtgccgctccttgctctgggctgctacagccaggtcaaccctctgaccctcacagccgctgtgctgatgcttgttgcccactatgctattatcgggcccggactgcaggccaaggcgacccgggaagcccagaaacgcaccgctgccggcatcatgaagaatcccacagtggatgggattgtcgctatcgacctcgatcctgtggtgtacgacgccaagttcgagaaacaactgggacagattatgctgctcatcctttgtacgtctcagattctgctgatgagaaccacatgggccctctgcgaatccatcaccctggcgacaggcccgcttaccacgctgtgggagggcagccccgggaagttctggaacacaaccatcgctgtttctatggccaatatttttcggggaagctatctcgctggcgccgggctggccttctccctgatgaaatctctcggaggcgggcgcagaggaaccggcgctcagggcgagacacttggggaaaagtggaaacggcaactgaaccagctgagcaagtccgagtttaatacctacaagagaagcggaatcatggaagtcgaccgctccgaggccaaagaaggcctcaagcggggggagacaacgaaacatgcggtgtctagaggaaccgccaagctgcgctggttcgtggagcggaaccttgtcaaacctgaaggcaaggttattgatctggggtgtggaagaggcggctggagctattactgcgctgggctcaagaaagtgacagaggtgaagggatataccaaaggcgggcccggacacgaagagcctatccccatggccacatacggctggaatctggtcaagctgcattccgggaaagacgtgtttttcatgcctccggaaaagtgtgataccctcctttgcgacattggagagtctagccccaaccctacgatcgaggaaggccgcaccctgcgggttctgaaaatggtggagccctggctcagaggcaatcagttttgtatcaagattctgaacccttacatgccctccgtcgtggaaacacttgagcagatgcaacgcaagcacgggggaatgctggttcggaatccgctctctagaaacagcacccacgagatgtattgggtgtcctgcggcacagggaatatcgtcagcgctgtgaacatgacctctcgcatgctgctgaaccggttcacaatggcccatagaaaacctacctacgaacgcgatgtggacctcggagcgggcacgagacacgtcgccgttgagcccgaagtggctaatctggatattatcgggcagcggattgagaacatcaagaatgaacataaatccacatggcactatgacgaggataacccctacaagacctgggcctatcacggaagctacgaggtgaaaccttctggctccgctagctctatggtcaatggcgtggttcgccttctgaccaagccctgggacgtgattcctatggtcacacagatcgccatgacggataccacaccgtttgggcaacagagagtgttcaaggaaaaagttgacacccggacacccagagctaagcggggaaccacacagatcatggaggtgaccgccaaatggctctggggctttctgtcccgcaacaagaaacctagaatttgtacgcgggaagagttcacccgcaaggtcagaagcaatgcggccatcggggctgtgtttgttgacgaaaaccagtggaattccgccaaggaggctgtggaggatgaacggttctgggaccttgtccatcgcgagagagaactgcacaaacaaggaaagtgcgccacatgcgtgtataacatgatgggcaaacgggagaagaaactcggggaattcggcaaggccaagggaagccgcgcgatttggtacatgtggctgggcgctagatttctggagttcgaggccctcgggtttatgaatgaagatcattggttctctcgggagaacagcctgtccggagtcgaaggcgaggggcttcacaaactgggatacatcctccgcgacatttctaagatccccggcgggaatatgtatgccgatgacaccgctggctgggatacaagaatcaccgaggacgatctgcagaacgaagccaaaattacggacatcatggagcctgaacatgctcttctggccacaagcatttttaagctcacctaccagaataaagtggttcgggtgcagcgccccgcgaagaacggaacagtcatggatgtgatctccagacgggaccaaagaggctctgggcaggtgggaacctatggcctgaacacgttcaccaatatggaggttcagctgattcgccagatggaaagcgaggggatctttctcccgtccgagctggaaacacctaaccttgccgagcgggctctggattggctcgaaaaacacggagccgagagactgaagcgcatggctatctctggcgacgactgtgtggtcaagcccattgatgaccggttcgccaccgcgcttacagccctgaatgatatggggaaagtgagaaaggacatccctcaatgggaacccagcaaaggctggaacgattggcagcaggttcctttttgctcccaccatttccaccagctcattatgaaggacggacgcgagatcgtggtcccctgtcggaatcaagatgagctggtgggcagagctcgcgtcagccagggggccggatggtctctgcgggaaaccgcttgcctcggcaaatcctacgcccagatgtggcaactgatgtattttcatagacgcgaccttcggctggctgccaacgcgatttgtagcgccgtgccggttgattgggtgcctgcttctagaacaacctggtccatccacgcccaccatcagtggatgacgacagaggacatgctcagcgtctggaatcgggtgtggatcgaagagaacccctggatggaagataagacccacgtttcctcttgggaggaggtgccctacctggggaagagagaagaccagtggtgcggaagccttattggcctgaccgcccgcgctacatgggccaccaatatccaggtcgcgatttcccaagtgcggagactcatcgggaacgagaattatctggactacatgacaagcatgaaacgcttcaagaacgaatctgatcctgagggcgctctgtggtga

SEQ ID NO: 19406 - RNA, 9879 nt, synthetic construct
  misc_feature 1..9879: note = derived and/or modified CDS sequence (opt5) from DENV-1__KC692510__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcacaaaccctgccgttctgagaaagctttgcattgaggcgaaaatctctaataccacgacagattcccggtgtccgacccaaggagaagccaccctggtggaggagcaggacgctaactttgtgtgccgcagaacattcgtcgatcggggctggggcaatgggtgtggactctttggcaaggggagcctgcttacctgcgccaaattcaagtgcgtgacaaagctggaaggaaaaattgttcagtacgagaacctcaagtattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccgcacaggcctggactttaacgagatggtgcttctgaccatgaaagagaagtcttggctcgtccataaacagtggttcctggatcttcctctgccctggacgtccggggctagcacatcccaagaaacctggaatagacaggacctcctggtgacatttaagaccgcgcacgccaaaaagcaggaggtcgtggttctgggatctcaagaaggcgctatgcacaccgccctcacaggggccacggagattcagaccagcggaacaaccacaatcttcgctggccatctgaagtgccggcttaaaatggataagctgaccctcaaagggatgtcctatgtgatgtgtacgggcagcttcaagctggaaaaagaggtcgccgagacacagcacggaaccgtgctggttcaggtgaagtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatgtgcgaccaccgccttatgtccgcggccattaaagatagcaaggctgtgcatgccgacatggggtattggatcgagtctgaaaaaaatgagacctggaagctcgcccgggcttccttcattgaagtgaaaacatgtacctggcccaagagccacacactgtggtctaacggagtcctggagtccgagatgatcatcccgaagatttttggcgggcctatcagccaacataattacagacccggatatttcacccagacggccggcccttggcacctcgggaaactggaacttgattttgacctgtgcgagggaaccacagtggttgtggatgaacactgcggcaaccggggcccctctctccgcaccacaaccgtcacggggaagattatccatgagtggtgttgcagaagctgtacactgcctcccctgcggttcagaggagaggacggctgctggtacgggatggaaattcgcccggtgaaagagaaggaagagaatcttgttcggtccatggtgagcgcgggatctggcgaagtcgattcctttagcctcgggatcctgtgtgtgtccatcatgattgaggaggttatgagatctcgctggagcagaaaaatgctgatgaccggaacactcgctgtgttcctgcttctgatcatgggccagctcacctggaacgacctgattcggctgtgcatcatggtcggcgccaatgcctccgaccgcatggggatgggaaccacataccttgctctgatggccacgtttaagatgagacctatgttcgcggtgggcctcctgtttcggcgcctcacctctagagaagtgctgcttctgacaattgggctcagcctggtcgcttccgttgagctgcccaactctcttgaagagctgggagatggcctcgccatggggatcatgatgctgaagctcctgaccgaattccaaccccaccagctttggacaaccctgctcagcctgacgtttgtgaaaacaaccctgtcccttgactatgcctggaagaccacagctatggtgctgagcattgtctctctcttccctctgtgtctctccaccacaagccagaaaacgacctggctgccggtgcttctgggatcttttggctgcaagcccctgacaatgttcctcatcaccgagaacaaaatctggggccggaagtcctggcctctgaatgaggggattatggccatcggaattgttagcatccttctgtcttccctcctgaagaacgatgtgcccctcgctggccctctgattgccgggggaatgcttatcgcgtgttacgtcatcagcggctccagcgccgacctgtctctggaaaaagctgccgaggtgagctgggaacaggaggctgaacattccggggcctctcacaatattctcgttgaggtgcaagatgacggaacaatgaagatcaaagatgaggaacgcgacgataccctgacgattcttctgaaggccaccctcctggctgtcagcggcgtgtatcccatgtccatccctgcgacactcttcgtctggtacttttggcagaaaaagaaacagagatctggcgtgctgtgggacacccccagcccgcctgaggttgaacgggccgtgcttgatgacgggatttatcgcatcctgcagagaggactgctcggccggtcccaagtcggggtgggagttttccaggatggcgtgtttcatacaatgtggcacgtcaccagaggggctgtgctgatgtaccagggaaagcgccttgagccctcttgggccagcgtgaagaaagacctgatctcctatggcggcgggtggcggttccagggaagctggaacacaggcgaggaagttcaagtcattgccgtggagcctgggaagaatcccaaaaacgtgcagacgaccccgggaacatttaagacccctgaaggcgaggtcggggctatcgccctcgacttcaaacccggaacctctggctcccctattgtgaatagagaaggcaagatcgttgggctgtacggaaacggcgtggtcacaacgagcgggacctacgtgtctgcgattgctcaggccaaggcctcccaagagggacccctccccgagatcgaagatgaggtttttaaaaagcgcaatctgacaattatggaccttcaccctggcagcgggaaaacccggagatatctgccggctatcgtgcgcgaagccatcaagcggaaactgagaacactcattctggcgcccacccgcgtcgtggcttccgagatggccgaagcccttaagggcatgcctatccggtaccagacgacagctgttaagtctgagcataccggaagagagattgtggatctgatgtgccacgccaccttcacaatgcggctcctgagccccgtccgcgtgcctaactataatatgatcattatggacgaagctcattttaccgatcccgcctccatcgcggccagaggctacatcagcacacgggtggggatgggagaggctgccgctattttcatgaccgccacgcctccgggctctgtcgaagcctttccccagtccaacgctgttatccaggacgaggaacgcgatattcctgagagaagctggaattctgggtatgactggatcacagatttccccggaaaaaccgtgtggttcgtgcctagcattaagtccggcaacgacatcgcgaattgtctgcggaaaaacgggaagagagtcatccaactctctcgcaaaacatttgataccgagtaccagaagacgaagaacaatgactgggactatgtggttaccacagatattagcgaaatgggcgccaacttccgggctgacagagtgatcgatccccgccggtgccttaaaccggtcattctgaaggacggacctgagagagtgatcctggccggccccatgcccgttaccgtggcctccgctgcccagcgccgggggagaattggacgcaatcagaacaaagaaggcgatcaatacgtctacatggggcagcctctcaataacgacgaggatcacgcgcattggacagaggctaagatgctgcttgacaatatcaacacccccgaaggaattatccctgccctgtttgagccggaaagagagaaatctgccgctatcgatggcgaatatcggctccgcggggaggccagaaagacattcgtggagctgatgcggcgcggcgacctgcccgtctggctcagctacaaggtggcgtccgaaggatttcagtatagcgatagacggtggtgcttcgacggcgagagaaataaccaggttcttgaagagaatatggatgtggaaatttggaccaaagagggggagcgcaagaaactgcggcctagatggctggacgcccgcacgtactctgaccccctcgctctgcgggaatttaaggagttcgccgctggaagacggtccgtgagcggcgatcttatcctggaaattgggaaactccctcaacacctgacactgcgcgcccagaacgctctcgacaatcttgtcatgctgcacaactccgagcagggaggcaaggcctatagacatgcgatggaagagctgcccgataccatcgagaccctcatgctgcttgccctgattgctgttctcacaggcggggtgaccctgtttttcctgtctggaaaaggcctcgggaagacaagcatcggacttctgtgtgtgacggcctcctctgctctgctctggatggccagcgtcgaaccgcactggatcgccgcttccattatcctggagtttttccttatggtgctgctcattcctgaacccgaccggcagcgcacccctcaagataatcagctggcgtacgttgtgatcggcctgctctttatgattcttacagtcgccgctaacgagatggggctgctggagaccacaaagaaagacctcggaatcggctatgtggccgccgaaaaccatcagcacgctaccatgctggatgtcgaccttcaccccgccagcgcgtggacgctgtacgccgtggctaccacagttatcacccctatgatgagacatacaattgagaataccacggccaacatctctctcacagctattgccaatcaagcggccatcctgatgggcctggataaggggtggcccatttccaaaatggacatcggagtgccgctccttgctctgggctgctacagccaggtcaaccctctgaccctcacagccgctgtgctgatgcttgttgcccactatgctattatcgggcccggactgcaggccaaggcgacccgggaagcccagaaacgcaccgctgccggcatcatgaagaatcccacagtggatgggattgtcgctatcgacctcgatcctgtggtgtacgacgccaagttcgagaaacaactgggacagattatgctgctcatcctttgtacgtctcagattctgctgatgagaaccacatgggccctctgcgaatccatcaccctggcgacaggcccgcttaccacgctgtgggagggcagccccgggaagttctggaacacaaccatcgctgtttctatggccaatatttttcggggaagctatctcgctggcgccgggctggccttctccctgatgaaatctctcggaggcgggcgcagaggaaccggcgctcagggcgagacacttggggaaaagtggaaacggcaactgaaccagctgagcaagtccgagtttaatacctacaagagaagcggaatcatggaagtcgaccgctccgaggccaaagaaggcctcaagcggggggagacaacgaaacatgcggtgtctagaggaaccgccaagctgcgctggttcgtggagcggaaccttgtcaaacctgaaggcaaggttattgatctggggtgtggaagaggcggctggagctattactgcgctgggctcaagaaagtgacagaggtgaagggatataccaaaggcgggcccggacacgaagagcctatccccatggccacatacggctggaatctggtcaagctgcattccgggaaagacgtgtttttcatgcctccggaaaagtgtgataccctcctttgcgacattggagagtctagccccaaccctacgatcgaggaaggccgcaccctgcgggttctgaaaatggtggagccctggctcagaggcaatcagttttgtatcaagattctgaacccttacatgccctccgtcgtggaaacacttgagcagatgcaacgcaagcacgggggaatgctggttcggaatccgctctctagaaacagcacccacgagatgtattgggtgtcctgcggcacagggaatatcgtcagcgctgtgaacatgacctctcgcatgctgctgaaccggttcacaatggcccatagaaaacctacctacgaacgcgatgtggacctcggagcgggcacgagacacgtcgccgttgagcccgaagtggctaatctggatattatcgggcagcggattgagaacatcaagaatgaacataaatccacatggcactatgacgaggataacccctacaagacctgggcctatcacggaagctacgaggtgaaaccttctggctccgctagctctatggtcaatggcgtggttcgccttctgaccaagccctgggacgtgattcctatggtcacacagatcgccatgacggataccacaccgtttgggcaacagagagtgttcaaggaaaaagttgacacccggacacccagagctaagcggggaaccacacagatcatggaggtgaccgccaaatggctctggggctttctgtcccgcaacaagaaacctagaatttgtacgcgggaagagttcacccgcaaggtcagaagcaatgcggccatcggggctgtgtttgttgacgaaaaccagtggaattccgccaaggaggctgtggaggatgaacggttctgggaccttgtccatcgcgagagagaactgcacaaacaaggaaagtgcgccacatgcgtgtataacatgatgggcaaacgggagaagaaactcggggaattcggcaaggccaagggaagccgcgcgatttggtacatgtggctgggcgctagatttctggagttcgaggccctcgggtttatgaatgaagatcattggttctctcgggagaacagcctgtccggagtcgaaggcgaggggcttcacaaactgggatacatcctccgcgacatttctaagatccccggcgggaatatgtatgccgatgacaccgctggctgggatacaagaatcaccgaggacgatctgcagaacgaagccaaaattacggacatcatggagcctgaacatgctcttctggccacaagcatttttaagctcacctaccagaataaagtggttcgggtgcagcgccccgcgaagaacggaacagtcatggatgtgatctccagacgggaccaaagaggctctgggcaggtgggaacctatggcctgaacacgttcaccaatatggaggttcagctgattcgccagatggaaagcgaggggatctttctcccgtccgagctggaaacacctaaccttgccgagcgggctctggattggctcgaaaaacacggagccgagagactgaagcgcatggctatctctggcgacgactgtgtggtcaagcccattgatgaccggttcgccaccgcgcttacagccctgaatgatatggggaaagtgagaaaggacatccctcaatgggaacccagcaaaggctggaacgattggcagcaggttcctttttgctcccaccatttccaccagctcattatgaaggacggacgcgagatcgtggtcccctgtcggaatcaagatgagctggtgggcagagctcgcgtcagccagggggccggatggtctctgcgggaaaccgcttgcctcggcaaatcctacgcccagatgtggcaactgatgtattttcatagacgcgaccttcggctggctgccaacgcgatttgtagcgccgtgccggttgattgggtgcctgcttctagaacaacctggtccatccacgcccaccatcagtggatgacgacagaggacatgctcagcgtctggaatcgggtgtggatcgaagagaacccctggatggaagataagacccacgtttcctcttgggaggaggtgccctacctggggaagagagaagaccagtggtgcggaagccttattggcctgaccgcccgcgctacatgggccaccaatatccaggtcgcgattaaccaagtgcggagactcatcgggaatgagaactatctggactacatgacatccatgaaacgcttcaagaatgaaagcgatcctgagggcgctctgtggtga

SEQ ID NO: 19407 - RNA, 9879 nt, synthetic construct
  misc_feature 1..9879: note = derived and/or modified CDS sequence (opt5) from DENV-1__KC692511__SS-prME
  source 1..9879: mol_type = other RNA
agcgtgaccatgctgctgatgctgcttcccacagctctggctttccacctcacgaccagaggaggggagcctcatatgatcgtgtccaagcaggaacggggaaaatctctgctttttaagacaagcgttggcgtgaacatgtgcaccctgattgccatggaccttggggagctgtgtgaagatacaatgacctacaaatgccccagaatcacagaggcggaacccgacgatgtggactgttggtgcaatgctaccgatacgtgggtcacctatggaacatgttcccagaccggcgagcacagacgggacaagcgctctgtggccctggcccctcatgttgggctcggactggagacaagaaccgaaacgtggatgagctccgagggcgcttggaaacagattcagaaggtggaaaactgggcccttcggcaccccggcttcacagtcatcgctctgtttctcgcccatgcgattgggacctctatcacacagaagggaatcattttcatcctgcttatgctggtgacccctagcatggccatgcgctgcgttggcattgggaatagagattttgtggagggactctccggcgctacctgggtcgacgtggtgctggagcacgggagctgtgtcacaacgatggccaaaaacaagcccaccctggatatcgaactcctgaaaacagaggttaccaatcctgctgtgcttcggaagctgtgcattgaagccaaaatctctaacacaaccacggactcccgctgtccgacacaaggagaggcgaccctcgtggaggaacaagatgccaatttcgtctgcagacggacctttgtggaccgcggctggggcaacgggtgtggactgttcggcaaggggagccttctgacatgcgctaagtttaaatgcgttaccaagctcgagggaaaaattgtgcagtacgaaaatctgaagtattctgtcatcgtgacagttcacacgggcgatcagcatcaagtggggaacgagaccacagaacacggaaccatcgccacaattacgccccaagctcctacctccgagatccagctgaccgactacggcgccctcacactggactgtagccccagaaccggccttgatttcaatgaaatggtcctgctcacaatgaaagagaagtcttggctggtgcataaacagtggtttcttgacctgcctctcccctggacctccggggccagcacgtcccaagagacatggaaccggcaggatctgctggtcaccttcaagacagctcacgcgaagaaacaggaagtggttgtgctcggatctcaagagggcgccatgcacaccgctctgaccggggccacagaaattcagacgagcggaaccacaaccatctttgccggccatcttaagtgccgcctgaaaatggacaagctcacactgaaagggatgtcctatgtcatgtgtaccggcagcttcaagctggagaaggaagtggctgagacgcagcacggaacagttcttgtgcaggtcaaatacgagggcaccgatgccccgtgcaagattcctttcctcacccaagacgaaaaaggggtgacacagaatggaagactgatcaccgcgaaccccatcgtgacagataaggagaaacctgttaatattgaaacggagccgccctttggcgagtcttatatcgtcgtgggggctggagaaaaggccctgaagctctcctggttcaaaaagggcagctctattgggaaaatgtttgaggccaccgctcggggcgccagacgcatggctatcctgggagacacagcctgggatttcggcagcattgggggactttttacctccgtgggcaagctgatccatcagatcttcgggacagcgtacggagtcctcttttctggcgtgagctggaccatgaaaattgggatcggcattctgctgacgtggcttggactcaactcccggagcacctctctgtccatgacatgtatcgccgttggcatggtgaccctgtacctcggggtcatggtgcaggctgacagcggatgcgttattaactggaagggcagagaactgaagtgtgggtctggaatcttcgtgacaaatgaggtccacacctggacagaacaatataaatttcaggccgattcccctaagcgccttagcgctgccattggcaaagcgtgggaggagggggtgtgcggcatccggtccgccaccagactggaaaacatcatgtggaagcagatttctaatgagctcaactacatcctgctggaaaatgacatgaaattcacggttgtggtcggagacattaacggcatccttgctcaggggaagaaaatgattcgcccgcaacccatggagcataagtatagctggaagtcctggggaaaagccaagatcatcggcgctgatattcagaatacaacctttatcattgacgggcctgatacccccgaatgtcctaacgaccagcgggcctggaatatctgggaggtggaggattacggattcggcatttttacaaccaacatctggctcaaactgagagactctcacacgcagatgtgcgatcaccgcctgatgagcgccgctatcaaggactccaaagcggtgcatgccgatatgggctattggattgaaagcgagaagaatgaaacatggaagctcgctcgggcctctttcatcgaggtcaaaacctgtatttggcccaagtcccacacactgtggagcaacggggttcttgaatctgagatggtgatcccgaaaatttacggaggccctatctcccaacataattatagacccgggtacttcacccagacagccggaccttggcacctgggcaagctcgagctggactttgatctgtgcgaagggaccacggtggtcgtggacgagcactgcggataccgcggccccagccttcggaccacaaccgttacaggcaaaatcattcatgaatggtgttgcagatcttgtaccctccctcccctgcggttccgcggggaggatggatgctggtatggcatggagatcagaccggtgaaggaaaaggaggaaaacctggtccggagcatggtgtccgctgggagcggagaggttgactctttttccctcggcattctgtgtgtgagcatccttattgaagaggtcatgagatcccgctggtctcggaaaatgctgatgacggggacactcgccgtgttcctgctgcttatcatgggacagctgacctggaatgacctcattagactgtgcatcatggttggcgcgaacgctagcgatcgcatgggcatggggacaacctacctcgccctgatggccacctttaagatgagacctatgttcgctgtgggacttctgtttcggcgcctcacatccagagaggtcctgctgcttacggtgggcctgtctctcgtggccagcgtcgaactgcccaactccctcgaggaactgggggacggacttgcgatgggcatcatgatgctgaaactcctgaccgatttccaaccccaccagctgtggacaacccttctgtctctcacatttattcggaccagcctgtccctcgactatgcttggaagacgatggccatggccctgagcatcgtttctcttttccctctgtgtctgtccacaaccagccagaaaaccacatggctcccggtgctgcttgggtcttttggatgcaagcccctgaccatgttcctcattacagagaataagatctggggccgcaaatcctggcctattaacgaaggcatcatggctgtggggatcgtcagcattctgctctcttccctgcttaagaatgatgtgcccctggccggacctctgatcgctggcgggatgctcattgcctgttacgttatcagcggatccagcgcggacctgtctcttgagaaagccgctgaggtgagctgggaagaggaagccgagcattccggcacgtctcacaacattctggtcgaagtgcaggatgacgggaccatgaagatcaaagatgaggagagagacgatacactcaccatcctgctcaaggctacactgcttgccgttagcggagtgtatcccatgtccattcctgccaccctgtttgtctggtacttctggcagaagaagaagcagcggtctggcgtgctgtgggacacgcccagcccgcctgaagtcgagcgcgctgtgctcgatgacggcatctatcgcattctgcagcgggggcttctgggacgctcccaggttggcgtgggggtcttccaagacggagtgtttcataccatgtggcacgttacaagaggcgcggtgctcatgtaccaggggaaacggctggaaccctcttgggccagcgtcaagaaagatctcatctcctacggaggcggctggagattccaggggagctggaataccggagaggaggtccaggtgattgctgttgaacctggcaagaaccccaaaaatgtccaaacaaccccggggacatttaagacgcctgagggagaagtgggcgccatcgccctggacttcaagcccgggacctctggatcccctattgtgaaccgcgagggcaaaatcgtcggcctttatgggaatggagtggttacaaccagcggcacctacgtgtctgctatcgcccaggcgaaggctacacaggaagggcccctgcccgagattgaggatgaagtctttaaaaagcggaacctgacgatcatggacctccaccctggatccggcaaaaccagacgctatctgccggccattgtgcgggaggccatcaagagaaaacttcgcacactgattctcgctcccacccgggttgtggccagcgaaatggcggaggctctgaaagggatgcctatcagataccaaacaaccgccgtcaagtccgaacatacgggccgcgagatcgtggatctgatgtgccacgccacattcaccatgcggctcctttctcccgttagagtgcctaattataacatgattatcatggacgaggctcattttaccgatcccgccagcattgctgcccggggatacatctccacacgcgtcggcatgggggaagcggccgctattttcatgaccgccacacctccgggaagcgtggaggcttttccccagtctaatgccgtgatccaggacgaagagagagatatccctgaacggtcctggaacagcggctatgactggattaccgatttccccgggaaaacggtctggtttgttccttctatcaagagcggaaatgacattgccaactgtctgcgcaaaaacggcaagagagtgatccagctgtcccggaagacattcgacaccgagtaccagaagacaaagaataacgattgggactacgtggtcaccacggatatttctgagatgggggctaatttcagagcggaccgcgtgatcgatccccggagatgcctcaaaccggttattctgaaggaaggccctgagcgcgtgatccttgccggacccatgcccgtcaccgtggctagcgccgcccagcggagaggccgcatcgggcggaaccagaataaagaaggagaccagtatatttacatgggccaacctctgaacaatgatgaggaccacgctcattggacagaggccaagatgctcctggataacatcaatacccccgaagggattatccctgcgctgtttgagccggaaagagagaagtccgctgccattgacggagaatatcgcctcagaggcgaggcccggaaaacattcgttgagcttatgcgcagaggggatctgcccgtgtggctgtcttacaaggtcgctagcgaaggctttcagtattccgaccggcgctggtgcttcgatggagagagaaacaatcaggtgctcgaagagaacatggacgtcgaaatctggaccaaagagggcgagcggaagaaactgagacctcgctggcttgacgcccggacatacagcgatcccctggcgctcagagaatttaaggagttcgccgctgggcgccggtctgtgtccggagacctgatcctggaaattggcaaactccctcagcaccttaccctgagagcccaaaatgctctggataacctcgttatgctgcacaatagcgagcaagggggaaaggcctatcggcatgctatggaggaacttcccgacacgatcgagacactgatgctcctggccctgattgcggtgctcaccggcggcgtgaccctctttttcctgtccgggaagggactgggcaaaacatctatcgggctcctgtgtgtcatggccagctccgcccttctgtggatggcctctgttgaaccgcactggattgctgccagcatcatcctcgagtttttcctgatggtgctgctcattcctgaacccgatcgccagagaacccctcaggacaaccaacttgcctacgtggtcatcggactgctgtttatgattctcacagtggctgcgaacgagatgggcctgcttgagacgaccaagaaagatctggggatcggacatgttgccgtggaaaatcaccaccatgctacaatgctcgacgtcgatctgcggcccgcctccgcctggaccctgtacgctgtggccacaaccgtcattacgcctatgatgcgccacaccatcgagaacacaaccgcgaatattagcctcacagccatcgctaaccaggccgctatccttatgggcctggacaagggctggcccatttctaaaatggatatcggggtgccgctgctcgccctgggatgctattcccaggttaatcctcttaccctgacggcggccgtgctcatgctggtcgctcattacgccattatcggccccgggctgcaagctaaggccacaagagaagctcagaagcggaccgccgcgggaattatgaaaaaccccacagtggacggcatcgttaccatcgatctcgaccctgtggtctatgacgccaagttcgagaaacagcttgggcagattatgctgctgatcctctgtaccagccaaattctgcttatgcgcacaacgtgggctctgtgcgaatctatcaccctcgccacaggaccgctgaccacactgtgggagggctcccccggcaagttttggaataccacgattgctgtgagcatggccaacatcttcagagggtcttacctcgccggagcgggccttgctttcagcctgatgaaatccctcgggggaggccggcgcgggacaggagcccagggcgagaccctcggcgaaaagtggaagagacagctgaatcagctttctaaaagcgagtttaacacctataagaaatccgggatcatggaagtggatcggagcgaggctaaggaaggactgaaaagaggcgagacaaccaagcacgccgtttcccgcgggacagccaagctccggtggttcgtcgagagaaatctggtgaaacctgaaggaaaggtgattgacctgggctgtgggcgcggaggctggtcttactattgcgctggcctcaaaaaggtcacggaggttaaagggtacaccaagggaggccccgggcatgaggagcctatccccatggccacatacggatggaaccttgtgaaactgcacagcggcaaggatgtgtttttcacccctccggaaaagtgtgacacactgctctgcgatattggggagtcctctcccaatcctaccatcgaggaaggacggacgctgagagtccttaaaatggtggagccctggctgcgcggcaaccaattttgtattaagatcctcaatccttatatgcccagcgttgtggaaaccctggagcagatgcagcggaaacacggcgggatgctggtcagaaacccgctctcccgcaattctacacatgagatgtactgggtgagctgcggaaccggcaacattgtttccgcggtgaacatgacaagccggatgctgcttaatagattcaccatggcccaccgcaagcctacatatgaacgggacgtcgatctgggggctggaaccagacatgtggccgtggagcccgaagtcgctaacctcgacatcatcggccagcgcattgagaatatcaaaaacgaacacaagtctacgtggcactacgatgaggacaatccctataagacatgggcctaccatgggtcctatgaggttaaacctagcggatctgcgtccagcatggtgaacggcgtggtcagactgcttaccaagccctgggatgtgattcctatggttacccaaatcgccatgacagacacgaccccgtttggccagcagcgggtgttcaaagaaaaggtcgacacacgcacccccagagctaaacgggggacagcccaaattatggaggtgaccgctaagtggctgtggggatttctctctagaaataagaaacctcggatctgtacacgcgaagagttcaccagaaaggttcggtccaacgccgctatcggcgccgtgtttgtcgatgaaaatcagtggaacagcgcgaaagaggccgtggaggacgaacgcttctgggatctggttcacagagagcgggaactgcataagcaggggaaatgcgctacgtgcgtgtacaatatgatgggaaagcgcgagaagaaactcggcgaatttgggaaggccaaaggctccagagctatttggtacatgtggctgggagcccggttccttgagttcgaggccctgggctttatgaacgaagaccactggttcagccgcgaaaattctctcagcggggtcgaaggagagggcctgcataaacttgggtatatcctgagagatatttccaaaatccccggaggcaacatgtacgcggacgataccgctgggtgggacacacggattaccgaggatgacctccagaatgaagccaagatcacagatatcatggagcctgaacacgccctgctggctacctctatttttaaactcacgtatcaaaacaaggtggtccgcgtgcagagacccgccaagagcggcacagttatggacgtgatctcccggcgcgatcagagaggatctggccaggtcgggacctacggactgaacacattcaccaatatggaggtgcaacttattcggcagatggaaagcgagggcatcttttccccgtctgagctggaaacgcctaacctcgctaaaaaggtgctggactggcttgagaaacacggggccgaaagactgaagcgcatggcgattagcggagacgattgtgttgtgaaacccatcgacgatcggttcgccaccgctctcacagccctgaatgacatgggcaaggtcagaaaggatatccctcagtgggagccctccaaagggtggaacgactggcagcaagtgcctttttgcagccatcacttccatcagctgattatgaaggatggccgcgaaatcgttgtgccctgtcggaatcaggacgagctcgtcggcagagctcgcgtgtctcagggcgccgggtggtccctgcgggagaccgcgtgccttggaaaaagctatgcccaaatgtggcagctgatgtactttcacagacgcgatctccggctggctgccaacgctatttgttctgccgtcccggtggactgggttcctacatccagaaccacatggagcatccacgctcatcaccagtggatgaccacggaagatatgctttccgtgtggaatcgcgtctggattgaggaaaacccctggatggaggacaagacacatgtgtctagctgggaagaggttccctatctgggcaaacgggaggaccaatggtgcgggtccctcatcggactgaccgccagagcgacctgggccacaaatattcaggtggctatcaaccaggtccggagactgatcggcaatgaaaactacctcgattacatgaccagcatgaagcgcttcaagaatgagtctgaccctgaaggggccctgtggtga

SEQ ID NO: 19408 - RNA, 9879 nt, synthetic construct
  misc_feature 1..9879: note = derived and/or modified CDS sequence (opt5) from DENV-1__KC692512__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggactttgttgagggactctccggcgccacatgggtggatgtcgtgctggaacacgggagctgtgtgacgaccatggctaagaataaacccacactggacatcgagctcctgaagaccgaagtcacaaaccctgccgttcttcgcaaactgtgcattgaggcgaagatctctaataccacgacagattccagatgtccgacccaaggagaagccaccctcgtggaggagcaggacgctaacttcgtgtgccggcgcacatttgtcgatagaggctggggcaatgggtgtggactgttcggcaaagggagccttctgacctgcgccaagtttaagtgcgtgacaaaactcgaaggaaagattgttcagtacgagaacctgaaatattctgtgatcgtcacggtgcacaccggcgaccagcatcaagttgggaatgaaacaaccgagcacggaacaatcgctaccattacgccccaggcccctacctccgaaatccagctgacagattacggcgccctcaccctggactgtagcccccggacaggccttgacttcaacgagatggtgctgctcaccatgaaggagaaatcttggctggtccataagcagtggtttcttgatctgcctctcccctggacgtccggggctagcacatcccaagaaacctggaatcgccaggacctgctggtgacattcaaaaccgcgcacgccaagaagcaggaggtcgtggttctcggatctcaagaaggcgctatgcacaccgccctgacaggggccacggagattcagaccagcggaacaaccacaatctttgctggccatcttaaatgcagactgaagatggataaactcaccctgaaggggatgtcctatgtgatgtgtacgggcagcttcaaactggaaaaggaggtcgccgagacacagcacggaaccgtgcttgttcaggtgaagtacgaaggcaccgacgcgccgtgcaaaattcctttctctacacaagatgagaagggggtcacccagaacggacggctcatcacagctaatcccatcgtgacggacaaagaaaagcctgtgaacattgagaccgagcccccctttggcgaatcctatatcgttgtcggggccggagagaaagccctgaagctgagctggttcaagagaggctctagcattgggaaaatgtttgaagctacagcccgcggcgctcggagaatggccatcctcggagataccgcgtgggacttcggctccattgggggagtgtttacatctgtgggcaagctggtccatcaggtgttcgggaccgcctacggagttctttttagcggcgtgtcctggacgatgaaaatcgggatcggcattctgctcacctggctgggactgaatagccgctctacatcccttagcatgacctgtatcgctgtcggcatggtgacactctacctgggggttatggtgcaggccgattctggatgcgtcattaactggaagggccgggagctgaaatgtgggtccggaatcttcgtgaccaacgaagttcacacatggaccgagcaatataagtttcaggctgacagccctaagagactctccgccgcgattggcaaagcctgggaggaaggggtgtgcggcatccgctctgctacgcggctggagaatattatgtggaagcagatcagcaacgaacttaatcatatcctgctcgagaacgatatgaaattcacagtcgtggtgggagacgccaatggcattctggctcaggggaagaaaatgatcagaccgcaacccatggaacacaagtactcctggaaatcttggggaaaggccaagattatcggcgccgacattcagaacaccacctttatcatcgatgggcctgacacacccgagtgtcctgatggacagcgcgcttggaatatttgggaggtcgaagactatggcttcggcgtttttaccacgaacatctggctgaaacttcgggatagctacacacagatgtgcgaccacagactcatgtccgcggccattaaggatagcaaagctgtgcatgccgacatggggtattggatcgagtctgaaaagaatgagacctggaaactggcccgcgcttccttcattgaagtgaagacatgtacctggcccaagagccacacactgtggtctaacggagtcctcgagtccgagatgatcatcccgaaaattttcggcgggcctatcagccaacataattaccggcccggatattttacccagacggccggcccttggcacctggggaagcttgaactggatttcgacctctgcgagggaaccacagtggttgtggatgaacactgcggcaacagaggcccctctctgcggaccacaaccgtcacggggaaaattatccatgagtggtgttgccgcagctgtacactgcctccccttagatttcggggagaggacggctgctggtacgggatggaaattagaccggtgaaggagaaagaagagaatctcgttcgctccatggtgagcgcgggatctggcgaagtcgattccttcagcctggggatcctgtgtgtgtccatcatgattgaggaggttatgcggtctagatggagccgcaagatgctcatgaccggaacactggctgtgtttcttctgctcatcatgggccagctgacctggaacgacctgattagactttgcatcatggtcggcgccaatgcctccgaccggatggggatgggaaccacatacctggctctcatggccacgttcaagatgcgccctatgtttgcggtgggcctgctcttcagacggctgacctctcgcgaagtgcttctgctcacaattgggctgagcctggtcgcttccgttgagcttcccaactctctggaagagctcggagatggcctggccatggggatcatgatgctcaaactgcttaccgaatttcaaccccaccagctgtggacaaccctcctgagcctgacgttcgtgaagacaaccctttccctggactatgcctggaaaaccacagctatggtgctcagcattgtctctctgtttcctctctgtctgtccaccacaagccagaagacgacctggcttccggtgctgctgggatctttcggctgcaaacccctcacaatgtttctgatcaccgagaacaagatctggggcagaaagtcctggcctcttaatgaggggattatggccatcggaattgttagcatcctgctctcttccctgctcaaaaacgatgtgcccctggctggccctcttattgccgggggaatgctgatcgcgtgttacgtcatcagcggctccagcgccgacctgtctctcgaaaaggctgccgaggtgagctgggaacaggaggctgaacattccggggcctctcacaatattctggttgaggtgcaagatgacggaacaatgaaaatcaaggatgaggaacgggacgatacccttacgattctgctcaaagccaccctgctcgctgtcagcggcgtgtatcccatgtccatccctgcgacactgttcgtctggtacttctggcagaagaaaaagcagcgctctggcgtgctttgggacacccccagcccgcctgaggttgaaagagccgtgctggatgacgggatttatcggatcctgcagcgcggactcctgggcagatcccaagtcggggtgggagtttttcaggatggcgtgttccatacaatgtggcacgtcacccggggggctgtgcttatgtaccagggaaagagactggagccctcttgggccagcgtgaaaaaggacctcatctcctatggcggcgggtggcgctttcagggaagctggaacacaggcgaggaagttcaagtcattgccgtggagcctgggaaaaatcccaagaacgtgcagacgaccccgggaacattcaaaacccctgaaggcgaggtcggggctatcgccctggactttaagcccggaacctctggctcccctattgtgaatcgggaagagaagatcgttggcctctacgggaacggagtggtcacaacgagcggcacctacgtgtctgcgattgctcaggccaaagcctcccaagaggggcccctgcccgaaatcgaggatgaagttttcaagaaaagaaatcttacaattatggacctgcaccctggaagcggcaagacccgccggtatctgccggctatcgtgagagaggccatcaaacgcaagctccggacactgattcttgcgcccaccagagtcgtggcttccgaaatggccgaggccctgaaggggatgcctatccgctaccagacgacagctgttaaatctgagcataccggccgggaaattgtggatctcatgtgccacgccacctttacaatgagactgctgagccccgtccgggtgcctaactataatatgatcattatggacgaggctcatttcaccgatcccgcctccatcgcggcccgcggatacatcagcacaagagtgggcatgggggaagctgccgctatttttatgaccgccacgcctccgggatctgtcgaggccttcccccagtccaacgctgttatccaggacgaagagcgggatattcctgagcgcagctggaattctggctatgactggatcacagattttcccgggaagaccgtgtggttcgtgcctagcattaaatccggaaacgacatcgcgaattgtctcagaaagaacggcaaacgggtcatccaactttctagaaagacattcgataccgaataccagaagacgaaaaacaatgactgggactatgtggttaccacagatattagcgagatgggggccaactttcgcgctgaccgggtgatcgatcccagacgctgcctgaagccggtcattctgaaagacggccctgaacgggtgatcctcgccggacccatgcccgttaccgtggcctccgctgcccagagacgcggccggattgggagaaatcagaacaaggagggagatcaatacgtctacatgggccagcctctgaataacgacgaggatcacgcgcattggacagaagctaaaatgcttctggacaatatcaacacccccgaggggattatccctgccctcttcgaaccggagcgcgaaaagtctgccgctatcgatggagagtatagactgcggggcgaggcccgcaagacatttgtggaactgatgagacggggggacctccccgtctggcttagctacaaagtggcgtccgagggcttccagtatagcgatcgcagatggtgctttgacggagaacggaataaccaggttctggaggaaaatatggatgtggagatttggaccaaggagggcgaaagaaaaaagctgcgccctcggtggctcgacgccagaacgtactctgaccccctggctcttcgcgagttcaaagaatttgccgctgggcggagatccgtgagcggagatctgatcctcgagattggcaagctgcctcaacacctgacactccgggcccagaacgctcttgacaatctggtcatgctgcacaactccgaacaggggggaaaagcctatcgccatgcgatggaggagctccccgataccatcgaaaccctgatgcttctggccctcattgctgttctgacaggcggcgtgaccctgttctttctctctgggaagggacttggcaagacaagcatcgggctgctgtgtgtgacggcctcctctgctctcctgtggatggccagcgtcgagccgcactggatcgccgcttccattatccttgaattctttctgatggtgctcctgattcctgagcccgacagacagcggacccctcaagataatcagctggcgtacgttgtgatcggactccttttcatgattctgacagtcgccgctaacgagatgggcctgctcgaaaccacaaaaaaggacctggggatcggacatgtggccgccgagaaccaccagcacagcaccatgcttgatgtcgacctgcatcccgcttctgcctggacgctctatgcggtggccaccacagttatcacccctatgatgcgccacacaattgaaaataccacggctaacatctccctgacagccattgctaatcaagccgcgatcctgatgggcctcgataaaggctggcccattagcaagatggacatcggggtgccgcttctggccctgggatgctactctcaggtcaaccctctcaccctgacagctgccgtgcttatgctggttgctcattacgccattatcggccccgggctccaggctaaagccaccagagaggcgcagaagcggaccgccgctggaatcatgaagaatcccacagtggatggcattgtcgccatcgacctggatcctgtggtgtatgacgctaaatttgaaaagcaactggggcagattatgctccttatcctgtgtacgtcccagattctgctcatgcgcaccacatgggccctgtgcgagagcatcacccttgccacaggaccgctgaccacgctctgggagggctctcccggcaaattctggaacacaaccatcgcggttagcatggctaatattttcagagggtcctacctggccggagctggcctggccttttctctcatgaagagccttgggggaggccggcgcgggaccggagcccagggcgaaacactgggcgagaaatggaagagacaactgaaccagctctccaagagcgaattcaatacctataaacggtccgggatcatggaggtcgacagatctgaagctaaggagggactgaaacgcggcgagacaacgaagcacgccgtgagccgggggaccgcgaaacttagatggtttgtggaacgcaacctggtcaagcctgagggaaaggttattgatctcggctgtgggcggggaggctggtcctactattgcgccggcctgaaaaaggtgacagaagtgaaagggtacaccaagggaggccccgggcatgaggaacctatccccatggctacatatggatggaatctggtcaaactccactctggcaaggacgtgttctttatgcctccggagaaatgtgatacccttctgtgcgacattggggagagctcccccaaccctacgatcgaagagggaagaaccctgcgcgttctcaagatggtggaaccctggctgcggggcaatcagttctgtatcaagattcttaacccttacatgccctctgtcgtggagacactggagcagatgcaaagaaaacacggcgggatgctcgttcgcaatccgctgagccggaactccacccatgaaatgtactgggtgagctgcggaacaggcaatatcgtctctgccgtgaacatgacctccagaatgctgctcaaccgctttacaatggctcaccggaagcctacctatgagagagatgtggacctgggggccggaacgcgccatgtcgcggttgaacccgaggtggccaatcttgatattatcggccagagaattgaaaacatcaaaaatgagcaccggagcacatggcactacgacgaggataacccctataagacctgggcttaccatgggtcttatgaagtgaaaccttccggaagcgcctcttccatggtcaatggcgtggttcgcctgctcaccaagccctgggacgtgattcctatggtcacacagatcgctatgacggataccacaccgttcggccaacagagagtgtttaaggagaaagttgacacccggacacccagagccaagcgggggaccacacagatcatggaagtgaccgctaaatggctgtggggattccttagccgcaacaagaaacctagaatttgtacgcgggaggaatttacccgcaaggtcagatccaatgccgcgatcggcgccgtgttcgttgacgagaaccagtggaatagcgctaaggaggccgtggaagatgagcggttttgggacctggtccaccgcgaaagagagctccataaacaagggaagtgcgctacatgcgtgtacaacatgatgggaaaacgggaaaagaaactgggcgagttcgggaaggccaagggctctcgcgccatttggtatatgtggctgggagcgagattcctcgagtttgaagctctgggcttcatgaatgaggatcactggtttagccgggaaaactccctttctggggtcgagggagagggcctgcataaactcgggtacatcctgcgcgacattagcaagatccccggaggcaatatgtacgccgatgacaccgccgggtgggatacaagaatcaccgaagacgatcttcagaacgaggctaaaattacggacatcatggaacctgagcacgccctgctcgctacatccattttcaagctgacctatcagaataaagtggttcgggtgcagcgccccgccaagaacggcacagtcatggatgtgatctctagacgggaccaaagaggaagcggccaggtggggacctacggactgaacacgtttaccaatatggaagttcagctcattcgccagatggagtccgagggcatcttcctgccgtctgaacttgagacacctaacctggcggaacgggccctcgattggctggagaaacacggggctgaaagacttaagcgcatggccatcagcggagacgactgtgtggtcaagcccattgatgaccggtttgctaccgccctgacagcgctcaatgatatgggcaaagtgagaaaggacatccctcaatgggagccctccaaagggtggaacgattggcagcaggttcctttctgcagccatcactttcatcagctgattatgaaggacggccgcgagatcgtggtcccctgtcggaatcaagatgaactggtgggaagagcccgcgtctctcagggcgctgggtggtccctccgggagaccgcctgcctgggaaaaagctatgctcagatgtggcaacttatgtacttccacagacgcgacctgcggctcgccgctaacgccatttgttctgcggtgccggttgattgggtgcctgcctccagaacaacctggagcatccacgctcatcaccagtggatgacgacagaagacatgctgtccgtctggaatcgggtgtggatcgaggaaaacccctggatggaggataagacccatgtttctagctgggaggaagtgccctatcttggcaagagagaggaccagtggtgcgggtccctgattggactcaccgcccgcgccacatgggctaccaatatccaggtcgccattaaccaagtgcggagactgatcggcaatgaaaactacctggactatatgacaagcatgaaacgctttaagaatgagtctgatcctgagggggcgctctggtga

SEQ ID NO: 19409 - RNA, 9879 nt, synthetic construct
  misc_feature 1..9879: note = derived and/or modified CDS sequence (opt5) from DENV-1__KC692513__SS-prME
  source 1..9879: mol_type = other RNA
agcgtgaccatgctgctgatgctgcttcccacagccctggctttccacctcacgaccagaggaggggagcctcatatgatcgtgtccaagcaggaacggggaaaatctctgctttttaagacaagcgttggcgtgaacatgtgcaccctgattgccatggaccttggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaggaacaagatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacaccgcaagagacctggaatcggcaggatctgctggtcacattcaagaccgctcacgcgaagaaacaggaagtggttgtgctcggatcccaagagggcgccatgcacaccgctctgacaggggccacggaaattcagacctctggaacaaccacaatctttgccggccatcttaagtgccgcctgaaaatggacaagctcaccctgaaagggatgagctatgtcatgtgtacgggctccttcaagctggagaaggaagtggctgagacacagcacggaaccgttcttgtgcaggtcaaatacgagggcaccgatgccccttgcaagattcccttcctcacacaagacgaaaaaggggtgacccagaacggaagactgatcacagcgaatcctatcgtgacggataaggagaaacccgttaacattgaaaccgagcccccttttggcgagagctatatcgtcgtgggggctggagaaaaggccctgaagctctcttggttcaaaaagggctccagcattgggaaaatgtttgaggccacagctcggggcgccagacgcatggctatcctgggagacaccgcctgggatttcggctctattgggggactttttacaagcgtgggcaagctgatccatcaggtcttcgggaccgcgtacggagtgctcttttccggcgtttcttggacgatgaaaatcgggattggcatcctgctgacctggcttggactcaatagccggtccacaagcctgtctatgacctgtattgccgtgggcatggtcacactgtacctcggggtgatggttcaggctgactccggatgcgtgatcaactggaagggcagagaactgaagtgtgggagcggaattttcgtcaccaacgaggtgcacacatggaccgaacaatataaatttcaggccgattctccgaagcgcctttccgctgccatcggcaaagcgtgggaggagggggtttgcggcattcggagcgccacgagactggaaaatatcatgtggaagcagatctccaacgagctcaattacattctgctggaaaacgacatgaaattcacagtggtcgtgggagacatcaatggcattcttgctcaggggaagaaaatgatccgcccccaacctatggagcataagtattcttggaaaagctggggaaaggccaagattatcggcgctgatatccagaacaccacctttattatcgacgggcccgatacacctgaatgtcccgacgatcagcgggcctggaatatttgggaggtggaggactacggattcggcatctttaccacgaacatttggctcaaactgagagattcccacacacagatgtgcgaccaccgcctgatgtctgccgctatcaaggatagcaaagcggtccatgccgacatgggctattggatcgaatccgagaagaatgaaacctggaagctcgctcgggccagcttcattgaggttaaaacatgtatctggccgaagtctcacaccctgtggtccaacggggtgcttgaaagcgagatggtgattcctaaaatctacggaggccccatttctcaacataattatagacctgggtacttcacacagaccgccggaccctggcacctgggcaagctcgagctggattttgacctgtgcgaagggacgaccgtcgtggttgatgagcactgcggataccgcggcccttcccttcggacaaccacagtgaccggcaaaatcatccatgaatggtgttgcagaagctgtacgctgcccccgctgcggttccgcggggaggacggatgctggtatggcatggagattagacctgtcaaggaaaaggaggaaaacctggtgcggtctatggttagcgctgggtccggagaggtggacagcttttctctcggcatcctgtgtgtctccattcttatcgaagaggtgatgagaagccgctggtcccggaaaatgctgatgacagggaccctcgccgttttcctgctgcttattatgggacagctgacatggaatgatctcatcagactgtgcattatggtgggcgcgaacgcttctgaccgcatgggcatggggaccacctacctcgccctgatggccacatttaagatgagacccatgttcgctgtcggacttctgtttcggcgcctcacgagcagagaggtgctgctgcttaccgtgggcctgtccctcgtcgcctctgttgaactgcccaatagcctcgaggaactgggggatggacttgcgatgggcatcatgatgctgaaactcctgacagacttccaacctcaccagctgtggaccacacttctgtccctcacctttatccggacgtctctgagcctcgattatgcttggaagacaatggccatggccctgtccattgtgagccttttcccgctgtgtctgtctaccacctcccagaaaacaacctggctccccgtgctgcttgggagctttggatgcaagcctctgacaatgttcctcatcacggagaacaagatttggggccgcaaatcttggcccatcaacgaaggcattatggctgtcgggatcgtgtccatcctgctcagctctctgcttaagaatgacgttcctctggccggacccctgattgctggcgggatgctcatcgcctgttacgtgatttccggaagctccgcggatctgagccttgagaaagccgctgaggtctcttgggaagaggaagccgagcatagcggcacctcccacaacatcctggtggaagttcaggacgatgggacaatgaagattaaagacgaggagagagatgacaccctcacaatcctgctcaaggctaccctgcttgccgtgtctggagtctatcctatgagcatccccgccacgctgtttgtgtggtacttctggcagaagaagaagcagcggtccggcgtcctgtgggataccccgtctcctcccgaagtggagcgcgctgttctcgacgacggcatttatagaatcctgcagcgggggcttctgggacgcagccaggtgggcgtcggggtgttccaagatggagtttttcatacaatgtggcacgtgaccagaggcgcggtcctcatgtaccaggggaaacggctggaaccttcctgggcctctgtgaagaaagacctcattagctacggaggcggctggagattccaggggtcctggaatacaggagaggaggtgcaggttatcgctgtcgaacccggcaagaacccgaaaaatgtgcaaaccacacctgggacgtttaagacccccgagggagaagtgggcgccattgccctggatttcaagcctgggacaagcggatctcccatcgtcaaccgcgagggcaaaattgtgggcctttatgggaatggagttgtgaccacctccggcacatacgtcagcgctatcgcccaggcgaaggctacgcaggaagggcccctgcctgagatcgaggacgaagtgtttaaaaagcggaacctgaccattatggatctccacccgggatctggcaaaacaagacgctatctgcccgccatcgttcgggaggccattaagagaaaacttcgcaccctgatcctcgctcctacacgggtggtcgcctccgaaatggcggaggctctgaaagggatgcccattagataccaaaccacggccgtcaagagcgaacatacaggccgcgagatcgttgacctgatgtgccacgccaccttcaccatgcggctcctttcccctgtgagagtccccaattataacatgatcattatggatgaggctcattttacagaccctgcctctatcgctgcccggggatacattagcacccgcgtgggcatgggggaagcggccgctatcttcatgacagccaccccgcccggatccgtggaggcttttcctcagagcaatgccgtcattcaggatgaagagagagacatccccgaacggtcttggaactccggctatgattggatcacggacttccctgggaaaacagtttggtttgtgcccagcattaagtctggaaatgacatcgccaactgtctgcgcaaaaatggcaagagagtgattcagctgagccggaagaccttcgatacagagtaccagaagaccaagaacaacgactgggattacgtcgtgacgaccgacatctccgagatgggggctaatttcagagcggatcgcgttattgacccgcggagatgcctcaaacctgtgatcctgaaggaaggccccgagcgcgtcattcttgccggacccatgcctgtgacagttgcttctgccgcccagcggagaggccgcatcgggcggaaccagaataaagaaggagatcagtatatctacatgggccaacccctgaacaatgacgaggatcacgctcattggaccgaggccaagatgctcctggacaacattaatacacctgaagggatcattccggcgctgtttgagcccgaaagagaaaagagcgctgccatcgatggagaatatcgcctcagaggcgaggcccggaaaaccttcgtggagcttatgcgcagaggggacctgcctgtctggctgtcctacaaggtggcttctgaaggctttcagtatagcgatcggcgctggtgcttcgacggagagagaaacaatcaggtcctcgaagagaacatggacgtggaaatttggacaaaagagggcgagcggaagaaactgagaccccgctggcttgatgcccggacctactccgaccctctggcgctcagagaatttaaggagttcgccgctgggcgccggagcgtttctggagatctgatcctggaaatcggcaaactcccccagcaccttacgctgagagcccaaaatgctctggacaacctcgtgatgctgcacaattccgagcaagggggaaaggcctatcggcatgctatggaggaacttccggatacaattgagaccctgatgctcctggccctgatcgcggtgctcaccggcggcgtcacactctttttcctgagcgggaagggactgggcaaaacctccattgggctcctgtgtgttatggcctctagcgcccttctctggatggcttccgtggaacctcactggatcgctgcctctattatcctcgagtttttcctgatggtgctgctcatccccgaacctgaccgccagagaacaccccaggataaccaacttgcctacgtcgtgattggactgctgtttatgatcctcacggttgctgcgaatgagatgggcctgcttgagaccacaaagaaagacctggggattggacatgtggccgtcgaaaaccaccaccatgctaccatgctcgatgtggacctgcggcctgccagcgcctggacactgtacgctgtcgccaccacggtgatcacccccatgatgcgccacacaattgagaacaccacagcgaatatctccctcaccgccattgctaaccaggccgctatccttatgggcctggataagggctggccgatcagcaaaatggacattggggttcctctgctcgccctgggatgctattctcaggtgaatccccttacgctgacagcggccgtcctcatgctggtggctcattacgccatcattggccccgggctgcaagctaaggccaccagagaagctcagaagcggacagccgcgggaatcatgaaaaaccctaccgttgatggcattgtgaccatcgacctcgacccggtcgtgtatgatgccaagttcgagaaacagcttgggcagatcatgctgctgattctctgtacatcccaaatcctgcttatgcgcacgacctgggctctgtgcgaaagcattacactcgccaccggacccctgacaaccctgtgggagggctctcctggcaagttttggaatacgacaatcgctgtgtccatggccaacattttcagagggagctacctcgccggagcgggccttgctttctctctgatgaaaagcctcgggggaggccggcgcgggaccggagcccagggcgagaccctcggcgaaaagtggaagagacagctgaatcagctttccaaatctgagtttaacacatataagaaaagcgggatcatggaagttgaccggtccgaggctaaggaaggactgaaaagaggcgagaccacaaagcacgccgtcagccgcgggacggccaagctccggtggttcgtggagagaaatctggtgaaacccgaaggaaaggtcatcgatctgggctgtgggcgcggaggctggtcctactattgcgctggcctcaaaaaggttaccgaggtgaaagggtacacaaagggaggccctgggcatgaggagcccattcctatggccacctacggatggaaccttgtgaaactgcactctggcaaggacgtctttttcacaccgcccgaaaagtgtgataccctgctctgcgacatcggggagagctcccctaatcccacgattgaggaaggacggaccctgagagtgcttaaaatggttgagccttggctgcgcggcaaccaattttgtatcaagattctcaatccctatatgccgtctgtggtcgaaacactggagcagatgcagcggaaacacggcgggatgctggtgagaaaccctctcagccgcaattccacccatgagatgtactgggtttcttgcggaacaggcaacatcgtgagcgcggtcaatatgacctcccggatgctgcttaacagattcacaatggcccaccgcaagcccacctatgaacgggatgtggacctgggggctggaacgagacatgtggccgtcgagcccgaagttgctaacctcgatattatcggccagcgcatcgagaatattaaaaacgaacacaagagcacatggcactacgacgaggataatccttataagacctgggcctaccatgggtcttatgaggtgaaaccctccggaagcgcgtcttccatggtgaacggcgtcgtgagactgcttaccaagccttgggacgttatcccgatggtgacacaaattgccatgacggacaccacaccctttggccagcagcgggtcttcaaagaaaaggtggatacccgcacacctagagctaaacgggggaccgcccaaatcatggaggttacagctaagtggctgtggggatttctcagcagaaataagaaaccccggatttgtacccgcgaagagttcacgagaaaggtgcggtctaacgccgctatcggcgccgtctttgtggacgaaaatcagtggaactccgcgaaagaggccgttgaggatgaacgcttctgggacctggtgcacagagagcgggaactgcataagcaggggaaatgcgctacctgcgtctacaatatgatgggaaagcgcgagaagaaactcggcgaatttgggaaggccaaaggcagcagagctatctggtacatgtggctgggagcccggttccttgagttcgaggccctgggctttatgaacgaagatcactggttctcccgcgagaatagcctctctggggtggaaggagagggcctgcataaacttgggtatattctgagagacatcagcaaaattcctggaggcaacatgtacgcggatgacacagctgggtgggatacccggatcacagaggacgatctccagaatgaagccaagattaccgacatcatggagcccgaacacgccctgctggctacgtccatctttaaactcacatatcaaaacaaggtcgtgcgcgttcagagaccggccaagtctggcaccgtgatggatgtcattagccggcgcgaccagagaggatccggccaggtggggacatacggactgaataccttcacgaacatggaggtgcaacttatccggcagatggaatctgagggcatttttagcccttccgagctggaaacccccaacctcgctaaaaaggttctggactggcttgagaaacacggggccgaaagactgaagcgcatggcgatctctggagatgactgtgtggtcaaacctattgatgaccggttcgccacagctctcaccgccctgaatgatatgggcaaggtgagaaaggacatcccccagtgggagcctagcaaagggtggaacgattggcagcaagttcccttttgctcccatcacttccatcagctgatcatgaaggacggccgcgaaattgtggtcccgtgtcggaatcaggatgagctcgtgggcagagctcgcgtcagccagggcgccgggtggtctctgcgggagacagcgtgccttggaaaatcctatgcccaaatgtggcagctgatgtactttcacagacgcgacctccggctggctgccaacgctatctgtagcgccgtgcctgttgattgggtgcccacctctagaacaacctggtccattcacgctcatcaccagtggatgacgacagaagacatgcttagcgtctggaatcgcgtgtggatcgaggaaaacccctggatggaggacaagacccatgtttcctcttgggaagaggtgccttatctgggcaaacgggaggatcaatggtgcgggagcctcattggactgaccgccagagcgacatgggccaccaatatccaggtcgctattaaccaggtgcggagactgatcggctccgaaaattacctcgactacatgacaagcatgaagcgcttcaagaacgagtctgatccggaaggggccctgtggtga

SEQ ID NO: 19410 - RNA, 9879 nt, synthetic construct
  misc_feature 1..9879: note = derived and/or modified CDS sequence (opt5) from DENV-1__KC692514__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggcggcagattcagcgcgttgagacatgggctcttagacaccccggcttcaccgtgatcgcctttttcctggcgcatgccattgggacatctatcacccagaaaggaatcatttttatcctcctgatgcttgtcacccctagcatggctatgcggtgcgtgggcattgggaaccgcgacttcgttgagggactgtccggcgccacatgggtggatgtcgtgctcgaacacgggagctgtgtgacgaccatggctaagaataagcccacactggacatcgagctgctcaaaaccgaagtcacaaaccctgccgttctgagaaagctttgcattgaggcgaaaatctctaataccacgacagattcccggtgtccgacccaaggagaagccaccctggtggaggagcaggacgctaactttgtgtgccgcagaacattcgtcgatcggggctggggcaatgggtgtggactctttggcaaggggagcctgcttacctgcgccaaattcaagtgcgtgacaaagctggaaggaaaaattgttcagtacgagaacctcaagtattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccgcacaggcctggactttaacgagatggtgcttctgaccatgaaagagaagtcttggctcgtccataaacagtggttcctggatcttcctctgccctggacgtccggggctagcacatcccaagaaacctggaatagacaggacctcctggtgacatttaagaccgcgcacgccaaaaagcaggaggtcgtggttctgggatctcaagaaggcgctatgcacaccgccctcacaggggccacggagattcagaccagcggaacaaccacaatcttcgctggccatctgaagtgccggcttaaaatggataagctgaccctcaaagggatgtcctatgtgatgtgtacgggcagcttcaagctggaaaaagaggtcgccgagacacagcacggaaccgtgctggttcaggtgaagtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatgtgcgaccaccgccttatgtccgcggccattaaagatagcaaggctgtgcatgccgacatggggtattggatcgagtctgaaaaaaatgagacctggaagctcgcccgggcttccttcattgaagtgaaaacatgtacctggcccaagagccacacactgtggtctaacggagtcctggagtccgagatgatcatcccgaagatttttggcgggcctatcagccaacataattacagacccggatatttcacccagacggccggcccttggcacctcgggaaactggaacttgattttgacctgtgcgagggaaccacagtggttgtggatgaacactgcggcaaccggggcccctctctccgcaccacaaccgtcacggggaagattatccatgagtggtgttgcagaagctgtacactgcctcccctgcggttcagaggagaggacggctgctggtacgggatggaaattcgcccggtgaaagagaaggaagagaatcttgttcggtccatggtgagcgcgggatctggcgaagtcgattcctttagcctcgggatcctgtgtgtgtccatcatgattgaggaggttatgagatctcgctggagcagaaaaatgctgatgaccggaacactcgctgtgttcctgcttctgatcatgggccagctcacctggaacgacctgattcggctgtgcatcatggtcggcgccaatgcctccgaccgcatggggatgggaaccacataccttgctctgatggccacgtttaagatgagacctatgttcgcggtgggcctcctgtttcggcgcctcacctctagagaagtgctgcttctgacaattgggctcagcctggtcgcttccgttgagctgcccaactctcttgaagagctgggagatggcctcgccatggggatcatgatgctgaagctcctgaccgaattccaaccccaccagctttggacaaccctgctcagcctgacgtttgtgaaaacaaccctgtcccttgactatgcctggaagaccacagctatggtgctgagcattgtctctctcttccctctgtgtctctccaccacaagccagaaaacgacctggctgccggtgcttctgggatcttttggctgcaagcccctgacaatgttcctcatcaccgagaacaaaatctggggccggaagtcctggcctctgaatgaggggattatggccatcggaattgttagcatccttctgtcttccctcctgaagaacgatgtgcccctcgctggccctctgattgccgggggaatgcttatcgcgtgttacgtcatcagcggctccagcgccgacctgtctctggaaaaagctgccgaggtgagctgggaacaggaggctgaacattccggggcctctcacaatattctcgttgaggtgcaagatgacggaacaatgaagatcaaagatgaggaacgcgacgataccctgacgattcttctgaaggccaccctcctggctgtcagcggcgtgtatcccatgtccatccctgcgacactcttcgtctggtacttttggcagaaaaagaaacagagatctggcgtgctgtgggacacccccagcccgcctgaggttgaacgggccgtgcttgatgacgggatttatcgcatcctgcagagaggactgctcggccggtcccaagtcggggtgggagttttccaggatggcgtgtttcatacaatgtggcacgtcaccagaggggctgtgctgatgtaccagggaaagcgccttgagccctcttgggccagcgtgaagaaagacctgatctcctatggcggcgggtggcggttccagggaagctggaacacaggcgaggaagttcaagtcattgccgtggagcctgggaagaatcccaaaaacgtgcagacgaccccgggaacatttaagacccctgaaggcgaggtcggggctatcgccctcgacttcaaacccggaacctctggctcccctattgtgaatagagaaggcaagatcgttgggctgtacggaaacggcgtggtcacaacgagcgggacctacgtgtctgcgattgctcaggccaagacatcccaagagggacccctccccgagatcgaagatgaggtttttaaaaagcgcaatctgaccattatggaccttcaccctggcagcgggaaaacacggagatatctgccggccatcgtgcgcgaagctatcaagcggaaactgagaaccctcattctggcccccacgcgcgtcgtggcgtccgagatggctgaagcccttaagggcatgcctatccggtaccagacaaccgccgttaagtctgagcataccggaagagagattgtggatctgatgtgccacgctacattcaccatgcggctcctgagccccgtccgcgtgcctaactataatatgatcattatggacgaagcccattttacagatcccgcttccatcgccgcgagaggctacatcagcacccgggtggggatgggagaggccgctgccattttcatgacggctacacctccgggctctgtcgaagcctttccccagtccaacgccgttatccaggacgaggaacgcgatattcctgagagaagctggaattctgggtatgactggatcaccgatttccccggaaaaacagtgtggttcgtgcctagcattaagtccggcaacgacatcgctaattgtctgcggaaaaacgggaagagagtcatccaactctctcgcaaaacctttgatacggagtaccagaagaccaagaacaatgactgggactatgtggttacaaccgatattagcgaaatgggcgcgaacttccgggccgacagagtgatcgatccccgccggtgccttaaaccggtcattctgaaggacggacctgagagagtgatcctggctggccccatgcccgttacagtggcctccgccgctcagcgccgggggagaattggacgcaatcagaacaaagaaggcgatcaatacgtctacatggggcagcctctcaataacgacgaggatcacgcccattggaccgaggcgaagatgctgcttgacaatatcaacacacccgaaggaattatccctgctctgtttgagccggaaagagagaaatctgccgccatcgatggcgaatatcggctccgcggggaggctagaaagaccttcgtggagctgatgcggcgcggcgacctgcccgtctggctcagctacaaggtggcctccgaaggatttcagtatagcgatagacggtggtgcttcgacggcgagagaaataaccaggttcttgaagagaatatggatgtggaaatttggacgaaagagggggagcgcaagaaactgcggcctagatggctggacgcgcgcacatactctgaccccctcgccctgcgggaatttaaggagttcgctgccggaagacggtccgtgagcggcgatcttatcctggaaattgggaaactccctcaacacctgaccctgcgcgctcagaacgccctcgacaatcttgtcatgctgcacaactccgagcagggaggcaaggcttatagacatgccatggaagagctgcccgataccatcgagacactcatgctgcttgcgctgattgccgttctcaccggcggggtgacactgtttttcctgtctggaaaaggcctcgggaagacgagcatcggacttctgtgtgtgaccgcttcctctgccctgctctggatggctagcgtcgaaccgcactggatcgccgcctccattatcctggagtttttccttatggtgctgctcattcctgaacccgaccggcagcgcacacctcaagataatcagctggcttacgttgtgatcggcctgctctttatgattcttaccgtcgcggccaacgagatggggctgctggagacaaccaagaaagacctcggaatcggctatgtggctgccgaaaaccatcagcacgccacgatgctggatgtcgaccttcaccccgctagcgcctggaccctgtacgcggtggccacaaccgttatcacacctatgatgagacataccattgagaatacgacagctaacatctctctcaccgccattgctaatcaagccgcgatcctgatgggcctggataaggggtggcccatttccaaaatggacatcggagtgccgctccttgccctgggctgctacagccaggtcaaccctctgacactcaccgctgccgtgctgatgcttgttgctcactatgccattatcgggcccggactgcaggctaaggccacccgggaagcgcagaaacgcacagccgctggcatcatgaagaatcccacggtggatgggattgtcgccatcgacctcgatcctgtggtgtacgacgctaagttcgagaaacaactgggacagattatgctgctcatcctttgtacctctcagattctgctgatgagaacaacctgggccctctgcgaatccatcacactggccaccggcccgcttacgacactgtgggagggcagccccgggaagttctggaacaccaccatcgcggtttctatggctaatatttttcggggaagctatctcgccggcgctgggctggccttctccctgatgaaatctctcggaggcgggcgcagaggaacaggcgcccagggcgagacccttggggaaaagtggaaacggcaactgaaccagctgagcaagtccgagtttaatacatacaagagaagcggaatcatggaagtcgaccgctccgaggctaaagaaggcctcaagcggggggagacgaccaaacatgccgtgtctagaggaacagcgaagctgcgctggttcgtggagcggaaccttgtcaaacctgaaggcaaggttattgatctggggtgtggaagaggcggctggagctattactgcgccgggctcaagaaagtgaccgaggtgaagggatatacaaaaggcgggcccggacacgaagagcctatccccatggctacctacggctggaatctggtcaagctgcattccgggaaagacgtgtttttcatgcctccggaaaagtgtgatacgctcctttgcgacattggagagtctagccccaaccctaccatcgaggaaggccgcacactgcgggttctgaaaatggtggagccctggctcagaggcaatcagttttgtatcaagattctgaacccttacatgccctccgtcgtggaaacccttgagcagatgcaacgcaagcacgggggaatgctggttcggaatccgctctctagaaacagcacacacgagatgtattgggtgtcctgcggcaccgggaatatcgtcagcgccgtgaacatgacatctcgcatgctgctgaaccggttcaccatggctcatagaaaacctacgtacgaacgcgatgtggacctcggagccggcacaagacacgtcgcggttgagcccgaagtggccaatctggatattatcgggcagcggattgagaacatcaagaatgaacataaatccacctggcactatgacgaggataacccctacaagacctgggcttatcacggaagctacgaggtgaaaccttctggctccgccagctctatggtcaatggcgtggttcgccttctgacaaagccctgggacgtgattcctatggtcacgcagatcgctatgaccgatacaaccccgtttgggcaacagagagtgttcaaggaaaaagttgacacacggacccccagagccaagcggggaacaacccagatcatggaggtgacggctaaatggctctggggctttctgtcccgcaacaagaaacctagaatttgtacccgggaagagttcacacgcaaggtcagaagcaatgccgcgatcggggccgtgtttgttgacgaaaaccagtggaattccgctaaggaggccgtggaggatgaacggttctgggaccttgtccatcgcgagagagaactgcacaaacaaggaaagtgcgctacctgcgtgtataacatgatgggcaaacgggagaagaaactcggggaattcggcaaggccaagggaagccgcgccatttggtacatgtggctgggcgcgagatttctggagttcgaggctctcgggtttatgaatgaagatcattggttctctcgggagaacagcctgtccggagtcgaaggcgaggggcttcacaaactgggatacatcctccgcgacatttctaagatccccggcgggaatatgtatgccgatgacacagccggctgggataccagaatcacggaggacgatctgcagaacgaagctaaaattacagacatcatggagcctgaacatgcccttctggctaccagcatttttaagctcacataccagaataaagtggttcgggtgcagcgccccgccaagaacggaaccgtcatggatgtgatctccagacgggaccaaagaggctctgggcaggtgggaacgtatggcctgaacaccttcacaaatatggaggttcagctgattcgccagatggaaagcgaggggatctttctcccgtccgagctggaaacccctaaccttgcggagcgggccctggattggctcgaaaaacacggagctgagagactgaagcgcatggccatctctggcgacgactgtgtggtcaagcccattgatgaccggttcgctacagcccttaccgcgctgaatgatatggggaaagtgagaaaggacatccctcaatgggaacccagcaaaggctggaacgattggcagcaggttcctttttgctcccaccatttccaccagctcattatgaaggacggacgcgagatcgtggtcccctgtcggaatcaagatgagctggtgggcagagcccgcgtcagccagggggctggatggtctctgcgggaaacagcctgcctcggcaaatcctacgctcagatgtggcaactgatgtattttcatagacgcgaccttcggctggccgctaacgccatttgtagcgcggtgccggttgattgggtgcctgcctctagaaccacgtggtccatccacgctcaccatcagtggatgacaaccgaggacatgctcagcgtctggaatcgggtgtggatcgaagagaacccctggatggaagataagacccacgtttcctcttgggaggaggtgccctacctggggaagagagaagaccagtggtgcggaagccttattggcctgacagcccgcgccacctgggctacaaatatccaggtcgccattaaccaagtgcggagactcatcgggaatgagaactatctggactacatgacgtccatgaaacgcttcaagaatgaaagcgatcctgagggcgcgctgtggtga

SEQ ID NO: 19411 - RNA, 9879 nt, synthetic construct
  misc_feature 1..9879: note = derived and/or modified CDS sequence (opt5) from DENV-1__KC692515__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggactttgttgagggactctccggcgccacatgggtggatgtcgtgctggaacacgggagctgtgtgacgaccatggctaagaataaacccacactggacatcgagctcctgaagaccgaagtcacaaaccctgccgttcttcgcaaactgtgcattgaggcgaagatctctaataccacgacagattccagatgtccgacccaaggagaagccaccctcgtggaggagcaggacgctaacttcgtgtgccggcgcacatttgtcgatagaggctggggcaatgggtgtggactgttcggcaaagggagccttctgacctgcgccaagtttaagtgcgtgacaaaactcgaaggaaagattgttcagtacgagaacctgaaatattctgtgatcgtcacggtgcacaccggcgaccagcatcaagttgggaatgaaacaaccgagcacggaacaatcgctaccattacgccccaggcccctacctccgaaatccagctgacagattacggcgccctcaccctggactgtagcccccggacaggccttgacttcaacgagatggtgctgctcaccatgaaggagaaatcttggctggtccataagcagtggtttcttgatctgcctctcccctggacgtccggggctagcacatcccaagaaacctggaatcgccaggacctgctggtgacattcaaaaccgcgcacgccaagaagcaggaggtcgtggttctcggatctcaagaaggcgctatgcacaccgccctgacaggggccacggagattcagaccagcggaacaaccacaatctttgctggccatcttaaatgcagactgaagatggataaactcaccctgaaggggatgtcctatgtgatgtgtacgggcagcttcaaactggaaaaggaggtcgccgagacacagcacggaaccgtgcttgttcaggtgaagtacgaaggcaccgacgcgccgtgcaaaattcctttctctacacaagatgagaagggggtcacccagaacggacggctcatcacagctaatcccatcgtgacggacaaagaaaagcctgtgaacattgagaccgagcccccctttggcgaatcctatatcgttgtcggggccggaggcaaagccctgaagctgagctggttcaagagagggtctagcattggcaaaatgtttgaggctacagcccgcggagctcggagaatggccatcctcggcgataccgcgtgggacttcgggtccattggaggcgtgtttacatctgtggggaagctggtccatcaggtgttcggaaccgcctacggcgttctttttagcggggtgtcctggacgatgaaaatcggcatcggaattctgctcacctggctgggcctgaatagccgctctacatcccttagcatgacctgtatcgctgtcgggatggtgacactctacctgggagttatggtgcaggccgattctggctgcgtcattaactggaaggggcgggaactgaaatgtggatccggcatcttcgtgaccaacgaggttcacacatggaccgaacaatataagtttcaggctgacagccctaagagactctccgccgcgattgggaaagcctgggaggagggcgtgtgcggaatccgctctgctacgcggctggaaaatattatgtggaagcagatcagcaacgagcttaatcatatcctgctcgaaaacgatatgaaattcacagtcgtggtgggcgacgccaatgggattctggctcagggaaagaaaatgatcagaccgcaacccatggagcacaagtactcctggaaatcttggggcaaggccaagattatcggggccgacattcagaacaccacctttatcatcgatggacctgacacacccgaatgtcctgatggccagcgcgcttggaatatttgggaggtcgaggactatggcttcggggtttttaccacgaacatctggctgaaacttcgggatagctacacacagatgtgcgaccacagactcatgtccgcggccattaaggatagcaaagctgtgcatgccgacatgggatattggatcgaatctgagaagaatgaaacctggaaactggcccgcgcttccttcattgaggtgaagacatgtacctggcccaagagccacacactgtggtctaacggcgtcctcgaatccgagatgatcatcccgaaaattttcgggggacctatcagccaacataattaccggcccggctattttacccagacggccgggccttggcacctgggaaagcttgagctggatttcgacctctgcgaaggcaccacagtggttgtggatgagcactgcggcaacagagggccctctctgcggaccacaaccgtcacgggaaaaattatccatgaatggtgttgccgcagctgtacactgcctccccttagatttcggggcgaggacgggtgctggtacggaatggagattagaccggtgaaggaaaaagaggaaaatctcgttcgctccatggtgagcgcgggctctggggaggtcgattccttcagcctgggaatcctgtgtgtgtccatcatgattgaagaggttatgcggtctagatggagccgcaagatgctcatgaccggcacactggctgtgtttcttctgctcatcatgggccagctgacctggaacgacctgattagactttgcatcatggtcggggccaatgcctccgaccggatgggaatgggcaccacatacctggctctcatggccacgttcaagatgcgccctatgtttgcggtggggctgctcttcagacggctgacctctcgcgaggtgcttctgctcacaattggactgagcctggtcgcttccgttgaacttcccaactctctggaggaactcggcgatgggctggccatgggaatcatgatgctcaaactgcttaccgagtttcaaccccaccagctgtggacaaccctcctgagcctgacgttcgtgaagacaaccctttccctggactatgcctggaaaaccacagctatggtgctcagcattgtctctctgtttcctctctgtctgtccaccacaagccagaagacgacctggcttccggtgctgctgggctctttcggctgcaaacccctcacaatgtttctgatcaccgaaaacaagatctgggggagaaagtcctggcctcttaatgagggaattatggccatcggcattgttagcatcctgctctcttccctgctcaaaaacgatgtgcccctggctgggcctcttattgccggaggcatgctgatcgcgtgttacgtcatcagcgggtccagcgccgacctgtctctcgagaaggctgccgaagtgagctgggagcaggaagctgagcattccggagcctctcacaatattctggttgaagtgcaagatgacggcacaatgaaaatcaaggatgaggagcgggacgatacccttacgattctgctcaaagccaccctgctcgctgtcagcggcgtgtatcccatgtccatccctgcgacactgttcgtctggtacttctggcagaagaaaaagcagcgctctggggtgctttgggacacccccagcccgcctgaagttgagagagccgtgctggatgacggaatttatcggatcctgcagcgcggcctcctggggagatcccaagtcggagtgggcgtttttcaggatggggtgttccatacaatgtggcacgtcacccggggagctgtgcttatgtaccagggcaagagactggaaccctcttgggccagcgtgaaaaaggacctcatctcctatggcgggggatggcgctttcagggcagctggaacacaggggaggaggttcaagtcattgccgtggaacctggaaaaaatcccaagaacgtgcagacgaccccgggcacattcaaaacccctgagggggaagtcggagctatcgccctggactttaagcccggcacctctggctcccctattgtgaatcgggaggaaaagatcgttgggctctacggaaacggcgtggtcacaacgagcgggacctacgtgtctgcgattgctcaggccaaagcctcccaagagggacccctgcccgagatcgaagatgaggttttcaagaaaagaaatcttacaattatggacctgcaccctggcagcgggaagacccgccggtatctgccggctatcgtgagagaagccatcaaacgcaagctccggacactgattcttgcgcccaccagagtcgtggcttccgagatggccgaagccctgaagggcatgcctatccgctaccagacgacagctgttaaatctgagcataccggacgggagattgtggatctcatgtgccacgccacctttacaatgagactgctgagccccgtccgggtgcctaactataatatgatcattatggacgaagctcatttcaccgatcccgcctccatcgcggcccgcggctacatcagcacaagagtggggatgggagaggctgccgctatttttatgaccgccacgcctccgggctctgtcgaagccttcccccagtccaacgctgttatccaggacgaggaacgggatattcctgagcgcagctggaattctgggtatgactggatcacagattttcccggaaagaccgtgtggttcgtgcctagcattaaatccggcaacgacatcgcgaattgtctcagaaagaacgggaaacgggtcatccaactttctagaaagacattcgataccgagtaccagaagacgaaaaacaatgactgggactatgtggttaccacagatattagcgaaatgggcgccaactttcgcgctgaccgggtgatcgatcccagacgctgcctgaagccggtcattctgaaagacggacctgagcgggtgatcctcgccggccccatgcccgttaccgtggcctccgctgcccagagacgcgggcggattggaagaaatcagaacaaggaaggcgatcaatacgtctacatggggcagcctctgaataacgacgaggatcacgcgcattggacagaggctaaaatgcttctggacaatatcaacacccccgaaggaattatccctgccctcttcgagccggaacgcgagaagtctgccgctatcgatggcgaatatagactgcggggggaggcccgcaagacatttgtggagctgatgagacggggcgacctccccgtctggcttagctacaaagtggcgtccgaaggattccagtatagcgatcgcagatggtgctttgacggcgagcggaataaccaggttctggaagagaatatggatgtggaaatttggaccaaggagggggagagaaaaaagctgcgccctcggtggctcgacgccagaacgtactctgaccccctggctcttcgcgaattcaaagagtttgccgctggacggagatccgtgagcggcgatctgatcctcgaaattgggaagctgcctcaacacctgacactccgggcccagaacgctcttgacaatctggtcatgctgcacaactccgagcagggaggcaaagcctatcgccatgcgatggaagagctccccgataccatcgagaccctgatgcttctggccctcattgctgttctgacaggcggggtgaccctgttctttctctctggaaagggccttgggaagacaagcatcggactgctgtgtgtgacggcctcctctgctctcctgtggatggccagcgtcgaaccgcactggatcgccgcttccattatccttgagttctttctgatggtgctcctgattcctgaacccgacagacagcggacccctcaagataatcagctggcgtacgttgtgatcggcctccttttcatgattctgacagtcgccgctaacgagatggggctgctcgagaccacaaaaaaggacctgggaatcggccatgtggccgccgaaaaccaccagcacagcaccatgcttgatgtcgacctgcatcccgcttctgcctggacgctctatgcggtggccaccacagttatcacccctatgatgcgccacacaattgagaataccacggctaacatctccctgacagccattgctaatcaagccgcgatcctgatgggcctcgataaagggtggcccattagcaagatggacatcggagtgccgcttctggccctgggctgctactctcaggtcaaccctctcaccctgacagctgccgtgcttatgctggttgctcattacgccattatcgggcccggactccaggctaaagccaccagagaagcgcagaagcggaccgccgctggcatcatgaagaatcccacagtggatgggattgtcgccatcgacctggatcctgtggtgtatgacgctaaatttgagaagcaactgggacagattatgctccttatcctgtgtacgtcccagattctgctcatgcgcaccacatgggccctgtgcgaaagcatcacccttgccacaggcccgctgaccacgctctgggagggctctcccgggaaattctggaacacaaccatcgcggttagcatggctaatattttcagaggatcctacctggccggcgctgggctggccttttctctcatgaagagccttggaggcgggcggcgcggaaccggcgcccagggcgagacactgggggaaaaatggaagagacaactgaaccagctctccaagagcgagttcaatacctataaacggtccggaatcatggaagtcgacagatctgaggctaaggaaggcctgaaacgcggggagacaacgaagcacgccgtgagccggggaaccgcgaaacttagatggtttgtggagcgcaacctggtcaagcctgaaggcaaggttattgatctcgggtgtggacggggcggctggtcctactattgcgccgggctgaaaaaggtgacagaggtgaaaggatacaccaagggcgggcccggacatgaagagcctatccccatggctacatatggctggaatctggtcaaactccactctgggaaggacgtgttctttatgcctccggaaaaatgtgatacccttctgtgcgacattggagagagctcccccaaccctacgatcgaggaaggcagaaccctgcgcgttctcaagatggtggagccctggctgcggggcaatcagttctgtatcaagattcttaacccttacatgccctctgtcgtggaaacactggagcagatgcaaagaaaacacgggggaatgctcgttcgcaatccgctgagccggaactccacccatgagatgtactgggtgagctgcggcacagggaatatcgtctctgccgtgaacatgacctccagaatgctgctcaaccgctttacaatggctcaccggaagcctacctatgaaagagatgtggacctgggagccggcacgcgccatgtcgcggttgagcccgaagtggccaatcttgatattatcgggcagagaattgagaacatcaaaaatgaacaccggagcacatggcactacgacgaggataacccctataagacctgggcttaccatggatcttatgaggtgaaaccttccggcagcgcctcttccatggtcaatggcgtggttcgcctgctcaccaagccctgggacgtgattcctatggtcacacagatcgctatgacggataccacaccgttcgggcaacagagagtgtttaaggaaaaagttgacacccggacacccagagccaagcggggaaccacacagatcatggaggtgaccgctaaatggctgtggggcttccttagccgcaacaagaaacctagaatttgtacgcgggaagagtttacccgcaaggtcagatccaatgccgcgatcggggccgtgttcgttgacgaaaaccagtggaatagcgctaaggaggccgtggaggatgaacggttttgggacctggtccaccgcgagagagaactccataaacaaggaaagtgcgctacatgcgtgtacaacatgatgggcaaacgggagaagaaactgggggaattcggcaaggccaagggatctcgcgccatttggtatatgtggctgggcgcgagattcctcgagtttgaggctctggggttcatgaatgaagatcactggtttagccgggagaactccctttctggagtcgaaggcgaggggctgcataaactcggatacatcctgcgcgacattagcaagatccccggcgggaatatgtacgccgatgacaccgccggctgggatacaagaatcaccgaggacgatcttcagaacgaagctaaaattacggacatcatggagcctgaacacgccctgctcgctacatccattttcaagctgacctatcagaataaagtggttcgggtgcagcgccccgccaagaacggaacagtcatggatgtgatctctagacgggaccaaagaggcagcgggcaggtgggaacctacggcctgaacacgtttaccaatatggaggttcagctcattcgccagatggaatccgaggggatcttcctgccgtctgagcttgaaacacctaacctggcggagcgggccctcgattggctggaaaaacacggagctgagagacttaagcgcatggccatcagcggcgacgactgtgtggtcaagcccattgatgaccggtttgctaccgccctgacagcgctcaatgatatggggaaagtgagaaaggacatccctcaatgggaaccctccaaaggctggaacgattggcagcaggttcctttctgcagccatcactttcatcagctgattatgaaggacggacgcgagatcgtggtcccctgtcggaatcaagatgagctggtgggcagagcccgcgtctctcagggggctggatggtccctccgggaaaccgcctgcctgggcaaaagctatgctcagatgtggcaacttatgtacttccacagacgcgacctgcggctcgccgctaacgccatttgttctgcggtgccggttgattgggtgcctgcctccagaacaacctggagcatccacgctcatcaccagtggatgacgacagaggacatgctgtccgtctggaatcgggtgtggatcgaagagaacccctggatggaagataagacccatgtttctagctgggaggaggtgccctatcttgggaagagagaagaccagtggtgcggatccctgattggcctcaccgcccgcgccacatgggctaccaatatccaggtcgccattaaccaagtgcggagactgatcgggaatgagaactacctggactatatgacaagcatgaaacgctttaagaatgaatctgatcctgagggcgcgctctggtga

SEQ ID NO: 19412 - RNA, 9879 nt, synthetic construct
  misc_feature 1..9879: note = derived and/or modified CDS sequence (opt5) from DENV-1__KC692516__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcatcttcaccacgaacatttggctgaaactgcgggatagctacacacagatgtgcgaccacagacttatgtccgcggccatcaaggatagcaaagctgttcatgccgacatggggtattggattgagtctgaaaagaatgagacctggaaactcgcccgcgcttccttcatcgaagtgaagacatgtacctggcccaagagccacacactgtggtctaacggagtgctggagtccgagatgatcattccgaaaatctacggcgggcctattagccaacataattatcggcccggatactttacccagacggccggcccttggcacctcgggaagctggaacttgatttcgacctgtgcgagggaaccacagtcgtggttgatgaacactgcggcaacagaggcccctctctccggaccacaaccgtgacggggaaaatcattcatgagtggtgttgccgcagctgtacactgcctcccctgagatttcggggagaggacggctgctggtacgggatggaaatcagaccggtcaaggagaaagaagagaatcttgtgcgctccatggttagcgcgggatctggcgaagtggataacttctccctcgggatcctgtgtgtcagcattatgatcgaggaggtgatgcggtccagatggtctcgcaagatgctgatgaccggaacactcgctgtttttctgcttctgattatgggccagctcacctggaatgacctgatcagactgtgcattatggtgggcgccaacgccagcgaccggatggggatgggaaccacatatcttgctctgatggccacgttcaagatgcgccctatgtttgcggtcggcctcctgttcagacggctcacctcccgcgaagtgctgcttctgacaatcgggctctctctggtggctagcctggagcttcccaactccctggaagagctcggagatggcctggccatggggattatgatgctcaaactgcttaccgaatttcaaccccaccagctgtggacaaccctcctgtctctgacgttcgtcaagacaacccttagcctggactacgcctggaaaaccacagctatggttctctccatcgtgagcctgtttcctctctgtctgtctaccacatcccagaagacgacctggcttccggtgctgctgggaagcttcggctgcaaacccctcacaatgtttctgatcaccgagaataagatttggggcagaaagtcttggcctcttaacgaggggatcatggccattggaatcgtctccattctgctcagctctctgctcaaaaatgatgtgcccctggctggccctcttatcgccgggggaatgctgatcgcgtgttatgttatttccggcagctccgccgacctgagcctcgaaaaggctgccgaggtgtcttgggaacaggaggctgaacatagcggggcctcccacaacatcctggtcgaggtgcaagatgacggaacaatgaaaattaaggatgaggaacgggacgatacccttacgatcctgctcaaagccaccctgctcgctgtttctggcgtgtaccccatgagcattcctgcgacactgttcgtctggtatttctggcagaagaaaaagcagcgctccggcgtgctttgggacaccccctctccgcctgaggtcgaaagagccgtgctggatgacgggatctaccggatcctgcagcgcggactcctgggcagaagccaagttggggtgggagtctttcaggatggcgtgttccatacaatgtggcacgttacccggggggctgtgcttatgtatcagggaaagagactggagccctcctgggcctgcgtcaaaaaggacctcatttcttacggcggcgggtggcgctttcagggactgtggaatacaggcgaggaagtgcaagtgatcgccgttgagcctgggaaaaaccccaagaatgtccagacgaccccgggaacattcaaaacccctgaaggcgaggtgggggctattgccctcgactttaagcccggaaccagcggctcccctatcgtgaaccgggaaggcaagattgtcgggctgtacggaaatggcgtggttacaacgagcgggacctatgtgtctgcgatcgctcaggccaaagcctcccaagagggaccccttcccgagattgaagatgaggtcttcaagaaaagaaacctgacaatcatggacctgcaccctggcagcgggaagacccgccggtacctcccggctatcgtgagagaagccattaaacgcaagctgcggacacttatcctggcgcccaccagagttgtggcttctgagatggccgaagccctcaagggcatgcctattcgctatcagacgacagctgtcaaatccgagcataccggacgggagatcgtggatctgatgtgtcacgccacctttacaatgagactgctcagccccgttcgggtgcctaattacaacatgattatcatggacgaagctcatttcaccgatcccgcctccatcgcggcccgcggctatatttctacaagagtcgggatgggagaggctgccgctatctttatgaccgccacgcctccgggcagcgtggaagccttcccccagtccaatgctgtgattcaggacgaggaacgggatatccctgagcgcagctggaactctgggtacgactggattacagattttcccggaaagaccgtctggttcgttccttccatcaaaagcggcaatgacatcgcgaactgccttagaaagaacgggaaacgggtgattcaactgtctagaaagacattcgataccgagtatcagaagacgaaaaataacgactgggactacgtggtcaccacagatatcagcgaaatgggcgccaattttcgcgctgaccgggtgattgatcccagacgctgcctgaagccggttatcctcaaagacggacctgagcgggtgattctggccggccccatgcccgtcaccgtggcctccgctgcccagagacgcgggcggatcggaagaaaccagaataaggaaggcgatcaatacgtttatatggggcagcctcttaacaatgacgaggatcacgcgcattggacagaggctaaaatgctgctcgacaacattaatacccccgaaggaatcatccctgccctgttcgagccggaacgcgagaagtctgccgctattgatggcgaatacagactgcggggggaggcccgcaagacatttgtggagctcatgagacggggcgaccttcccgtctggctgagctataaagtggcgtccgaaggattccagtactctgatcgcagatggtgttttgacggcgagcggaacaatcaggtcctggaagagaacatggatgtggaaatctggaccaaggagggggagagaaaaaagctccgccctcggtggctggacgccagaacgtatagcgacccccttgctctgcgcgaattcaaagagtttgccgctggacggagatccgttagcggcgatctcattctggaaatcgggaagctgcctcaacacctcacacttcgggcccagaatgctctggacaacctggtgatgctccacaattctgagcagggaggcaaagcctaccgccatgcgatggaagagctgcccgataccattgagacccttatgctgctcgccctgatcgctgtgctgacaggcggggtcaccctcttctttctttccggaaagggcctggggaagacaagcatcggactgctctgcgttacggcctcctctgctctgctttggatggccagcgtggaaccgcactggattgccgcttccatcattctggagttctttctcatggtgctgctgatccctgaacccgacagacagcggacccctcaagataaccagctcgcgtatgtcgtgattggccttctgttcatgatcctgacagttgccgctaacgagatggggctcctggagaccacaaaaaaggaccttggaatcggccatgtggccgccgaaaatcaccagcacgctaccatgctggatgtcgacctccatcccgcctctgcgtggacgctgtacgccgtggctaccacagtcattacccctatgatgcgccacacaatcgagaacaccacggccaatattagcctgacagctatcgccaaccaagcggccattctcatgggccttgataaagggtggcccatctccaagatggacattggagtgccgctgctggctctcggctgttacagccaggttaatcctctgacccttacagccgctgtgctgatgctcgtcgcccattatgctatcatcgggcccggactgcaggccaaagcgaccagagaagcccagaagcggaccgctgccggcattatgaagaaccccacagtggatgggatcgttgctattgacctggatcctgtggtctacgacgccaaatttgagaagcaactcggacagatcatgcttctgattctgtgcacgtctcagatcctcctgatgcgcaccacatgggccctttgtgaatccatcaccctggcgacaggcccgctcaccacgctgtgggagggcagccccgggaaattctggaatacaaccattgctgtgtctatggccaacatcttcagaggatcctatctggctggcgccgggctcgcctttagccttatgaagtctctgggaggcgggcggcgcggaaccggcgctcagggcgagacactgggggaaaaatggaagagacaactcaatcagctgagcaagtccgagttcaacacctacaaacggtctggaattatggaagtggacagaagcgaggccaaggaaggccttaaacgcggggagacaacgaagcacgcggtttcccggggaaccgccaaactgagatggtttgtcgagcgcaatctcgtgaagcctgaaggcaaggtgatcgatctggggtgcggacggggcggctggagctattactgtgctgggctgaaaaaggtcacagaggttaaaggatataccaagggcgggcccggacatgaagagcctattcccatggccacatacggctggaacctcgtgaaacttcactccgggaaggacgtgttctttatgcctccggaaaaatgcgataccctgctgtgtgacatcggagagtctagccccaatcctacgatcgaggaaggcagaaccctccgcgtcctgaagatggtggagccctggcttcggggcaaccagttctgcattaagatcctgaatccttacatgccctccgttgtggaaacactcgagcagatgcaaagaaaacacgggggaatgctggtccgcaacccgctgtctcggaatagcacccatgagatgtattgggtgtccagaggcacagggaacattgtttctgctgtgaacatgaccagccgcatgctcctgaatcggtttacaatggcccacagaaagcctacctacgaacgcgatgtcgaccttggagcgggcacgagacatgtggccgtggagcccgaagtcgctaacctggatatcattgggcagcggatcgagaatattaaaaacgaacacaagtccacatggcactatgacgaggataatccctacaaaacctgggcctatcatggaagctacgaggttaagccttctggctccgctagctctatggtgaacggcgtggtccgcctcctgaccaagccctgggacgtgatccctatggttacacagatcgccatgacggataccacaccgttcgggcaacagagagtgtttaaagaaaaggtcgacacccggacacccagagctaaacggggaaccacacagattatggaggtgaccgccaagtggctttggggcttcctgtcccgcaataaaaagcctagaatctgtacgcgggaagagtttacccgcaaggttagaagcaacgcggccattggggctgtgttcgtcgacgaaaaacagtggaattctgccaaggaggctgtggaggatgaacggttttgggacctcgttcaccgcgagagagaactgcataaacaaggaaagtgcgccacatgcgtgtataacatgatgggcaaacgggagaagaagctgggggaattcggcaaagccaagggatcccgcgcgatctggtacatgtggctcggcgctagattcctggagtttgaggcccttgggttcatgaatgaagatcactggtttagccgggagaactccctgagcggagtcgaaggcgaggggctccataaactgggatacattcttcgcgacatctctaagatccccggcgggaatatgtatgccgatgacaccgctggctgggatacaagaattaccgaggacgatctgcagaacgaagccaaaatcacggacattatggagcctgaacacgctctcctggccacaagcatcttcaagctgacctaccagaataaagtggtccgggtgcagcgccccgcgaagaacggaacagttatggatgtgatttccagacgggaccaaagaggctctgggcaggtcggaacctatggcctcaacacgtttaccaatatggaggtgcagctgatccgccagatggaaagcgaggggatcttccttccgtccgagctggaaacacctaacctcgccgagcgggtgctggattggcttgaaaagcacggagctgagagactgaaacgcatggccatttctggcgacgactgtgttgtgaagcccatcgatgaccggtttgctaccgccctcacagcgctgaatgatatggggaaagtcagaaaggacattcctcaatgggaacccagcaaaggctggaacgattggcagcaggtgcctttctgctcccatcactttcatcagctgatcatgaaggacggacgcgagattgttgtgccctgtcggaatcaagatgagctcgtcggcagagcccgcgtgtctcagggggctggatggagcctgcgggaaaccgcctgccttggcaagtcctacgctcagatgtggcaactgatgtatttccacagacgcgacctccggctggccgctaacgccatctgtagcgcggtcccggtggattgggttcctacatctagaaccacgtggtccatccacgcccatcaccagtggatgacaaccgaggacatgcttagcgtgtggaatcgggtctggattgaagagaacccctggatggaagataaaacccatgtgtcttcctgggaggaggttccctacctggggaagagagaagaccagtggtgcggaagcctcatcggcctgacagctcgcgccacctgggccacaaatattcaggtggctatcaaccaagtccggagactgattgggaatgagaactatctcgactacatgacgtccatgaaacgctttaagaatgaatctgatcctgagggcgccctgtggtga

SEQ ID NO: 19413 - RNA, 9879 nt, synthetic construct
  misc_feature 1..9879: note = derived and/or modified CDS sequence (opt5) from DENV-1__KC692517__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaatcgaacacggaaccattgctacaatcaccccccaggcccctacgtccgagattcagctgaccgactacggcgccctcacactggactgtagcccccggaccggccttgatttcaacgaaatggtgctgctcacaatgaaggagaaatcttggctggtccataagcagtggtttcttgacctgcctctcccctggacctccggggctagcacgccgcaagagacatggaatcgccaggatctgctggtgaccttcaaaacagcgcacgccaagaagcaggaagtcgtggttctcggatcccaagagggcgctatgcacaccgccctgaccggggccacagaaatccagacgtctggaaccacaaccatttttgctggccatcttaaatgcagactgaagatggacaaactcacactgaaggggatgagctatgtgatgtgtaccggctccttcaaactggagaaggaagtcgccgagacgcagcacggaacagtgcttgttcaggtgaagtacgagggcaccgatgcgccttgcaaaatccccttcagcacccaagacgaaaagggggtcacacagaacggacggctcatcaccgctaatcctattgtgacagataaagagaagtctgtgaacatcgaaacggagcccccctttggcgagtcctatattgttgtcggggtgggagaaaaagccctgaagctgagctggttcaagaaaggctctagcatcgggaagatgtttgaggccaccgctagaggcgcccgccggatggctattctcggagacacagcctgggatttcggctccatcgggggagtgtttacctctgtcggcaaactggtgcatcaggttttcgggacagcgtacggagtgctttttagcggcgtctcctggaccatgaagatcgggattggcatcctgctcacgtggctgggactgaatagcagatctacctcccttagcatgacatgtattgccgtgggcatggttaccctctacctgggggtgatggtccaggctgactctggatgcgtgatcaactggaaaggccgcgaactgaagtgtgggtccggaattttcgttacaaacgaggtgcacacctggacagaacaatataagtttcaggccgatagccctaaacggctctccgctgccatcggcaaggcgtgggaggagggggtctgcggcattagatctgccacccgcctggaaaatatcatgtggaaacagatcagcaacgagcttaatcatattctgctcgaaaacgacatgaagttcacggtggtggtcggagacgctaatggcatcctggcccaggggaaaaagatgattcggccgcaacccatggagcacaaatactcctggaagtcttggggaaaggctaaaatcattggcgccgatatccagaacacaacctttatcattgacgggcctgatacccccgaatgtcctgacggacagagagcctggaatatctgggaggttgaggattatggcttcggcatttttacaaccaacatctggctgaagcttcgcgacagctacacgcagatgtgcgatcaccggctcatgtccgctgcgattaaagacagcaaggccgtgcatgctgatatggggtattggatcgaatctgagaaaaatgaaacatggaagctggccagagcctccttcatcgaggtgaagacctgtacatggcccaaaagccacaccctgtggtctaacggagtcctcgaatccgagatgattatcccgaagatttacggcgggcctatcagccaacataattatcgccccggatacttcacacagaccgctggcccttggcacctggggaaacttgagctggactttgatctctgcgaaggaacgaccgtggttgtggacgagcactgcggcaaccggggcccctctctgagaacaaccacagtcaccgggaagattatccatgaatggtgttgccggagctgtacgctgcctccccttcgcttcagaggagaggatggctgctggtacgggatggagatccggccggtgaaagaaaaggaggaaaatctcgttagatccatggtgagcgccggatctggcgaggtcgactcctttagcctggggattctgtgtgtgtccatcatgattgaagaggttatgcgctctcggtggagcagaaagatgctcatgacaggaaccctggcggtgttccttctgctcatcatgggccagctgacatggaacgacctgattcgcctttgcatcatggtcggcgctaatgcctccgatagaatggggatgggaaccacctatctggccctcatggctacatttaaaatgcggcctatgttcgccgtgggcctgctctttcgcagactgacgtctcgggaggtgcttctgctcaccattgggctgagcctggtcgcgtccgttgaacttcccaactctctggaggaactcggagacggcctggctatggggatcatgatgctcaagctgcttacagagttccaaccccaccagctgtggaccacactcctgagcctgacctttgtgaaaacgacactttccctggattacgcctggaagaccaccgccatggtgctcagcatcgtctctctgttccctctctgtctgtccacaaccagccagaaaacaacgtggcttccggtgctgctgggatcttttggctgcaaccccctcaccatgttcctgattacagaaaataagatctggggccgcaagtcctggcctcttaacgaggggattatggctatcggaattgttagcatcctgctctcttccctgctcaaaaatgacgtgcccctggccggccctcttatcgctgggggaatgctgattgcctgttatgtcatcagcggctccagcgcggatctgtctctcgagaaggccgctgaagtgagctgggagcaggaagccgagcattccggggcttctcacaacattctggttgaagtgcaagacgatggaaccatgaaaatcaaggacgaggagagagatgacacacttaccattctgctcaaagccacgctgctcgccgtcagcggcgtgtaccccatgtccatccctgctaccctgtttgtctggtatttctggcagaagaaaaagcagcggtctggcgtgctttgggatacacccagcccgcctaaggttgaacgcgcggtgctggacgatgggatctacagaattctgcagcggggactcctgggccgctcccaagtcggggtgggagttttccaggacggcgtgtttcataccatgtggcacgtcacaagaggggccgtgcttatgtatcagggaaaacggctggagccctcttgggctagcgtgaagaaagacctcatctcctacggcggcgggtggagattccagggaagctggaataccggcgaagaggttcaagtcattgccgtggagcctgggaagaaccccaaaaatgtgcagacaacgccgggaacctttaagacacctgaaggcgaggtcggggccatcgctctggatttcaagcccggaacctctggctcccctattgtgaaccgcgaaggcaaaatcgttgggctctacggaaatggcgtggtcaccacaagcgggacgtatgtgtctgccattgcgcaggctaaggcctcccaagagggacccctgcccgaaatcgaggacgaggtttttaaaaagcggaaccttaccatcatggatctgcaccctggcagcgggaaaacaagacgctacctgccggccattgtgcgggaagctatcaagagaaagctccgcaccctgattcttgcccccacacgggtcgtggcgtccgagatggctgaagccctgaaaggcatgcctatcagatatcagaccacggccgttaagtctgagcatacaggacgcgaaattgtggacctcatgtgccacgctaccttcaccatgcggctgctgagccccgtcagagtgcctaattacaacatgatcatcatggatgaggcccattttacagaccccgcttccattgccgcgcggggctatatcagcacccgcgtggggatgggagaggccgctgccattttcatgacagctacccctccgggctctgtcgaagcctttccccagtccaatgccgttatccaggatgaggaaagagacattcctgagcggagctggaactctgggtacgattggatcacggacttccccggaaaaacagtgtggtttgtgcctagcatcaagtccggcaatgatattgctaactgtctccgcaaaaacgggaagagagtcatccaactttctcggaagaccttcgacacagaatatcagaaaaccaagaataacgactgggattacgtggttacgaccgacattagcgagatgggcgcgaatttcagagccgatcgcgtgatcgacccccggagatgcctgaaaccggtcattctgaaggatggacctgagcgcgtgatcctcgctggccccatgcccgttacagtggcctccgccgctcagcggagagggcgcattggacggaaccagaataaagaaggcgaccaatacgtctatatggggcagcctctgaacaatgatgaggaccacgcccattggaccgaagcgaagatgcttctggataacatcaatacacccgagggaatcattcctgctctctttgagccggaaagagagaagtctgccgccatcgacggcgaataccgcctgagaggggaggctcggaaaaccttcgtggaactgatgcgcagaggcgatctccccgtctggcttagctataaggtggcctccgagggatttcagtacagcgaccggcgctggtgcttcgatggcgagagaaacaatcaggttctggaagagaacatggacgtggaaatttggacaaaagagggggaacggaagaaactgagacctcgctggctcgacgcgcggacctattctgatcccctggcccttagagagtttaaggagttcgctgccggacgccggtccgtgagcggcgacctgatcctcgaaattgggaaactgcctcaacacctgacgctcagagctcagaatgcccttgataacctggtcatgctgcacaattccgagcagggaggcaaggcttaccggcatgccatggaagagctccccgacacaatcgaaaccctgatgcttctggcgctcatcgccgttctgaccggcggggtgacactgtttttcctctctggaaagggccttgggaaaaccagcattggactgctgtgtgtgacagcttcctctgccctcctgtggatggctagcgtcgagccgcactggatcgccgcctccattatccttgagtttttcctgatggtgctcctgattcctgaacccgatcgccagagaacgcctcaagacaaccagctggcttatgttgtgatcggcctcctttttatgatcctgaccgtcgcggccaacgagatggggctgctcgaaacaaccaagaaagatctgggaattggctacgtggctgccgagaatcatcagcacgccacaatgcttgacgtcgatctgcggcccgctagcgcctggaccctctacgcggtggccacgaccgttatcacacctatgatgcgccacaccattgagaacacaaccgctaatatctctctgacggccattgctaaccaagccgcgatcctgatgggcctcgacaaggggtggcccatttccaaaatggatatcggagtgccgcttctggccctgggctgctatagccaggtcaatcctctcacactgaccgctgccgtgcttatgctggttgctcattacgccatcattgggcccggactccaggctaaggccacaagagaagcgcagaagcggaccgccgctggcatcatgaaaaaccccaccgtggacgggattgtcgccatcgatctggaccctgtggtgtatgacgctaagttcgagaaacaactgggacagattatgctccttatcctgtgtacatctcagatcctgctcatgcgcacgacctgggccctgtgcgaatccattacacttgccaccggcccgctgacaaccctctgggagggcagccccgggaagttttggaatacgacaatcgcggtttctatggctaacattttcagaggaagctacctggccggcgctgggctggccttctccctcatgaaatctcttggaggcgggcggcgcggaaccggcgcccagggcgaaaccctgggggagaagtggaagagacaactgaatcagctcagcaaatccgagtttaacacatataagcggagcggaatcatggaagtcgatagatccgaggctaaagaaggcctgaagcgcggggagaccacaaaacacgccgtgtctcggggaacggcgaagcttagatggttcgtggaacgcaatctggtcaagcctgagggcaaagttattgacctcgggtgtggacggggcggctggagctactattgcgccgggctgaagaaagtgaccgaggtgaagggatacacaaaaggcgggcccggacatgaagagcctatccccatggctacctacggctggaacctggtcaagctccactccgggaaagatgtgtttttcatgcctccggaaaagtgtgacacacttctgtgcgatatcggagagtctagccccaatcctaccattgaagagggcagaacgctgcgcgttctcaagatggtggagccctggctgcggggcaaccagttttgtatcaaaattcttaatccttatatgccctccgtcgtggaaaccctggagcagatgcaaagaaagcatgggggaatgctcgttcgcaacccgctgtctcggaatagcacacacgaaatgtactgggtgtcctgcggcaccgggaacatcgtcagcgccgtgaacatgacatctagaatgctgctcaatcgcttcaccatggctcaccggaaacctacatatgagagagacgtggatctgggagccggcacccgccatgtcgcggttgagcccgaagtggccaaccttgacattatcgggcagagaattgagaatatcaagaacgaacacaaatccacgtggcattacgatgaggacaatccctataagacatgggcttaccacggaagctatgaagtgaagccttctggctccgccagctctatggtcaacggcgtggttcggctgctcaccaaaccctgggatgtgatccctatggtcacccagattgctatgacagacacgaccccgtttgggcaacagcgcgtgttcaaggagaaagttgacacaagaaccccccgggccaagagaggaacaacccagatcatggaggtgacagctaaatggctgtggggctttctttcccggaataagaagcctcgcatttgtaccagagaagagttcacgcggaaagtccgcagcaacgccgcgatcggggccgtgtttgttgatgaaaatcagtggaactccgctaaggaggccgtggaagacgagagattctgggatctggtccaccgggagcgcgaactccataaacaaggaaagtgcgctacctgcgtgtacaatatgatgggcaaaagagagaagaagctgggggaatttggcaaagccaagggaagccgggccatttggtacatgtggctgggcgcgcgcttcctcgagttcgaagctctggggtttatgaacgaggaccactggttctctagagagaatagcctttccggagtcgaaggcgaggggctgcataaactcggatatatcctgcgggatatctctaagattcccggcgggaacatgtacgccgacgatacagccggctgggacacccgcatcacagaagatgaccttcagaatgaggctaaaattaccgatatcatggagcctgaacacgccctgctcgctacgagcatttttaagctgacatatcagaacaaagtggttagagtgcagcggcccgccaagaacggaaccgtcatggacgtgatctcccgcagagatcaacggggctctgggcaggtgggaacatacggcctgaataccttcacgaacatggaggttcagctcgtgagacagatggaaagcgaggggatctttctgccgtccgaacttgagacccctaatctggcggagcgcgtcctcgactggctggaaaagcatggagtggagcggcttaaaagaatggccatttctggcgacgattgtgttgtgaagcccatcgacgatcgcttcgctacagccctgaccgctctcaacgacatggggaaagtccggaaggatattcctcaatgggaacccagcaaaggctggaatgactggcagcaggtgcctttttgctcccaccacttccatcagctgatcatgaaggatggaagagagattgtcgtgccctgtcgcaaccaagacgaactggttggccgggccagagtgagccagggggcgggatggtctctccgcgagacagcctgcctgggcaagtcctatgctcagatgtggcaacttatgtactttcaccggagagatctgcgcctcgccgctaatgccatctgtagcgctgtcccggtggactgggttcctacctctcggacaacctggtccatccatgcccaccaccagtggatgacgacagaggatatgctgagcgtgtggaacagagtctggattgaagagaatccctggatggaagacaaaacccatgtgtcctcttgggaggaagtgccctatcttgggaagcgggaggaccagtggtgcggaagcctgatcggcctcaccgcgagagccacatgggctaccaacattcaggttgccatcaatcaagtccgccggctgattgggaacgagaattacctggattacatgacatccatgaaaagattcaagaacgaaagcgaccctgagggcgccctctggtga

SEQ ID NO: 19414 - RNA, 9879 nt, synthetic construct
  misc_feature 1..9879: note = derived and/or modified CDS sequence (opt5) from DENV-1__KC762649__SS-prME
  source 1..9879: mol_type = other RNA
agcgtgaccatgctgctcatgctgatgcccaccgcccttgctttccacctgacgacccggggaggggaacctcatatgatcgtgtccaagcaggaacggggaaaatctctcctgtttaagacaagcgccggcgttaacatgtgcacccttattgcgatggacctgggggaactctgtgaagatacactgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattggggcttctatcacacagaagggaatcattttcatcctgcttatgctggtcacccctagcatggccatgagatgcgtgggcattgggtcccgggattttgttgagggactcagcggcgctacctgggtggacgtcgtgctggagcacgggtcttgtgtgacaacgatggccaaggataaacccaccctggacatcgaactcctgaagacagaggtcaccaaccctgcggttcttcgcaaactgtgcattgaagccaagatctccaatacaaccacggatagcagatgtccgacacaaggagaggctaccctcgtggaagaacaggacgccaacttcgtgtgccggcgcacctttgtcgatagaggctggggcaatgggtgtggactgttcggcaaagggtctcttattacatgcgctaagtttaagtgcgtgtccaaactggagggaaagatcgttcagtacgaaaacctcaaatatagcgtgatcgtcaccgtgcacacaggcgaccagcatcaagttgggaatgagtctacggaacacggaaccacagccaccattacaccccaggcccctaccacggagatccagctgaccgactacggcgctctgacactcgattgtagcccccggaccggcctggacttcaacgaaatggtgcttctgacaatgaaggagaaaagctggctcgtccataagcagtggtttctggatcttcctctgccctggacctccggggcgtctacgagccaagagacatggaatcgccaggacctcctggtgaccttcaaaacagcccacgctaagaagcaggaagtcgtggttctgggatcccaagagggcgccatgcacaccgccctcaccggggctacagaaattcagacgagcggaaccacaaccatctttgccggccatctgaaatgcagacttaagatggataaactgacactcaaggggatgtcttatgtgatgtgtaccggctccttcaaactggagaaggaagtcgcggagacgcagcacggaacagtgctggttcagattaagtacgagggcaccgacgctccgtgcaaaatccctttcagcacccaagatgaaaagggggtgacacagaacggacggcttatcaccgccaatcccattgtcacagacaaagagaagcctgtgaacatcgaagccgagccgccctttggcgagtcttatattgtgatcggggctggagaaaaagccctcaagctgagctggttcaagaaaggctcctctattgggaagatgtttgaggctacggccagaggcgcgcgccggatggccatcctgggagataccgcttgggacttcggcagcatcgggggagtttttacatccgtcggcaaactcgtgcatcagattttcgggaccgcctacggagtgctgtttagcggcgtctcttggacaatgaagatcgggattggcgtgcttctgacctggctcggactcaattccagaagcacgtctctgtccatgacctgtatcgctgttggccttgtgacactctacctgggggtcatggtgcaggccgatagcggatgcgttattaactggaaaggccgcgaactgaagtgtgggtccggaatcttcgtgaccaatgaggtccacacatggaccgaacaatataagtttcaggcggactctcctaaacggctcagcgccgctattggcaaggcctgggaggagggggtgtgcggcatcagatccgctacacgcctggaaaacatcatgtggaaacagatttctaacgagcttaatcatatcctgctcgaaaacgacatgaagttcaccgttgtggtcggagatgtggccggcattctggcccaggggaaaaagatgatccggccgcaacccatggagcacaaatacagctggaagtcctggggaaaggctaaaattatcggcgcggacgtgcagaatacgacatttatcattgatgggcctaacacccccgaatgtcctgacgatcagagagcctggaatatctgggaggtcgaggactatggattcggcatttttaccacaaacatctggctgaaacttcgcgatagctacacccaggtttgcgaccaccggctcatgtctgctgccattaaagattccaaggccgtgcatgctgacatgggctattggatcgaaagcgagaaaaatgaaacgtggaagctggccagagcgtctttcatcgaggtgaagacatgtatttggcccaaatcccacaccctgtggagcaacggggtcctcgaatctgagatgatcattccgaagatctacggaggccctattagccaacataattatcgccccgggtacttcacacagaccgctggaccttggcacctgggcaaacttgagctggattttgacctctgcgaagggacaaccgtggttgtggatgagcactgcggaaaccggggcccctccctgagaacgaccacagtcaccggcaagatcatccatgaatggtgttgccggagctgtacactgcctccccttcgcttcagaggggaggacggatgctggtacggcatggagattcggccggtgaaagaaaaggaggaaaatctcgttaagtctatggtgtccgccgggagcggagaggtcgactccttttctctgggcctgctctgtatcagcattatgatcgaagaggtgatgagatcccgctggtctcggaaaatgctgatgaccgggacgcttgccgttttctttctgctcattatgggacagctgacatggaacgatctgatcagactttgcattatggtgggcgctaatgccagcgaccgcatgggcatggggaccacatatctggcgctcatggctaccttcaagatgagacctatgtttgccgtcggactgctgttccggcgcctgacctccagagaggtgcttctgctcacaatcggcctgtctctggtggccagcgtcgaacttcccaactccctggaggaactcggggatggactggctatgggcatcatgattctcaaactgcttacggactttcaaagccaccagctgtgggccaccctcctgtctctgacattcatcaagaccacattttcccttcattacgcttggaaaaccatggccatggttctgagcattgtgtctctcttccccctgtgtctctccacgacaagccagaagaccacctggctgcctgtgcttctggggtctctgggatgcaagccgctcacaatgtttctgatcgcggagaataaaatttggggccggaagtcctggccccttaacgaaggcatcatggccgtcgggatcgtgagcattctgctctccagcctgctcaaaaacgatgttcctctggctggaccccttatcgccggcgggatgctgattgcttgttatgtgatctctggaagctccgccgacctgtctctcgagaaggccgctgaggtcagctgggaagaggaagcggagcactccggcgcctctcataatattctggtggaagttcaggatgacgggaccatgaaaatcaaggatgaggagcgcgacgatacacttacgatcctgctcaaagctaccctgctcgccgtgagcggagtctaccctctgtccattcccgccacacttttcgtgtggtatttctggcaaaagaagaaacagagatctggcgtcctgtgggacaccccttcccctcccgaagtggagcgggctgttctggatgacggcatctaccgcattatgcagagagggctcctgggacggtcccaggtgggcgtcggggtgtttcaagaaaacgttttccacacaatgtggcacgtgacccgcggagccgtccttatgtatcagggcaagagactggagcccagctgggcgtctgtgaaaaaggacctcatctcctacgggggaggctggcggctgcagggcagctggaatacgggggaggaagtgcaggttattgctgtcgagcccggcaagaatcctaagaatgtgcaaaccgcccccggcatctttaagacaccggaaggggaggtgggagccattgctctcgatttcaaacctggcacctctgggtcccccatcgtcaacagagaaggaaagatcgtgggcctgtacggcaatggggttgtgacaaccagcggaacatatgtctccgccattgcgcaggctaaagcctctcaggagggccctcttcccgagatcgaagacgaggtgtttcgcaagcggaacctgacgattatggatctgcatcccgggagcggaaaaaccagacgctacctccctgccatcgttcgggaagctattaagagaaagctgcgcacacttatcctggccccgacccgggtggtcgcttccgagatggccgaagcgctcaaaggcatgcccatcagatatcaaaccacagccgtcaagagcgagcacacggggaaagagattgttgacctgatgtgccatgctaccttcacaatgcgcctgctctctcctgtgcgggtccccaattacaacatgatcattatggatgaagcccactttaccgacccttccagcatcgctgccagaggctatatttctacacgggtgggaatgggcgaggccgctgcgatcttcatgaccgccacgccccctgggagcgtggaggcttttccgcagtccaatgccgtcatccaggatgaggaacgcgacattcccgagagatcttggaacagcggatacgagtggatcacagatttccctggcaagaccgtttggtttgtgccctccattaaatctgggaatgacatcgccaactgtcttcggaagaatggaaagcgcgtgattcagctgagcagaaaaaccttcgatacagaatatcaaaagaccaaaaacaacgactgggactacgtcgtgacaaccgatatctccgagatgggcgctaatttccgggccgacagagttattgatcctcgccggtgcctgaagcccgtgatcctcaaagacgggccggaaagagtcatcctggcgggccctatgcccgtgacggttgctagcgccgcccagcgccggggaagagtgggccgcaaccataataaggagggggatcagtacatttatatgggacagccccttaacaatgacgaggatcacgctcactggacagaagccaagatgctgctcgacaacatcaatacccctgagggcattatccccgcgctgtttgaacctgagcgggaaaaatctgccgctattgatggggagtacagactgcgcggagaggccagaaagacattcgtcgaactcatgcggcgcggcgaccttccggtgtggctgtcctataaagtcgctagcgaggggtttcaatactccgatagacggtggtgcttcgacggcgaacgcaacaatcaggtgctggaggaaaacatggatgttgagatctggaccaaggagggagaacgcaagaagctccggcccagatggctggacgcccgcacgtattctgaccctcttgctctgcgggagtttaaagagttcgccgcgggcagacgcagcgtgtccggggatctcatcctggagattggaaagctgccccagcatctcacccagcgggcccaaaatgctcttgacaacctggtgatgctgcacaattctgaacagggcgggagagcctaccggcatgctatggaggagctccctgatacaatcgaaaccctgatgcttctggccctcattgccgtcctgacaggaggcgttaccctgtttttcctcagcggccgcgggcttggaaagacatccatcggcctgctgtgtgtgatggctagctctgtgctcctgtggatggcgtccgtcgagccccactggattgccgctagcatcatccttgaatttttcctgatggtgctcctgattccggagcctgacagacagcggacaccccaggataaccaactggcctatgttgtgatcgggctcctttttatgattctgacggtcgccgctaatgagatgggactgctcgaaacaaccaaaaaggacctgggcatcgggcacgtggccgtcgagaaccatcaccatgcggccatgcttgatgtggacctgcaccctgcttctgcctggaccctctacgctgttgccacaaccattatcacacccatgatgcgccatacgattgaaaacaccacagcgaatatctccctgaccgccatcgctaaccaggccgctattctgatgggactcgataaaggctggcctatcagcaagatggacattggcgtgccccttctggccctggggtgctactctcaggtcaatccgctcacactgaccgctgccgtgcttatgctggttgcgcactatgccatcattggacctggcctccaagctaaagccacgagagaggctcagaagcggaccgccgccgggatcatgaagaaccccacagtggatggaatcgtcgcgattgacctggatcccgtggtgtacgacgctaaattcgaaaagcagctgggccagatcatgctccttattctgtgtaccagccaaatcctgctcatgcgcacaacctgggccctgtgcgagtccattacgcttgctacagggcctctgaccacactctgggagggatctccgggcaaattttggaataccaccatcgccgttagcatggccaacatcttcagaggctcctatctggctggggccggactggcgttcagcctcatgaagtcccttggcgggggacggcgcggcacaggggcccagggagaaacgctgggcgagaaatggaagagacagctgaatcagctctctaagagcgaatttaacacctacaaacggtccggcattatggaggtcgacagatctgaagctaaggaggggctgaaacgcggagagacaaccaagcacgccgtgagccggggcacagctaaacttagatggttcgtggaacgcaatctggtcaagcccgaggggaaggttatcgatctcggatgtggcagagggggatggtcctattactgcgccggcctgaaaaaggtgaccgaagtgaaaggctatacgaaagggggacctggccatgaggaacccattcctatggcgacatacgggtggaacctggtcaaactccactctggaaaggacgtgtttttcattccccctgagaaatgtgatacccttctgtgcgacatcggcgagagctccccgaatcccaccatcgaagaggggagaacactgcgcgttctcaagatggtggaaccttggctgcggggaaaccaattttgtattaagatccttaatccctacatgcctagcgtcgtggagaccctggagcagatgcagagaaaacatggcggcatgctcgttcgcaaccccctgtctagaaattccacacacgaaatgtattgggtgagctgcgggacgggaaacatcgtctctgccgtgaatatgacctccagaatgctgctcaaccgcttcacaatggctcaccggaagccgacctacgagagagatgtggacctgggcgccgggacacgccatgtcgctgttgaacctgaggtggccaaccttgatattatcggacagagaattgaaaatatcaaacacgagcataagagcacctggcactatgacgaggataacccctacaaaacgtgggcttatcatggctcttacgaagtgaagccctccgggagcgcctccagcatggtcaatggagtggttaagctgctcaccaaaccttgggacgtgattcccatggtcacacaaatcgcgatgaccgatacaaccccttttggccagcagcgggtgttcaaggagaaagttgacacacgcaccccgaaggccaaaagaggcacgacacaaatcatggaagtgaccgctcggtggctgtgggggtttctttctagaaacaagaagccccggatttgtacccgcgaggagttcacaagaaaagtccggagcaatgccgctatcggagccgtgtttgttgacgagaaccagtggaactccgccaaggaggcggtggaagatgagcgcttctgggacctggtccacagagaacgggagctccacaaacagggcaagtgcgctacgtgcgtgtataacatgatggggaaacgcgaaaagaagctgggagagtttggcaaagccaaggggtctagagccatttggtacatgtggctgggcgctcggttcctcgagttcgaagccctgggatttatgaatgaggatcattggttcagccgcgaaaactccctttctggcgtcgagggggagggactgcacaaactcggctacatcctgagagacattagcaagatccctgggggaaatatgtatgctgatgacaccgccggctgggatacacggatcaccgaagacgatcttcagaacgaggcgaaaattacagacatcatggaacccgagcatgccctgctcgctaaggccatttttaaactgacctaccaaaataaggtggttcgcgtgcagagacctgctaagaacgggacagtcatggatgtgatctcccggcgcgaccagagaggctctggacaggtgggcacctatgggctgaatacgttcaccaacatggaagcccaactcattcggcagatggagagcgagggaatcttttcccccagcgaactggagacaccgaaccttgcggaaagagttctggattggctcgagaaatacggcgtggaacgcctgaagcggatggccatctctggggacgactgtgtcgtgaaacctattgatgacagattcgctaccgcccttacagctctgaatgatatgggaaaggttcgcaaagacatcccccagtgggagccttccaagggctggaacgattggcagcaagtgcccttttgcagccaccacttccatcagctcattatgaaggacgggcgggagatcgtcgtgccttgtagaaatcaggatgaactggtcggccgcgcccgggtgtctcagggagctggctggtccctgagagagaccgcctgcctcgggaaaagctatgcgcaaatgtggcagctgatgtactttcaccgccgggaccttagactggccgctaacgccatttgttccgccgttcccgtggattgggtcccgacgtctcgcacaacctggagcatccatgctcaccatcagtggatgacaaccgaagacatgctctccgtgtggaatcgggtttggattgaggaaaacccttggatggaggataagacgcacatcagctcttgggaggacgtgccctatctgggaaaaagagaagaccaatggtgcggctcccttatcgggctgaccgcccgggcgacatgggctaccaatattcaggtcgccatcaaccaggtgagacgcctcattggaaatgagaactacctggattacatgacaagcatgaagcggttcaaaaatgaatctgaccccgagggcgccctgtggtga

SEQ ID NO: 19415 - RNA, 9879 nt, synthetic construct
  misc_feature 1..9879: note = derived and/or modified CDS sequence (opt5) from DENV-1__KC762625__SS-prME
  source 1..9879: mol_type = other RNA
tccgtgaccatgctgctcatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggagctctgtgaagatacactgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgtccaaactggagggaaagatcgttcagtacgaaaacctcaaatatagcgtgatcgtcacagtgcacacgggcgaccagcatcaagttgggaatgagtctaccgaacacggaacaaccgctacaattacaccccaggcccctacgaccgagatccagctgacagactacggcgccctgaccctcgattgtagcccccggacaggcctggacttcaacgaaatggtgcttctgaccatgaaggagaaaagctggctcgtccataagcagtggtttctggatcttcctctgccctggacgtccggggcttctacaagccaagagacctggaatcgccaggacctcctggtgacattcaaaaccgcgcacgccaagaagcaggaagtcgtggttctgggatcccaagagggcgctatgcacaccgccctcacaggggccacggaaattcagaccagcggaacaaccacaatctttgctggccatctgaaatgcagacttaagatggataaactgaccctcaaggggatgtcttatgtgatgtgtacgggctccttcaaactggagaaggaagtcgccgagacacagcacggaaccgtgctggttcagattaagtacgagggcaccgacgcgccgtgcaaaatccctttcagcacacaagatgaaaagggggtgacccagaacggacggcttatcacagctaatcccattgtcacggacaaagagaagcctgtgaacatcgaagccgagccgccctttggcgagtcttatattgtgatcggggccggagaaaaagctctcaagctgagctggttcaagaaaggctcctctattgggaagatgtttgaggccaccgctagaggcgcccgccggatggcgatcctgggagatacagcctgggacttcggcagcatcgggggagtttttacctccgtcggcaaactcgtgcatcagattttcgggacagcttacggagtgctgtttagcggcgtctcttggaccatgaagatcgggattggcgtgcttctgacgtggctcggactcaattccagaagcacctctctgtccatgacatgtatcgccgttggccttgtgaccctctacctgggggtcatggtgcaggctgatagcggatgcgttattaactggaaaggccgcgaactgaagtgtgggtccggaatcttcgtgacaaatgaggtccacacctggacagaacaatataagtttcaggccgactctcctaaacggctcagcgcggccattggcaaggcttgggaggagggggtgtgcggcatcagatccgccacccgcctggaaaacatcatgtggaaacagatttctaacgagcttaatcatatcctgctcgaaaacgacatgaagttcacggttgtggtcggagatgtggctggcattctggcccaggggaaaaagatgatccggccgcaacccatggagcacaaatacagctggaagtcctggggaaaggccaaaattatcggcgctgacgtgcagaatacaacctttatcattgatgggcctaacacccccgaatgtcctgacgatcagagagcgtggaatatctgggaggtcgaggactatggattcggcatttttacaaccaacatctggctgaaacttcgcgatagctacacgcaggtttgcgaccaccggctcatgtctgccgctattaaagattccaaggccgtgcatgccgacatgggctattggatcgaaagcgagaaaaatgaaacatggaagctggctagagcctctttcatcgaggtgaagtcctgtatttggcccaaaagccacaccctgtggtctaacggggtcctcgaaagcgagatgatcattccgaagatctacggaggccctatttcccaacataattatcgccccgggtacttcacacagaccgcgggaccttggcacctgggcaaacttgagctggattttgacctctgcgaagggacaaccgtggttgtggatgagcactgcggaaaccggggccccagcctgagaacgaccacagtcaccggcaagatcatccatgaatggtgttgccggtcttgtacactgcctccccttcgcttcagaggggaggacggatgctggtacggcatggagattcggccggtgaaagaaaaggaggaaaatctcgttaagtccatggtgagcgctgggtccggagaggtcgactcttttagcctgggcctgctctgtatctccattatgatcgaagaggtgatgagatctcgctggagccggaaaatgctgatgaccgggacgcttgccgttttctttctgctcattatgggacagctgacatggaacgatctgatcagactttgcattatggtgggcgccaatgcttccgaccgcatgggcatggggaccacatatctggccctcatggcgaccttcaagatgagacctatgtttgctgtcggactgctgttccggcgcctgacctctagagaggtgcttctgctcacaatcggcctgagcctggtggcctccgtcgaacttcccaacagcctggaggaactcggggatggactggccatgggcatcatgattctcaaactgcttacggactttcaatctcaccagctgtgggctaccctcctgtccctgacattcatcaagaccacatttagccttcattacgcctggaaaaccatggctatggttctgtctattgtgtccctcttccccctgtgtctcagcacgacatctcagaagaccacctggctgcctgtgcttctggggtccctgggatgcaagccgctcacaatgtttctgatcgccgagaataaaatttggggccggaagtcctggccccttaacgaaggcatcatggcggtcgggatcgtgtccattctgctcagctctctgctcaaaaacgatgttcctctggccggaccccttatcgctggcgggatgctgattgcctgttatgtgatcagcggatcctctgctgacctgagcctcgagaaggccgccgaggtctcctgggaagaggaagctgagcactctggcgcgagccataatattctggtggaagttcaggatgacgggaccatgaaaatcaaggatgaggagcgcgacgatacacttacgatcctgctcaaagccaccctgctcgctgtgtccggagtctaccctctgtctattcccgccacacttttcgtgtggtatttctggcaaaagaagaaacagagaagcggcgtcctgtgggacacccctagccctcccgaagtggagcgggccgttctggatgacggcatctaccgcattatgcagagagggctcctgggacggagccaggtgggcgtcggggtgtttcaagaaaacgttttccacacaatgtggcacgtgacccgcggagctgtccttatgtatcagggcaagagactggagccctcttgggcctccgtgaaaaaggacctcatcagctacgggggaggctggcggctgcagggctcttggaatacgggggaggaagtgcaggttattgcggtcgagcccggcaagaatcctaagaatgtgcaaaccgctcccggcacatttaagaccccggaaggggaggtgggagccatcgccctcgatttcaaacctggcacatccgggagccccattgtcaacagagaaggaaagatcgtgggcctgtacggcaatggggttgtgaccacatccggaacgtatgtctctgctatcgcccaggcgaaagctagccaggagggccctcttcccgagattgaagacgaggtgtttcgcaagcggaacctgaccatcatggatctgcatcccgggtccggaaaaacaagacgctacctccctgccattgttcgggaagccatcaagagaaagctgcgcacccttattctggctccgacccgggtggtcgccagcgagatggctgaagccctcaaaggcatgcccatcagatatcaaacaacggcggtgaagtctgagcacaccgggaaagagatcgttgacctgatgtgccatgccacattcaccatgcgcctgctctcccctgtgcgggtccccaattacaacatgattatcatggatgaagctcactttacagaccctagctctattgccgctagaggctatatcagcacccgggtgggaatgggcgaggccgccgctattttcatgacggcgacaccccctgggtccgtggaagcctttccgcagtctaatgctgtcatccaggatgaggaacgcgacatccccgagagaagctggaactccggatacgagtggattaccgatttccctggcaagaccgtttggtttgtgccctctatcaaaagcgggaatgacattgccaactgtcttcggaagaatggaaagcgcgtgatccagctgtccagaaaaacattcgataccgaatatcaaaagaccaagaacaacgactgggactacgtcgtgaccacggatattagcgagatgggcgccaatttccgggctgacagagttatcgatcctcgccggtgcctgaagcccgtgattctcaaagacgggccggaaagagtcatcctggccggccctatgcccgtgacagttgcgtctgctgcccagcgccggggaagagtgggccgcaaccataataaggagggggatcagtacatctatatgggacagccccttaacaatgacgaggatcacgcccactggaccgaagctaagatgctgctcgacaacattaatacacctgagggcatcattcccgccctgtttgaacctgagcgggaaaaatccgcggccatcgatggggagtacagactgcgcggagaggctagaaagaccttcgtcgaactcatgcggcgcggcgaccttccggtgtggctgagctataaagtcgcctccgaggggtttcaatactctgatagacggtggtgcttcgacggcgaacgcaacaatcaggtgctggaggaaaacatggatgttgagatttggacgaaggagggagaacgcaaaaagctccggcccagatggctggacgctcgcacctatagcgaccctcttgccctgcgggagtttaaagagttcgctgccggcagacgctccgtgtctggggatctcatcctggagatcggaaagctgccccagcatctcacacagcgggcgcaaaatgcccttgacaacctggtgatgctgcacaatagcgaacagggcgggagagcttaccggcatgccatggaggagctccctgataccattgaaacactgatgcttctggctctcatcgccgtcctgaccggaggcgttacactgtttttcctctccggccgcgggcttggaaagaccagcattggcctgctgtgtgtgatggcctcttccgtgctcctgtggatggctagcgtcgagccccactggatcgcggcctctattatccttgaatttttcctgatggtgctcctgatcccggagcctgacagacagcggacgccccaggataaccaactggcttatgttgtgattgggctcctttttatgatcctgacagtcgccgccaatgagatgggactgctcgaaaccaccaaaaaggacctgggcattgggcacgtggctgtcgagaaccatcaccatgccgcgatgcttgatgtggacctgcaccctgcctccgcttggacactctacgccgttgctaccacaatcattacgcccatgatgcgccataccatcgaaaacacaaccgccaatattagcctgacagcgatcgccaaccaggctgccatcctgatgggactcgataaaggctggcctatttctaagatggacatcggcgtgccccttctggctctggggtgctacagccaggtcaatccgctcaccctgacggccgctgtgcttatgctggttgcccactatgcgattatcggacctggcctccaagccaaagctaccagagaggcccagaagcggacagctgccgggattatgaagaaccccaccgtggatggaatcgtcgccatcgacctggatcccgtggtgtacgacgcgaaattcgaaaagcagctgggccagattatgctccttatcctgtgtacatcccaaattctgctcatgcgcaccacgtgggctctgtgcgagtctatcacacttgccaccgggcctctgacaaccctctgggagggaagcccgggcaaattttggaataccacaattgctgtttccatggccaacatcttcagaggcagctatctggccggggctggactggccttctccctcatgaagtctcttggcgggggacggcgcggcacgggggcgcagggagaaaccctgggcgagaaatggaagagacagctgaatcagctcagcaagtccgaatttaacacatacaaacggtctggcatcatggaggtcgacagaagcgaagccaaggaggggctgaaacgcggagagaccacaaagcacgctgtgtcccggggcaccgccaaacttagatggttcgtggaacgcaatctggtcaagcccgaggggaaggttattgatctcggatgtggcagagggggatggtcttattactgcgctggcctgaaaaaggtgacggaagtgaaaggctatacaaaagggggacctggccatgaggaacccatccctatggccacctacgggtggaacctggtcaaactccacagcggaaaggacgtgtttttcattccccctgagaaatgtgatacccttctgtgcgacatcggcgagtccagcccgaatcccacaattgaagaggggagaaccctgcgcgttctcaagatggtggaaccttggctgcggggaaaccaattttgtatcaagattcttaatccctacatgccttctgtcgtggagacactggagcagatgcagagaaaacatggcggcatgctcgttcgcaaccccctgtcccggaatagcacgcacgaaatgtattgggtgtcttgcgggaccggaaacatcgtctccgcggtgaatatgacaagcagaatgctgctcaaccgcttcaccatggcccaccggaagccgacatacgagagagatgtggacctgggcgctgggacccgccatgtcgccgttgaacctgaggtggctaaccttgatatcattggacagagaatcgaaaatattaaacacgagcataagtctacgtggcactatgacgaggataacccctacaaaacctgggcctatcatggctcctacgaagtgaagcccagcgggtccgctagctctatggtcaatggagtggttaagctgctcacaaaaccttgggacgtgatccccatggtcacccaaattgccatgacagataccacaccttttggccagcagcgggtgttcaaggagaaagttgacacccgcacgccgaaggcgaaaagaggcacaacccaaatcatggaagtgaccgcccggtggctgtgggggtttcttagcagaaacaagaagccccggatctgtacacgcgaggagttcacgagaaaagtccggtccaatgctgccattggagctgtgtttgttgacgagaaccagtggaactctgccaaggaggccgtggaagatgagcgcttctgggacctggtccacagagaacgggagctccacaaacagggcaagtgcgcgacctgcgtgtataacatgatggggaaacgcgaaaagaagctgggagagtttggcaaagctaaggggagcagagccatctggtacatgtggctgggcgcccggttcctcgagttcgaagctctgggatttatgaatgaggatcattggttctcccgcgaaaactctcttagcggcgtcgagggggagggactgcacaaactcggctacattctgagagacatctccaagattcctgggggaaatatgtatgccgatgacacagctggctgggatacccggatcacagaagacgatcttcagaacgaggccaaaatcaccgacattatggaacccgagcatgcgctgctcgccaaggctatctttaaactgacataccaaaataaggtggttcgcgtgcagagacctgccaagaacgggaccgtcatggatgtgatttctcggcgcgaccagagaggcagcggacaggtgggcacgtatgggctgaataccttcacaaacatggaagctcaactcatccggcagatggagtccgagggaatttttagcccctctgaactggagaccccgaaccttgccgaaagagttctggattggctcgagaaatacggcgtggaacgcctgaagcggatggcgatctccggggacgactgtgtcgtgaaacctatcgatgacagattcgccacagctcttaccgccctgaatgatatgggaaaggttcgcaaagacattccccagtgggagcctagcaagggctggaacgattggcagcaagtgcccttttgctctcaccacttccatcagctcatcatgaaggacgggcgggagattgtcgtgccttgtagaaatcaggatgaactggtcggccgcgctcgggtgtcccagggagccggctggagcctgagagagacggcttgcctcgggaaatcctatgcccaaatgtggcagctgatgtactttcaccgccgggaccttagactggcggccaacgctatctgttctgccgttcccgtggattgggtcccgacaagccgcaccacatggtccattcatgcccaccatcagtggatgaccacggaagacatgctcagcgtgtggaatcgggtttggatcgaggaaaacccttggatggaggataagacccacatttcttcctgggaggacgtgccctatctgggaaaaagagaagaccaatggtgcggcagccttatcgggctgacagctcgggccacctgggcgacaaatatccaggtcgctattaaccaggtgagacgcctcatcggaaatgagaactacctggattacatgacctctatgaagcggttcaaaaatgaaagcgaccccgagggcgccctgtggtga

SEQ ID NO: 19416 - RNA, 9879 nt, synthetic construct
  misc_feature 1..9879: note = derived and/or modified CDS sequence (opt5) from DENV-1__KC762635__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagaccagcgccggcgttaatatgtgcacccttattgcgatggacctgggggagctctgtgaagatacactgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagcgcgttgaaacatgggctcttagacaccccggcttcaccgtgatcgccctgtttctcgcgcatgccattgggacatctatcacccagaaaggaatcattttcatcctgcttatgctggtcacccctagcatggctatgcggtgcgtgggcattgggtcccgcgattttgttgagggactcagcggcgccacatgggtggacgtcgtgctggagcacgggtcttgtgtgacgaccatggctaaggataagcccacactggacatcgaactcctgaaaaccgaggtcacaaaccctgccgttcttagaaagctgtgcattgaagcgaaaatctccaataccacgacagatagccggtgtccgacccaaggagaggccaccctcgtggaagaacaagacgctaacttcgtgtgccgcagaacatttgtcgatcggggctggggcaatgggtgtggactgttcggcaaggggtctcttattacctgcgccaaatttaagtgcgtgacaaagctggagggaaaaatcgttcagtacgaaaacctcaagtattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccgcaccggcctggacttcaacgaaatggtgcttctgacgatgaaagagaagtcctggctcgtccataaacagtggtttctggatcttcctctgccctggacaagcggggcttccacctctcaagagacatggaatagacaggacctcctggtgaccttcaagaccgcgcacgccaaaaagcaggaagtcgtggttctgggaagccaagagggcgctatgcacacagccctcacgggggccaccgaaattcagacatccggaaccacaaccatctttgctggccatctgaagtgccggcttaaaatggataagctgacgctcaaagggatgagctatgtgatgtgtacaggctctttcaagctggagaaagaagtcgccgagacccagcacggaaccgtgctggttcagattaagtacgagggcacagacgcgccgtgcaagatccctttctccacccaagatgaaaaaggggtgacacagaacggaagacttatcacggctaatcccattgtcaccgacaaggagaaacctgtgaacatcgaagccgagccgccctttggcgagagctatattgtgatcggggccggagaaaaggctctcaaactgtcttggttcaagaagggcagctccattgggaaaatgtttgaggccacagctcgcggcgcccggagaatggcgatcctgggagataccgcctgggacttcggctctatcgggggagtttttacaagcgtcggcaagctcgtgcatcagattttcgggaccgcttacggagtgctgttttccggcgtcagctggacgatgaaaatcgggattggcgtgcttctgacctggctcggactcaattctcgctccacaagcctgtctatgacctgtatcgccgttggccttgtgacactctacctgggggtcatggtgcaggctgattccggatgcgttattaactggaagggccgggaactgaaatgtgggagcggaatcttcgtgaccaatgaggtccacacatggaccgaacaatataagtttcaggccgactcccctaagagactctctgcggccattggcaaggcttgggaggagggggtgtgcggcatccgcagcgccacgcggctggaaaacatcatgtggaagcagatttccaacgagcttaatcatatcctgctcgaaaacgacatgaaattcacagttgtggtcggagatgtggctggcattctggcccaggggaagaaaatgatcagaccgcaacccatggagcacaagtactcttggaaaagctggggaaaggccaagattatcggcgctgacgtgcagaataccacctttatcattgatgggcctaacacacccgaatgtcctgacgatcagcgcgcgtggaatatctgggaggtcgaggactatggattcggcatttttaccacgaacatctggctgaaacttcgggattcctacacacaggtttgcgaccacagactcatgagcgccgctattaaggattctaaagccgtgcatgccgacatgggctattggatcgaatccgagaagaatgaaacctggaaactggctcgcgccagcttcatcgaggtgaagacatgtatttggcccaagtctcacaccctgtggtccaacggggtcctcgaaagcgagatgatcattccgaaaatctacggaggccctatttctcaacataattatcggcccgggtacttcacacagaccgcgggaccttggcacctgggcaaacttgagctggattttaacctctgcgaagggacgaccgtggttgtggacgagcactgcggaaatagaggccccagcctgcggacaaccacagtcaccggcaaaatcatccatgaatggtgttgccgctcctgtacgctgcctccccttagattcagaggggaagatggatgctggtacggcatggagattcggccggtgaaggaaaaagaggaaaacctcgttaagagcatggtgtctgctgggtccggagaggtcgacagcttttccctgggcctgctctgtatctctattatgatcgaagaggtgatgcgcagccggtggtccagaaagatgctgatgacagggacccttgccgttttctttctgctcattatgggacagctgacatggaatgacctgatccgcctttgcattatggtgggcgccaacgcttctgatagaatgggcatggggaccacctatctggccctcatggcgacattcaaaatgcggcctatgtttgctgtcggactgctgttccgcagactgacgagccgggaggtgcttctgctcaccatcggcctgtccctggtggcctctgtcgaacttcccaatagcctggaggaactcggggacggactggccatgggcatcatgattctcaagctgcttacagattttcaatcccaccagctgtgggctaccctcctgagcctgacattcatcaaaaccacgttttctcttcattacgcctggaagacaatggctatggttctgtccattgtgagcctcttccccctgtgtctctctaccacctcccagaaaacaacctggctgcctgtgcttctggggagcctgggatgcaagccgctcacaatgtttctgatcgccgagaacaagatttggggccgcaaatcttggccccttaacgaaggcatcatggcggtcgggatcgtgtccattctgctcagctccctgctcaagaatgacgttcctctggccggaccccttatcgctggcgggatgctgattgcctgttatgtgatcagcggatctagcgctgatctgtccctcgagaaagccgccgaggtctcttgggaagaggaagctgagcacagcggcgcgtcccataacattctggtggaagttcaggacgatgggacgatgaagatcaaagacgaggagagagatgacacccttacaatcctgctcaaggccaccctgctcgctgtgtctggagtctaccctctgagcattcccgccacacttttcgtgtggtatttctggcagaagaagaagcagcggtccggcgtcctgtgggataccccttctcccccggaagtggagcgcgccgttctggacgatggcatctacagaattatgcagcgggggctcctgggacgcagccaggtgggcgtcggggtgtttcaagaaaatgttttccacacgatgtggcacgtgaccagaggagctgtccttatgtatcagggcaaacggctggagccttcctgggccagcgtgaagaaagacctcatctcttacgggggaggctggagactgcagggctcctggaacacaggggaggaagtgcaggttattgcggtcgagcccggaaagaatcctaaaaacgtgcaaaccgctcccggcacatttaagaccccggaaggggaggtgggagccatcgccctcgacttcaagcctggcacaagcgggtctcccattgtcaatcgcgaaggaaaaatcgtgggcctgtacggcaacggggttgtgacgacctccggaacatatgtcagcgctatcgcccaggcgaaggcttcccaggagggccctcttcccgagattgaagatgaggtgtttcggaaaagaaatctgaccatcatggacctgcatcccgggtctggaaagacccgccggtacctccctgccattgttagagaagccatcaaacgcaagctgcggacacttattctggctccgacgagagtggtcgccagcgagatggctgaagccctcaagggcatgcccatccgctatcaaaccacagcggtgaaatccgagcacaccgggaaggagatcgttgatctgatgtgccatgccacattcaccatgcggctgctcagccctgtgagagtccccaactacaatatgattatcatggacgaagctcactttacggatccttcttccattgccgctcggggctatatcagcacacgcgtgggaatgggcgaggccgccgctattttcatgaccgcgacaccccctgggtctgtggaagcctttccgcagagcaacgctgtcatccaggacgaggaaagagatatccccgagcggtcctggaactctggatacgagtggattacagacttccctggcaaaaccgtttggtttgtgcccagcatcaagtccgggaacgatattgccaattgtcttcgcaaaaacggaaagagagtgatccagctgtctcggaagacattcgacaccgaatatcagaaaacgaagaacaatgattgggactacgtcgtgacaaccgacattagcgagatgggcgccaacttcagagctgatcgcgttatcgaccctcggagatgcctgaaacccgtgattctcaaggatgggccggaacgcgtcatcctggccggccctatgcccgtgacagttgcgtccgctgcccagcggagaggacgcgtgggccggaatcataacaaagagggggaccagtacatctatatgggacagccccttaataacgatgaggaccacgcccactggaccgaagctaagatgctgctcgataatattaacacgcctgagggcatcattcccgccctgtttgaacctgagagagaaaagagcgcggccatcgacggggagtaccgcctgagaggagaggctcggaaaaccttcgtcgaactcatgcgcagaggcgatcttccggtgtggctgtcttataaggtcgcctccgaggggtttcaatacagcgaccggcgctggtgcttcgatggcgaaagaaataaccaggtgctggaggaaaatatggacgttgagatttggacaaaagagggagaacggaagaaactcagaccccgctggctggatgctcggacctattccgaccctcttgccctgagagagtttaaggagttcgctgccggccgccggtctgtgagcggggacctcatcctggagatcggaaaactgccccagcatctcacacagagagcgcaaaacgcccttgataatctggtgatgctgcacaactccgaacagggcgggcgggcttaccgccatgccatggaggagctccctgacaccattgaaacactgatgcttctggctctcatcgccgtcctgaccggaggcgttacgctgtttttcctctctggcagagggcttggaaagacaagcattggcctgctgtgtgtgatggcctccagcgtgctcctgtggatggcttctgtcgagccccactggatcgcggcctccattatccttgaatttttcctgatggtgctcctgatcccggagcctgatcggcagcgcacaccccaagacaatcaactggcttatgttgtgattgggctcctttttatgatcctgaccgtcgccgccaacgagatgggactgctcgaaaccaccaagaaagatctgggcattgggcacgtggctgtcgagaaccatcaccatgccgcgatgcttgacgtggatctgcaccctgccagcgcttggacactctacgccgttgctacgaccatcattacacccatgatgagacataccatcgaaaatacaaccgccaacatttctctgacggcgatcgccaatcaggctgccatcctgatgggactcgacaagggctggcctatttccaaaatggatatcggcgtgccccttctggctctggggtgctacagccaggtcaacccgctcaccctgacagccgctgtgcttatgctggttgcccactatgcgattatcggacctggcctccaagccaaggctacccgggaggcccagaaacgcacagctgccgggattatgaagaatcccaccgtggacggaatcgtcgccatcgatctggaccccgtggtgtacgatgcgaagttcgaaaaacagctgggccagattatgctccttatcctgtgtacgtctcaaattctgctcatgagaacaacctgggctctgtgcgagagcatcacacttgccaccgggcctctgaccacactctgggagggatccccgggcaagttttggaacacgaccattgctgtttctatggccaatatcttccggggcagctatctggccggggctggactggccttctccctcatgaaaagccttggcgggggacgcagaggcacaggggcgcagggagaaaccctgggcgagaagtggaaacggcagctgaaccagctctccaagtctgaatttaatacatacaagagaagcggcatcatggaggtcgaccgctccgaagccaaagaggggctgaagcggggagagaccacgaaacacgctgtgtctagaggcacagccaaacttcgctggttcgtggaacggaacctggtcaaacccgaggggaaggttattgacctcggatgtggcagagggggatggagctattactgcgctggcctgaagaaagtgaccgaagtgaagggctataccaaagggggacctggccatgaggaacccatccctatggccacatacgggtggaatctggtcaagctccactccggaaaagatgtgtttttcattccccctgagaagtgtgacacccttctgtgcgatatcggcgagtctagcccgaaccccacaattgaagaggggcgcacgctgcgggttctcaaaatggtggaaccttggctgagaggaaatcaattttgtatcaagattcttaacccctacatgccttccgtcgtggagaccctggagcagatgcagcgcaagcatggcggcatgctcgttcggaatcccctgagcagaaactctacacacgaaatgtattgggtgtcctgcgggaccggaaatatcgtcagcgcggtgaacatgacatctcgcatgctgctcaaccggttcaccatggcccacagaaaaccgacgtacgagcgcgacgtggatctgggcgctgggaccagacatgtcgccgttgaacctgaggtggctaatcttgacatcattggacagcggatcgaaaacattaagcacgagcataaatccacatggcactatgatgaggacaatccctacaagacctgggcctatcatggcagctacgaagtgaaaccctctgggtccgctagctccatggtcaacggagtggttaagctgctcacaaagccttgggatgtgatccccatggtcacccaaattgccatgacagacaccacgccttttggccagcagcgcgtgttcaaagagaaggttgatacaagaaccccgaaagcgaagcggggcaccacacaaatcatggaagtgacggccagatggctgtgggggtttcttagccggaataaaaagccccgcatctgtaccagagaggagttcacacggaaggtccgctctaacgctgccattggagctgtgtttgttgacgagaatcagtggaacagcgccaaagaggccgtggaagacgagagattctgggatctggtccaccgggaacgcgagctccacaagcagggcaaatgcgcgacctgcgtgtataatatgatggggaagagagagaaaaagctgggagagtttggcaaggctaaagggtcccgggccatctggtacatgtggctgggcgcccgcttcctcgagttcgaagctctgggatttatgaacgaggaccattggttctctagagaaaatagcctttccggcgtcgagggggagggactgcacaagctcggctacattctgcgggatatctctaaaattcctgggggaaacatgtatgccgacgatacagctggctgggacacccgcatcacagaagatgaccttcagaatgaggccaagatcaccgatattatggaacccgagcatgcgctgctcgccaaagctatctttaagctgacgtaccaaaacaaagtggttagagtgcagcggcctgccaagaatgggaccgtcatggacgtgattagccgcagagatcagcggggctccggacaggtgggcacatatgggctgaacaccttcacaaacatggaagctcaactcatcagacagatggagtctgagggaatttttagcccctccgaactggagaccccgaatcttgccgaacgcgttctggactggctcgagaagtacggcgtggaacggctgaaaagaatggcgatcagcggggatgactgtgtcgtgaagcctatcgacgatcgcttcgccacggctcttacagccctgaacgacatgggaaaagttcggaaggatattccccagtgggagccttctaaaggctggaatgactggcagcaagtgcccttttgctcccaccacttccatcagctcatcatgaaggatgggagagagattgtcgtgccttgtcgcaaccaggacgaactggtcggccgggctagagtgagccagggagccggctggtctctgcgcgagaccgcttgcctcgggaagtcctatgcccaaatgtggcagctgatgtactttcaccggagagatcttcgcctggcggccaatgctatctgtagcgccgttcccgtggactgggtcccgacatcccggaccacgtggtctattcatgcccaccatcagtggatgaccacagaagatatgctcagcgtgtggaacagagtttggatcgaggaaaatccttggatggaggacaaaacccacatttccagctgggaggatgtgccctatctgggaaagcgggaagaccaatggtgcggctctcttatcgggctgacagctagagccacctgggcgacaaacatccaggtcgctattaatcaggtgcgccggctcatcggaaacgagaattacctggactacatgacctccatgaaaagattcaagaacgaaagcgatcccgagggcgccctgtggtga

SEQ ID NO: 19417 - RNA, 9879 nt, synthetic construct
  misc_feature 1..9879: note = derived and/or modified CDS sequence (opt5) from DENV-1__KC762650__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagaccagcgccggcgttaatatgtgcacccttatcgcgatggacctgggggagctctgtgaagatacactgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagcgcgttgaaacatgggctcttagacaccccggcttcaccgtgatcgccctgtttctcgcgcatgccattgggacatctatcacccagaaaggaatcattttcatcctgcttatgctggtcacccctagcatggctatgcggtgcgtgggcattgggtcccgcgattttgttgagggactcagcggcgccacatgggtggacgtcgtgctggagcacgggtcttgtgtgacgaccatggctaaggataagcccacactggacatcgaactcctgaaaaccgaggtcacaaaccctgccgttcttagaaagctgtgcattgaagcgaaaatctccaataccacgacagatagccggtgtccgacccaaggagaggccaccctcgtggaagaacaagacgctaacttcgtgtgccgcagaacatttgtcgatcggggctggggcaatgggtgtggactgttcggcaaggggtctcttattacctgcgccaaatttaagtgcgtgacaaagctggagggaaaaatcgttcagtacgaaaacctcaagtattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccgcaccggcctggacttcaacgaaatggtgcttctgacgatgaaagagaagtcctggctcgtccataaacagtggtttctggatcttcctctgccctggacaagcggggcttccacctctcaagagacatggaatagacaggacctcctggtgaccttcaagaccgcgcacgccaaaaagcaggaagtcgtggttctgggaagccaagagggcgctatgcacacagccctcacgggggccaccgaaattcagacatccggaaccacaaccatctttgctggccatctgaagtgccggcttaaaatggataagctgacgctcaaagggatgagctatgtgatgtgtacaggctctttcaagctggagaaagaagtcgccgagacccagcacggaaccgtgctggttcagattaagtacgagggcacagacgcgccgtgcaagatccctttctccacccaagatgaaaaaggggtgacacagaacggaagacttatcacggctaatcccattgtcaccgacaaggagaaacctgtgaacatcgaagccgagccgccctttggcgagagctatattgtgatcggggccggagaaaaggctctcaaactgtcttggttcaagaagggcagctccattgggaaaatgtttgaggccacagctcgcggcgcccggagaatggcgatcctgggagataccgcctgggacttcggctctatcgggggagtttttacaagcgtcggcaagctcgtgcatcagattttcgggaccgcttacggagtgctgttttccggcgtcagctggacgatgaaaatcgggattggcgtgcttctgacctggctcggactcaattctcgctccacaagcctgtctatgacctgtatcgccgttggccttgtgacactctacctgggggtcatggtgcaggctgattccggatgcgttattaactggaagggccgggaactgaaatgtgggagcggaatcttcgtgaccaatgaggtccacacatggaccgaacaatataagtttcaggccgactcccctaagagactctctgcggccattggcaaggcttgggaggagggggtgtgcggcatccgcagcgccacgcggctggaaaacatcatgtggaagcagatttccaacgagcttaatcatatcctgctcgaaaacgacatgaaattcacagttgtggtcggagatgtggctggcattctggcccaggggaagaaaatgatcagaccgcaacccatggagcacaagtactcttggaaaagctggggaaaggccaagattatcggcgctgacgtgcagaataccacctttatcattgatgggcctaacacacccgaatgtcctgacgatcagcgcgcgtggaatatctgggaggtcgaggactatggattcggcatttttaccacgaacatctggctgaaacttcgggattcctacacacaggtttgcgaccacagactcatgagcgccgctattaaggattctaaagccgtgcatgccgacatgggctattggatcgaatccgagaagaatgaaacctggaaactggctcgcgccagcttcatcgaggtgaagacatgtatttggcccaagtctcacaccctgtggtccaacggggtcctcgaaagcgagatgatcattccgaaaatctacggaggccctatttctcaacataattatcggcccgggtacttcacacagaccgcgggaccttggcacctgggcaaacttgagctggattttaacctctgcgaagggacgaccgtggttgtggacgagcactgcggaaatagaggccccagcctgcggacaaccacagtcaccggcaaaatcatccatgaatggtgttgccgctcctgtacgctgcctccccttagattcagaggggaagatggatgctggtacggcatggagattcggccggtgaaggaaaaagaggaaaacctcgttaagagcatggtgtctgctgggtccggagaggtcgacagcttttccctgggcctgctctgtatctctattatgatcgaagaggtgatgcgcagccggtggtccagaaagatgctgatgacagggacccttgccgttttctttctgctcattatgggacagctgacatggaatgacctgatccgcctttgcattatggtgggcgccaacgcttctgatagaatgggcatggggaccacctatctggccctcatggcgacattcaaaatgcggcctatgtttgctgtcggactgctgttccgcagactgacgagccgggaggtgcttctgctcaccatcggcctgtccctggtggcctctgtcgaacttcccaatagcctggaggaactcggggacggactggccatgggcatcatgattctcaagctgcttacagattttcaatcccaccagctgtgggctaccctcctgagcctgacattcatcaaaaccacgttttctcttcattacgcctggaagacaatggctatggttctgtccattgtgagcctcttccccctgtgtctctctaccacctcccagaaaacaacctggctgcctgtgcttctggggagcctgggatgcaagccgctcacaatgtttctgatcgccgagaacaagatttggggccgcaaatcttggccccttaacgaaggcatcatggcggtcgggatcgtgtccattctgctcagctccctgctcaagaatgacgttcctctggccggaccccttatcgctggcgggatgctgattgcctgttatgtgatcagcggatctagcgctgatctgtccctcgagaaagccgccgaggtctcttgggaagaggaagctgagcacagcggcgcgtcccataacattctggtggaagttcaggacgatgggacgatgaagatcaaagacgaggagagagatgacacccttacaatcctgctcaaggccaccctgctcgctgtgtctggagtctaccctctgagcattcccgccacacttttcgtgtggtatttctggcagaagaagaagcagcggtccggcgtcctgtgggataccccttctcccccggaagtggagcgcgccgttctggacgatggcatctacagaattatgcagcgggggctcctgggacgcagccaggtgggcgtcggggtgtttcaagaaaatgttttccacacgatgtggcacgtgaccagaggagctgtccttatgtatcagggcaaacggctggagccttcctgggccagcgtgaagaaagacctcatctcttacgggggaggctggagactgcagggctcctggaacacaggggaggaagtgcaggttattgcggtcgagcccggaaagaatcctaaaaacgtgcaaaccgctcccggcacatttaagaccccggaaggggaggtgggagccatcgccctcgacttcaagcctggcacaagcgggtctcccattgtcaatcgcgaaggaaaaatcgtgggcctgtacggcaacggggttgtgacgacctccggaacatatgtcagcgctatcgcccaggcgaaggcttcccaggagggccctcttcccgagattgaagatgaggtgtttcggaaaagaaatctgaccatcatggacctgcatcccgggtctggaaagacccgccggtacctccctgccattgttagagaagccatcaaacgcaagctgcggacacttattctggctccgacgagagtggtcgccagcgagatggctgaagccctcaagggcatgcccatccgctatcaaaccacagcggtgaaatccgagcacaccgggaaggagatcgttgatctgatgtgccatgccacattcaccatgcggctgctcagccctgtgagagtccccaactacaatatgattatcatggacgaagctcactttacggatccttcttccattgccgctcggggctatatcagcacacgcgtgggaatgggcgaggccgccgctattttcatgaccgcgacaccccctgggtctgtggaagcctttccgcagagcaacgctgtcatccaggacgaggaaagagatatccccgagcggtcctggaactctggatacgagtggattacagacttccctggcaaaaccgtttggtttgtgcccagcatcaagtccgggaacgatattgccaattgtcttcgcaaaaacggaaagagagtgatccagctgtctcggaagacattcgacaccgaatatcagaaaacgaagaacaatgattgggactacgtcgtgacaaccgacattagcgagatgggcgccaacttcagagctgatcgcgttatcgaccctcggagatgcctgaaacccgtgattctcaaggatgggccggaacgcgtcatcctggccggccctatgcccgtgacagttgcgtccgctgcccagcggagaggacgcgtgggccggaatcataacaaagagggggaccagtacatctatatgggacagccccttaataacgatgaggaccacgcccactggaccgaagctaagatgctgctcgataatattaacacgcctgagggcatcattcccgccctgtttgaacctgagagagaaaagagcgcggccatcgacggggagtaccgcctgagaggagaggctcggaaaaccttcgtcgaactcatgcgcagaggcgatcttccggtgtggctgtcttataaggtcgcctccgaggggtttcaatacagcgaccggcgctggtgcttcgatggcgaaagaaataaccaggtgctggaggaaaatatggacgttgagatttggacaaaagagggagaacggaagaaactcagaccccgctggctggatgctcggacctattccgaccctcttgccctgagagagtttaaggagttcgctgccggccgccggtctgtgagcggggacctcatcctggagatcggaaaactgccccagcatctcacacagagagcgcaaaacgcccttgataatctggtgatgctgcacaactccgaacagggcgggcgggcttaccgccatgccattgaggagctccctgacaccatcgaaacactgatgcttctggctctcattgccgtcctgaccggaggcgttacgctgtttttcctctctggcagagggcttggaaagacaagcatcggcctgctgtgtgtgatggcctccagcgtgctcctgtggatggcttctgtcgagccccactggattgcggcctccatcatccttgaatttttcctgatggtgctcctgattccggagcctgatcggcagcgcacaccccaagacaatcaactggcttatgttgtgatcgggctcctttttatgattctgaccgtcgccgccaacgagatgggactgctcgaaaccaccaagaaagatctgggcatcgggcacgtggctgtcgagaaccatcaccatgccgcgatgcttgacgtggatctgcaccctgccagcgcttggacactctacgccgttgctacgaccattatcacacccatgatgagacataccattgaaaatacaaccgccaacatctctctgacggcgatcgccaatcaggctgccattctgatgggactcgacaagggctggcctatctccaaaatggatattggcgtgccccttctggctctggggtgctacagccaggtcaacccgctcaccctgacagccgctgtgcttatgctggttgcccactatgcgatcattggacctggcctccaagccaaggctacccgggaggcccagaaacgcacagctgccgggatcatgaagaatcccaccgtggacggaatcgtcgccattgatctggaccccgtggtgtacgatgcgaagttcgaaaaacagctgggccagatcatgctccttattctgtgtacgtctcaaatcctgctcatgagaacaacctgggctctgtgcgagagcattacacttgccaccgggcctctgaccacactctgggagggatccccgggcaagttttggaacacgaccatcgctgtttctatggccaatatcttccggggcagctatctggccggggctggactggccttctccctcatgaaaagccttggcgggggacgcagaggcacaggggcgcagggagaaaccctgggcgagaagtggaaacggcagctgaaccagctctccaagtctgaatttaatacatacaagagaagcggcattatggaggtcgaccgctccgaagccaaagaggggctgaagcggggagagaccacgaaacacgctgtgtctagaggcacagccaaacttcgctggttcgtggaacggaacctggtcaaacccgaggggaaggttatcgacctcggatgtggcagagggggatggagctattactgcgctggcctgaagaaagtgaccgaagtgaagggctataccaaagggggacctggccatgaggaacccattcctatggccacatacgggtggaatctggtcaagctccactccggaaaagatgtgtttttcattccccctgagaagtgtgacacccttctgtgcgatattggcgagtctagcccgaaccccacaatcgaagaggggcgcacgctgcgggttctcaaaatggtggaaccttggctgagaggaaatcaattttgtattaagatccttaacccctacatgccttccgtcgtggagaccctggagcagatgcagcgcaagcatggcggcatgctcgttcggaatcccctgagcagaaactctacacacgaaatgtattgggtgtcctgcgggaccggaaatatcgtcagcgcggtgaacatgacatctcgcatgctgctcaaccggttcaccatggcccacagaaaaccgacgtacgagcgcgacgtggatctgggcgctgggaccagacatgtcgccgttgaacctgaggtggctaatcttgacattatcggacagcggattgaaaacatcaagcacgagcataaatccacatggcactatgatgaggacaatccctacaagacctgggcctatcatggcagctacgaagtgaaaccctctgggtccgctagctccatggtcaacggagtggttaagctgctcacaaagccttgggatgtgattcccatggtcacccaaatcgccatgacagacaccacgccttttggccagcagcgcgtgttcaaagagaaggttgatacaagaaccccgaaagcgaagcggggcaccacacaaatcatggaagtgacggccagatggctgtgggggtttcttagccggaataaaaagccccgcatttgtaccagagaggagttcacacggaaggtccgctctaacgctgccatcggagctgtgtttgttgacgagaatcagtggaacagcgccaaagaggccgtggaagacgagagattctgggatctggtccaccgggaacgcgagctccacaagcagggcaaatgcgcgacctgcgtgtataatatgatggggaagagagagaaaaagctgggagagtttggcaaggctaaagggtcccgggccatttggtacatgtggctgggcgcccgcttcctcgagttcgaagctctgggatttatgaacgaggaccattggttctctagagaaaatagcctttccggcgtcgagggggagggactgcacaagctcggctacatcctgcgggatatttctaaaatccctgggggaaacatgtatgccgacgatacagctggctgggacacccgcatcacagaagatgaccttcagaatgaggccaagattaccgatatcatggaacccgagcatgcgctgctcgccaaagctatttttaagctgacgtaccaaaacaaagtggttagagtgcagcggcctgccaagaatgggaccgtcatggacgtgatcagccgcagagatcagcggggctccggacaggtgggcacatatgggctgaacaccttcacaaacatggaagctcaactcattagacagatggagtctgagggaatctttagcccctccgaactggagaccccgaatcttgccgaacgcgttctggactggctcgagaagtacggcgtggaacggctgaaaagaatggcgatcagcggggatgactgtgtcgtgaagcctattgacgatcgcttcgccacggctcttacagccctgaacgacatgggaaaagttcggaaggatatcccccagtgggagccttctaaaggctggaatgactggcagcaagtgcccttttgctcccaccacttccatcagctcattatgaaggatgggagagagatcgtcgtgccttgtcgcaaccaggacgaactggtcggccgggctagagtgagccagggagccggctggtctctgcgcgagaccgcttgcctcgggaagtcctatgcccaaatgtggcagctgatgtactttcaccggagagatcttcgcctggcggccaatgctatttgtagcgccgttcccgtggactgggtcccgacatcccggaccacgtggtctatccatgcccaccatcagtggatgaccacagaagatatgctcagcgtgtggaacagagtttggattgaggaaaatccttggatggaggacaaaacccacatctccagctgggaggatgtgccctatctgggaaagcgggaagaccaatggtgcggctctcttatcgggctgacagctagagccacctgggcgacaaacattcaggtcgctatcaatcaggtgcgccggctcattggaaacgagaattacctggactacatgacctccatgaaaagattcaagaacgaaagcgatcccgagggcgccctgtggtga

SEQ ID NO: 19418 - RNA, 9879 nt, synthetic construct
  misc_feature 1..9879: note = derived and/or modified CDS sequence (opt5) from DENV-1__KC762623__SS-prME
  source 1..9879: mol_type = other RNA
tccgtgaccatgctgctcatgctgatgcccacagcccttgctttccacctgacgaccagaggaggggaacctcatatgatcgtgtccaagcaggaacggggaaaatctctcctgtttaagacaagcgccggcgttaacatgtgcacccttattgcgatggacctgggggagctctgtgaagatacactgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgtccaaactggagggaaagatcgttcagtacgaaaacctcaaatatagcgtgatcgtcacagtgcacacgggcgaccagcatcaagttgggaatgagtctaccgaacacggaacaaccgctacaattacaccccaggcccctacgaccgagatccagctgacagactacggcgccctgaccctcgattgtagcccccggacaggcctggacttcaacgaaatggtgcttctgaccatgaaggagaaaagctggctcgtccataagcagtggtttctggatcttcctctgccctggacgtccggggcttctacaagccaagagacctggaatcgccaggacctcctggtgacattcaaaaccgcgcacgccaagaagcaggaagtcgtggttctgggatcccaagagggcgctatgcacaccgccctcacaggggccacggaaattcagaccagcggaacaaccacaatctttgctggccatctgaaatgcagacttaagatggataaactgaccctcaaggggatgtcttatgtgatgtgtacgggctccttcaaactggagaaggaagtcgccgagacacagcacggaaccgtgctggttcagattaagtacgagggcaccgacgcgccgtgcaaaatccctttcagcacacaagatgaaaagggggtgacccagaacggacggcttatcacagctaatcccattgtcacggacaaagagaagcctgtgaacatcgaagccgagccgccctttggcgagtcttatattgtgatcggggccggagaaaaagctctcaagctgagctggttcaagaaaggctcctctattgggaagatgtttgaggccaccgctagaggcgcccgccggatggcgatcctgggagatacagcctgggacttcggcagcatcgggggagtttttacctccgtcggcaaactcgtgcatcagattttcgggacagcttacggagtgctgtttagcggcgtctcttggaccatgaagatcgggattggcgtgcttctgacgtggctcggactcaattccagaagcacctctctgtccatgacatgtatcgccgttggccttgtgaccctctacctgggggtcatggtgcaggctgatagcggatgcgttattaactggaaaggccgcgaactgaagtgtgggtccggaatcttcgtgacaaatgaggtccacacctggacagaacaatataagtttcaggccgactctcctaaacggctcagcgcggccattggcaaggcttgggaggagggggtgtgcggcatcagatccgccacccgcctggaaaacatcatgtggaaacagatttctaacgagcttaatcatatcctgctcgaaaacgacatgaagttcacggttgtggtcggagatgtggctggcattctggcccaggggaaaaagatgatccggccgcaacccatggagcacaaatacagctggaagtcctggggaaaggccaaaattatcggcgctgacgtgcagaatacaacctttatcattgatgggcctaacacccccgaatgtcctgacgatcagagagcgtggaatatctgggaggtcgaggactatggattcggcatttttacaaccaacatctggctgaaacttcgcgatagctacacgcaggtttgcgaccaccggctcatgtctgccgctattaaagattccaaggccgtgcatgccgacatgggctattggatcgaaagcgagaaaaatgaaacatggaagctggctagagcctctttcatcgaggtgaagtcctgtatttggcccaaaagccacaccctgtggtctaacggggtcctcgaaagcgagatgatcattccgaagatctacggaggccctatttcccaacataattatcgccccgggtacttcacacagaccgcgggaccttggcacctgggcaaacttgagctggattttgacctctgcgaagggacaaccgtggttgtggatgagcactgcggaaaccggggccccagcctgagaacgaccacagtcaccggcaagatcatccatgaatggtgttgccggtcttgtacactgcctccccttcgcttcagaggggaggacggatgctggtacggcatggagattcggccggtgaaagaaaaggaggaaaatctcgttaagtccatggtgagcgctgggtccggagaggtcgactcttttagcctgggcctgctctgtatctccattatgatcgaagaggtgatgagatctcgctggagccggaaaatgctgatgaccgggacgcttgccgttttctttctgctcattatgggacagctgacatggaacgatctgatcagactttgcattatggtgggcgccaatgcttccgaccgcatgggcatggggaccacatatctggccctcatggcgaccttcaagatgagacctatgtttgctgtcggactgctgttccggcgcctgacctctagagaggtgcttctgctcacaatcggcctgagcctggtggcctccgtcgaacttcccaacagcctggaggaactcggggatggactggccatgggcatcatgattctcaaactgcttacggactttcaatctcaccagctgtgggctaccctcctgtccctgacattcatcaagaccacatttagccttcattacgcctggaaaaccatggctatggttctgtctattgtgtccctcttccccctgtgtctcagcacgacatctcagaagaccacctggctgcctgtgcttctggggtccctgggatgcaagccgctcacaatgtttctgatcgccgagaataaaatttggggccggaagtcctggccccttaacgaaggcatcatggcggtcgggatcgtgtccattctgctcagctctctgctcaaaaacgatgttcctctggccggaccccttatcgctggcgggatgctgattgcctgttatgtgatcagcggatcctctgctgacctgagcctcgagaaggccgccgaggtctcctgggaagaggaagctgagcactctggcgcgagccataatattctggtggaagttcaggatgacgggaccatgaaaatcaaggatgaggagcgcgacgatacacttacgatcctgctcaaagccaccctgctcgctgtgtccggagtctaccctctgtctattcccgccacacttttcctgtggtatttctggcaaaagaagaaacagagaagcggcgtgctgtgggacacccctagccctcccgaagtcgagcgggccgtgctcgatgacggcatctaccgcattatgcagagagggctgcttggacggagccaggttggcgtgggggtctttcaagaaaacgtgttccacacaatgtggcacgttacccgcggagctgtgctgatgtatcagggcaagagactcgagccctcttgggcctccgtcaaaaaggacctgatcagctacgggggaggctggcggctccagggctcttggaatacgggggaggaagtccaggtgattgcggttgagcccggcaagaatcctaagaatgtccaaaccgctcccggcacatttaagaccccggaaggggaggtgggagccatcgccctggatttcaaacctggcacatccgggagccccattgtgaacagagaaggaaagatcgtcggcctttacggcaatggggtggttaccacatccggaacgtatgtgtctgctatcgcccaggcgaaagctagccaggagggccctctgcccgagattgaagacgaggtctttcgcaagcggaacctgaccatcatggatctccatcccgggtccggaaaaacaagacgctacctgcctgccattgtgcgggaagccatcaagagaaaacttcgcaccctgattctcgctccgacccgggttgtggccagcgagatggctgaagccctgaaaggcatgcccatcagatatcaaacaacggcggtcaagtctgagcacaccgggaaagagatcgtggacctgatgtgccatgccacattcaccatgcgcctcctttcccctgttcgggtgcccaattacaacatgattatcatggatgaagctcactttacagaccctagctctattgccgctagaggctatatcagcacccgggtcggaatgggcgaggccgccgctattttcatgacggcgacaccccctgggtccgtggaagcctttccgcagtctaatgctgtgatccaggatgaggaacgcgacatccccgagagaagctggaactccggatacgagtggattaccgatttccctggcaagaccgtctggtttgttccctctatcaaaagcgggaatgacattgccaactgtctgcggaagaatggaaagcgcgtgatccagctgtccagaaaaacattcgataccgaatatcaaaagaccaagaacaacgactgggactacgtggtcaccacggatattagcgagatgggcgccaatttccgggctgacagagtgatcgatcctcgccggtgcctcaagcccgttattctgaaagacgggccggaaagagtgatccttgccggccctatgcccgtcacagtggcgtctgctgcccagcgccggggaagagttggccgcaaccataataaggagggggatcagtacatctatatgggacagcccctgaacaatgacgaggatcacgcccactggaccgaagctaagatgctcctggacaacattaatacacctgagggcatcattcccgccctgtttgaacctgagcgggaaaaatccgcggccatcgatggggagtacagactccgcggagaggctagaaagaccttcgtggaacttatgcggcgcggcgacctgccggtctggctgagctataaagtggcctccgaggggtttcaatactctgatagacggtggtgcttcgacggcgaacgcaacaatcaggtcctcgaggaaaacatggatgtggagatttggacgaaggagggagaacgcaagaagctgcggcccagatggcttgacgctcgcacctatagcgaccctctggccctccgggagtttaaagagttcgctgccggcagacgctccgtttctggggatctgatcctggagatcggaaagctcccccagcatcttacacagcgggcgcaaaatgccctggacaacctggtgatgctccacaatagcgaacagggcgggagagcttaccggcatgccatggaggagctgcctgataccattgaaacacttatgctgctcgctctgatcgccgtgctgaccggaggcgtcacactctttttcctttccggccgcgggctgggaaagaccagcattggcctgctctgtgttatggcctcttccgtgctgctttggatggctagcgtggagccccactggatcgcggcctctattatcctggaatttttcctcatggtcctgctgatcccggagcctgacagacagcggacgccccaggataaccaactcgcttatgtggttattgggcttctgtttatgatcctgacagtggccgccaatgagatgggactcctggaaaccaccaaaaaggaccttggcattgggcacgtcgctgtggagaaccatcaccatgccgcgatgctggatgtcgacctccaccctgcctccgcttggacactgtacgccgtggctaccacaatcattacgcccatgatgcgccataccatcgaaaacacaaccgccaatattagcctgacagcgatcgccaaccaggctgccatcctcatgggacttgataaaggctggcctatttctaagatggacatcggcgttcccctgctggctctcgggtgctacagccaggtgaatccgctgacccttacggccgctgtcctgatgctcgtggcccactatgcgattatcggacctggcctgcaagccaaagctaccagagaggcccagaagcggacagctgccgggattatgaagaaccccaccgttgatggaatcgtggccatcgacctggatcccgtcgtgtacgacgcgaaattcgaaaagcagctcggccagattatgcttctgatcctgtgtacatcccaaattctcctgatgcgcaccacgtgggctctttgcgagtctatcacactggccaccgggcctctcacaaccctgtgggagggaagcccgggcaaattttggaataccacaattgctgtgtccatggccaacatcttcagaggcagctatctggccggggctggactcgccttctcccttatgaagtctctgggcgggggacggcgcggcacgggggcgcagggagaaaccctgggcgagaaatggaagagacagctcaatcagctgagcaagtccgaatttaacacatacaaacggtctggcatcatggaggttgacagaagcgaagccaaggaggggcttaaacgcggagagaccacaaagcacgctgtctcccggggcaccgccaaactgagatggttcgtggaacgcaatctcgtgaagcccgaggggaaggtcattgatctgggatgtggcagagggggatggtcttattactgcgctggcctgaaaaaggttacggaagtgaaaggctatacaaaagggggacctggccatgaggaacccatccctatggccacctacgggtggaacctcgtgaaacttcacagcggaaaggacgtctttttcattccccctgagaaatgtgataccctgctgtgcgacatcggcgagtccagcccgaatcccacaattgaagaggggagaaccctccgcgtgctgaagatggttgaaccttggcttcggggaaaccaattttgtatcaagattctgaatccctacatgccttctgtggtcgagacactcgagcagatgcagagaaaacatggcggcatgctggtgcgcaaccccctgtcccggaatagcacgcacgaaatgtattgggtttcttgcgggaccggaaacatcgtgtccgcggtcaatatgacaagcagaatgctcctgaaccgcttcaccatggcccaccggaagccgacatacgagagagatgtggaccttggcgctgggacccgccatgtggccgtcgaacctgaggttgctaacctggatatcattggacagagaatcgaaaatattaaacacgagcataagtctacgtggcactatgacgaggataacccctacaaaacctgggcctatcatggctcctacgaagtgaagcccagcgggtccgctagctctatggtgaatggagtcgtgaagctcctgacaaaaccttgggacgttatccccatggtgacccaaattgccatgacagataccacaccttttggccagcagcgggtcttcaaggagaaagtggacacccgcacgccgaaggcgaaaagaggcacaacccaaatcatggaagttaccgcccggtggctttgggggtttctgagcagaaacaagaagccccggatctgtacacgcgaggagttcacgagaaaagtgcggtccaatgctgccattggagctgtctttgtggacgagaaccagtggaactctgccaaggaggccgttgaagatgagcgcttctgggacctcgtgcacagagaacgggagctgcacaaacagggcaagtgcgcgacctgcgtctataacatgatggggaaacgcgaaaagaagctgggagagtttggcaaagctaaggggagcagagccatctggtacatgtggctcggcgcccggttcctggagttcgaagctcttggatttatgaatgaggatcattggttctcccgcgaaaactctctgagcggcgtggagggggagggactccacaaactgggctacattcttagagacatctccaagattcctgggggaaatatgtatgccgatgacacagctggctgggatacccggatcacagaagacgatctgcagaacgaggccaaaatcaccgacattatggaacccgagcatgcgctcctggccaaggctatctttaaactgacataccaaaataaggtcgtgcgcgttcagagacctgccaagaacgggaccgtgatggatgtcatttctcggcgcgaccagagaggcagcggacaggtgggcacgtatgggctcaataccttcacaaacatggaagctcaactgatccggcagatggagtccgagggaatttttagcccctctgaacttgagaccccgaacctggccgaaagagtgctcgattggctggagaaatacggcgttgaacgccttaagcggatggcgatctccggggacgactgtgtggtcaaacctatcgatgacagattcgccacagctctgaccgccctcaatgatatgggaaaggtgcgcaaagacattccccagtgggagcctagcaagggctggaacgattggcagcaagttcccttttgctctcaccacttccatcagctgatcatgaaggacgggcgggagattgtggtcccttgtagaaatcaggatgaactggtgggccgcgctcgggtctcccagggagccggctggagcctcagagagacggcttgcctggggaaatcctatgcccaaatgtggcagcttatgtactttcaccgccgggacctgagactcgcggccaacgctatctgttctgccgtgcccgttgattgggtgccgacaagccgcaccacatggtccattcatgcccaccatcagtggatgaccacggaagacatgctgagcgtctggaatcgggtgtggatcgaggaaaacccttggatggaggataagacccacatttcttcctgggaggacgttccctatcttggaaaaagagaagaccaatggtgcggcagcctgatcgggctcacagctcgggccacctgggcgacaaatatccaggtggctattaaccaggtcagacgcctgatcggaaatgagaactacctggattacatgacctctatgaagcggttcaaaaatgaaagcgaccccgagggcgccctctggtga

SEQ ID NO: 19419 - RNA, 9879 nt, synthetic construct
  misc_feature 1..9879: note = derived and/or modified CDS sequence (opt5) from DENV-1__KC762632__SS-prME
  source 1..9879: mol_type = other RNA
agcgtgaccatgctgctcatgctgatgcccacagcccttgctttccacctgacgacccggggcggggagcctcatatgatcgtctccaagcaggaacggggaaaatctctcctgtttaagaccagcgccggcgttaatatgtgcacccttattgcgatggacctgggggagctctgtgaagatacactgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagatgcagcgcgttgaaacatgggctcttagacaccccggcttcaccgtgattgccctgtttctcgcgcatgccatcgggacatctattacccagaaaggaatcatcttcattctgcttatgctggtcacccctagcatggctatgcggtgcgtgggcatcgggtcccgcgattttgttgagggactcagcggcgccacatgggtggacgtcgtgctggagcacgggtcttgtgtgacgaccatggctaaggataagcccacactggacattgaactcctgaaaaccgaggtcacaaaccctgccgttcttagaaagctgtgcatcgaagcgaaaatttccaatatcaccacggatagccggtgtccgacacaaggagaggccaccctcgtggaagaacaagacgctaacttcgtgtgccgcagaacctttgtcgatcggggctggggcaatgggtgtggactgttcggcaaggggtctcttattacatgcgccaaatttaagtgcgtgaccaagctggagggaaaaatcgttcagtacgaaaacctcaagtattccgtgatcgtcacagtgcacacgggcgaccagcatcaagttgggaatgagagcaccgaacacggaacaaccgctacaattacgccccaagcccctaccaccgagatccagctgacagactacggcgccctgaccctcgattgttctccccgcacaggcctggacttcaacgaaatggtgcttctgaccatgaaagagaagtcctggctcgtccataaacagtggtttctggatcttcctctgccctggacgagcggggcttccacatctcaagagacctggaatagacaggacctcctggtgacattcaagaccgcgcacgccaaaaagcaggaagtcgtggttctgggaagccaagagggcgctatgcacaccgccctcacaggggccacggaaattcagacctccggaacaaccacaatctttgctggccatctgaagtgccggcttaaaatggataagctgaccctcaaagggatgagctatgtgatgtgtacgggctctttcaagctggagaaagaagtcgccgagacacagcacggaaccgtgctggttcagattaagtacgagggcaccgacgcgccgtgcaagatccctttctccacacaagatgaaaaaggggtgacccagaacggaagacttatcacagctaatcccattgtcacggacaaggagaaacctgtgaacatcgaagccgagccgccctttggcgagagctatattgtgatcggggccggagaaaaggctctcaaactgtcttggttcaagaagggcagctccattgggaaaatgtttgaggccaccgctcgcggcgcccggagaatggcgatcctgggagatacagcctgggacttcggctctatcgggggagtttttaccagcgtcggcaagctcgtgcatcagattttcgggacagcttacggagtgctgttttccggcgtcagctggaccatgaaaatcgggattggcgtgcttctgacgtggctcggactcaattctcgctccaccagcctgtctatgacatgtatcgccgttggccttgtgaccctctacctgggggtcatggtgcaggctgattccggatgcgttattaactggaagggccgggaactgaaatgtgggagcggaatcttcgtgacaaatgaggtccacacctggacagaacaatataagtttcaggccgactcccctaagagactctctgcggccattggcaaggcttgggaggagggggtgtgcggcatccgcagcgccacccggctggaaaacatcatgtggaagcagatttccaacgagcttaatcatatcctgctcgaaaacgacatgaaattcacggttgtggtcggagatgtggctggcattctggcccaggggaagaaaatgatcagaccgcaacccatggagcacaagtactcttggaaaagctggggaaaggccaagattatcggcgctgacgtgcagaatacaacctttatcattgatgggcctaacacccccgaatgtcctgacgatcagcgcgcgtggaatatctgggaggtcgaggactatggattcggcatttttacaaccaacatctggctgaaacttcgggattcctacacgcaggtttgcgaccacagactcatgagcgccgctattaaggattctaaagccgtgcatgccgacatgggctattggatcgaatccgagaagaatgaaacatggaaactggctcgcgccagcttcatcgaggtgaagacctgtatttggcccaagtctcacacactgtggtccaacggggtcctcgaaagcgagatgatcattccgaaaatctacggaggccctatttctcaacataattatcggcccgggtacttcacccagacagcgggaccttggcacctgggcaaacttgagctggattttaacctctgcgaagggaccacggtggttgtggacgagcactgcggaaatagaggccccagcctgcggaccacaaccgtcacaggcaaaatcatccatgaatggtgttgccgctcctgtaccctgcctccccttagattcagaggggaggatggatgctggtacggcatggagattagaccggtgaaggaaaaagaggaaaacctcgttaagagcatggtgtctgctgggtccggagaggtcgacagcttttccctgggcctgctctgtatctctattatgatcgaagaggtgatgcgcagccggtggtccagaaagatgctgatgacggggacacttgccgttttctttctgctcattatgggacagctgacctggaatgacctgatccgcctttgcattatggtgggcgccaacgcttctgatagaatgggcatggggacaacctatctggccctcatggcgaccttcaaaatgcggcctatgtttgctgtcggactgctgttccgcagactgacaagccgggaggtgcttctgctcacgatcggcctgtccctggtggcctctgtcgaacttcccaatagcctggaggaactcggggacggactggccatgggcatcatgattctcaagctgcttaccgattttcaatcccaccagctgtgggctacactcctgagcctgaccttcatcaaaacaaccttttctcttcattacgcctggaagacgatggctatggttctgtccattgtgagcctcttccccctgtgtctctctacaacctcccagaaaaccacatggctgcctgtgcttctggggagcctgggatgcaagccgctcaccatgtttctgatcgccgagaacaagatttggggccgcaaatcttggccccttaacgaaggcatcatggcggtcgggatcgtgtccattctgctcagctccctgctcaagaatgacgttcctctggccggaccccttatcgctggcgggatgctgattgcctgttatgtgatcagcggatctagcgctgatctgtccctcgagaaagccgccgaggtctcttgggaagaggaagctgagcacagcggcgcgtcccataacattctggtggaagttcaggacgatgggacaatgaagatcaaagacgaggagagagatgacacgcttaccatcctgctcaaggccacactgctcgctgtgtctggagtctaccctctgagcattcccgccacccttttcgtgtggtatttctggcagaagaagaagcagcggtccggcgtcctgtgggatacaccttctcccccggaagtggagcgcgccgttctggacgatggcatctacagaattatgcagcgggggctcctgggacgcagccaggtgggcgtcggggtgtttcaagaaaatgttttccacaccatgtggcacgtgacgagaggagctgtccttatgtatcagggcaaacggctggagccttcctgggccagcgtgaagaaagacctcatctcttacgggggaggctggagactgcagggctcctggaacaccggggaggaagtgcaggttattgcggtcgagcccggaaagaatcctaaaaacgtgcaaacagctcccggcacctttaagacaccggaaggggaggtgggagccatcgccctcgacttcaagcctggcaccagcgggtctcccattgtcaatcgcgaaggaaaaatcgtgggcctgtacggcaacggggttgtgacaacgtccggaacctatgtcagcgctatcgcccaggcgaaggcttcccaggagggccctcttcccgagattgaagatgaggtgtttcggaaaagaaatctgacaatcatggacctgcatcccgggtctggaaagacccgccggtacctccctgccattgttagagaagccatcaaacgcaagctgcggacccttattctggctccgacaagagtggtcgccagcgagatggctgaagccctcaagggcatgcccatccgctatcaaacgaccgcggtgaaatccgagcacacagggaaggagatcgttgatctgatgtgccatgccaccttcacaatgcggctgctcagccctgtgagagtccccaactacaatatgattatcatggacgaagctcactttaccgatccttcttccattgccgctcggggctatatcagcacgcgcgtgggaatgggcgaggccgccgctattttcatgacagcgacaccccctgggtctgtggaagcctttccgcagagcaacgctgtcatccaggacgaggaaagagatatccccgagcggtcctggaactctggatacgagtggattaccgacttccctggcaaaacagtttggtttgtgcccagcatcaagtccgggaacgatattgccaattgtcttcgcaaaaacggaaagagagtgatccagctgtctcggaagaccttcgacacagaatatcagaaaaccaagaacaatgattgggactacgtcgtgacgacagacattagcgagatgggcgccaacttcagagctgatcgcgttatcgaccctcggagatgcctgaaacccgtgattctcaaggatgggccggaacgcgtcatcctggccggccctatgcccgtgaccgttgcgtccgctgcccagcggagaggacgcgtgggccggaatcataacaaagagggggaccagtacatctatatgggacagccccttaataacgatgaggaccacgcccactggacagaagctaagatgctgctcgataatattaacacccctgagggcatcattcccgccctgtttgaacctgagagagaaaagagcgcggccatcgacggggagtaccgcctgagaggagaggctcggaaaacgttcgtcgaactcatgcgcagaggcgatcttccggtgtggctgtcttataaggtcgcctccgaggggtttcaatacagcgaccggcgctggtgcttcgatggcgaaagaaataaccaggtgctggaggaaaatatggacgttgagatttggaccaaagagggagaacggaagaaactcagaccccgctggctggatgctcggacatattccgaccctcttgccctgagagagtttaaggagttcgctgccggccgccggtctgtgagcggggacctcatcctggagatcggaaaactgccccagcatctcacccagagagcgcaaaacgcccttgataatctggtgatgctgcacaactccgaacagggcgggcgggcttaccgccatgccatggaggagctccctgacacaattgaaaccctgatgcttctggctctcatcgccgtcctgacaggaggcgttaccctgtttttcctctctggcagagggcttggaaagacgagcattggcctgctgtgtgtgatggcctccagcgtgctcctgtggatggcttctgtcgagccccactggatcgcggcctccattatccttgaatttttcctgatggtgctcctgatcccggagcctgatcggcagcgcacaccccaggacaatcaactggcttatgttgtgattgggctcctttttatgatcctgaccgtcgccgccaacgagatgggactgctcgaaaccacaaagaaagatctgggcattgggcacgtggctgtcgagaaccatcaccatgccgcgatgcttgacgtggatctgcaccctgccagcgcttggaccctctacgccgttgctacaacgatcattacccccatgatgagacatacaatcgaaaataccacagccaacatttctctgaccgcgatcgccaatcaggctgccatcctgatgggactcgacaagggctggcctatttccaaaatggatatcggcgtgccccttctggctctggggtgctacagccaggtcaacccgctcacgctgaccgccgctgtgcttatgctggttgcccactatgcgattatcggacctggcctccaagccaaggctacacgggaggcccagaaacgcaccgctgccgggattatgaagaatcccacagtggacggaatcgtcgccatcgatctggaccccgtggtgtacgatgcgaagttcgaaaaacagctgggccagattatgctccttatcctgtgtacctctcaaattctgctcatgagaacgacatgggctctgtgcgagagcatcacccttgccacagggcctctgaccaccctctgggagggatccccgggcaagttttggaacacaacgattgctgtttctatggccaatatcttccggggcagctatctggccggggctggactggccttctccctcatgaaaagccttggcgggggacgcagaggcaccggggcgcagggagaaacactgggcgagaagtggaaacggcagctgaaccagctctccaagtctgaatttaatacctacaagagaagcggcatcatggaggtcgaccgctccgaagccaaagaggggctgaagcggggagagacaaccaaacacgctgtgtctagaggcacggccaaacttcgctggttcgtggaacggaacctggtcaaacccgaggggaaggttattgacctcggatgtggcagagggggatggagctattactgcgctggcctgaagaaagtgacagaagtgaagggctataccaaagggggacctggccatgaggaacccatccctatggccacctacgggtggaatctggtcaagctccactccggaaaagatgtgtttttcattccccctgagaagtgtgacacacttctgtgcgatatcggcgagtctagcccgaaccccaccattgaagaggggcgcacactgcgggttctcaaaatggtggaaccttggctgagaggaaatcaattttgtatcaagattcttaacccctacatgccttccgtcgtggagacgctggaccagatgcagcgcaagcatggcggcatgctcgttcggaatcccctgagcagaaactctacccacgagatgtattgggtgtcctgcgggacaggaaatatcgtcagcgcggtgaacatgacctctcgcatgctgctcaaccggttcacaatggcccacagaaaaccgacctacgaacgcgatgtggacctgggcgctgggacgagacatgtcgccgttgagcctgaagtggctaatcttgatatcattggacagcggatcgagaacattaagcacgaacataaatccacctggcactatgacgaggataatccctacaagacatgggcctatcatggcagctacgaggtgaaaccctctgggtccgctagctccatggtcaacggagtggttaagctgctcaccaagccttgggacgtgatccccatggtcacacaaattgccatgaccgatacaaccccttttggccagcagcgcgtgttcaaagaaaaggttgacacgagaacaccgaaagcgaagcggggcaccacccaaatcatggaggtgacagccagatggctgtgggggtttcttagccggaataaaaagccccgcatctgtacgagagaagagttcacccggaaggtccgctctaacgctgccattggagctgtgtttgttgacgaaaatcagtggaacagcgccaaagaggccgtggaggatgaaagattctgggacctggtccaccgggagcgcgaactccacaagcagggcaaatgcgcgacatgcgtgtataatatgatggggaagagagagaaaaagctgggagaatttggcaaggctaaagggtcccgggccatctggtacatgtggctgggcgcccgcttcctcgagttcgaggctctgggatttatgaacgaagatcattggttctctagagagaatagcctttccggcgtcgaaggggagggactgcacaagctcggctacattctgcgggacatctctaaaattcctgggggaaacatgtatgccgatgacaccgctggctgggatacacgcatcaccgaggacgatcttcagaatgaagccaagatcacagacattatggagcccgaacatgcgctgctcgccaaagctatctttaagctgacctaccaaaacaaagtggttagagtgcagcggcctgccaagaatgggacggtcatggatgtgattagccgcagagaccagcggggctccggacaggtgggcacctatgggctgaacacattcaccaacatggaggctcaactcatcagacagatggaatctgagggaatttttagcccctccgagctggaaacaccgaatcttgccgagcgcgttctggattggctcgaaaagtacggcgtggagcggctgaaaagaatggcgatcagcggggacgactgtgtcgtgaagcctatcgatgaccgcttcgccaccgctcttacggccctgaacgatatgggaaaagttcggaaggacattccccagtgggaaccttctaaaggctggaatgattggcagcaagtgcccttttgctcccaccacttccatcagctcatcatgaaggacgggagagagattgtcgtgccttgtcgcaaccaggatgagctggtcggccgggctagagtgagccagggagccggctggtctctgcgcgaaacagcttgcctcgggaagtcctatgcccaaatgtggcagctgatgtactttcaccggagagaccttcgcctggcggccaatgctatctgtagcgccgttcccgtggattgggtcccgacctcccggacaacctggtctattcatgcccaccatcagtggatgacgaccgaggacatgctcagcgtgtggaacagagtttggatcgaagagaatccttggatggaagataaaacacacatttccagctgggaggacgtgccctatctgggaaagcgggaggaccaatggtgcggctctcttatcgggctgaccgctagagccacatgggcgaccaacatccaggtcgctattaatcaggtgcgccggctcatcggaaacgaaaattacctggattacatgacatccatgaaaagattcaagaacgagagcgaccccgaaggcgccctgtggtga

SEQ ID NO: 19420 - RNA, 9879 nt, synthetic construct
  misc_feature 1..9879: note = derived and/or modified CDS sequence (opt5) from DENV-1__KC762637__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagaccagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcgtgcatcagattttcgggaccgcttacggagtgctgttttccggcgtcagctggacgatgaagatcgggattggcgtgcttctgacctggctcggactcaattctagatccacaagcctgtctatgacctgtatcgccgttggccttgtgacactctacctgggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacgacatgaagttcacagttgtggtcggagatgtggctggcattctggcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaaacttcgcgattcctacacacaggtttgcgaccaccggctcatgagcgccgctattaaagattctaaggccgtgcatgccgacatgggctattggatcgaatccgagaaaaatgaaacctggaagctggctagagccagcttcatcgaggtgaagacatgtatttggcccaaatctcacaccctgtggtccaacggggtcctcgaaagcgagatgatcattccgaagatctacggaggccctatttctcaacataattatcgccccgggtacttcacacagaccgcgggaccttggcacctgggcaaacttgagctggattttgacctctgcgaagggacgaccgtggttgtggatgagcactgcggaaaccggggccccagcctgagaacaaccacagtcaccggcaagatcatccatgaatggtgttgccggtcctgtacgctgcctccccttcgcttcagaggggaggacggatgctggtacggcatggagattcggccggtgaaagaaaaggaggaaaatctcgttaagagcatggtgtctgctgggtccggagaggtcgacagcttttccctgggcctgctctgtatctctattatgatcgaagaggtgatgagaagccgctggtcccggaaaatgctgatgacagggacccttgccgttttctttctgctcattatgggacagctgacatggaacgatctgatcagactttgcattatggtgggcgccaatgcttctgaccgcatgggcatggggaccacctatctggccctcatggcgacattcaagatgagacctatgtttgctgtcggactgctgttccggcgcctgacgagcagagaggtgcttctgctcaccatcggcctgtccctggtggcctctgtcgaacttcccaacagcctggaggaactcggggatggactggccatgggcatcatgattctcaaactgcttacagactttcaatcccaccagctgtgggctaccctcctgagcctgacattcatcaagaccacgttttctcttcattacgcctggaaaacaatggctatggttctgtccattgtgagcctcttccccctgtgtctctctaccacctcccagaagacaacctggctgcctgtgcttctggggagcctgggatgcaagccgctcacaatgtttctgatcgccgagaataaaatttggggccggaagtcttggccccttaacgaaggcatcatggcggtcgggatcgtgtccattctgctcagctccctgctcaaaaacgatgttcctctggccggaccccttatcgctggcgggatgctgattgcctgttatgtgatcagcggatctagcgctgacctgtccctcgagaaggccgccgaggtctcttgggaagaggaagctgagcacagcggcgcgtcccataatattctggtggaagttcaggatgacgggacgatgaaaatcaaggatgaggagcgcgacgatacccttacaatcctgctcaaagccaccctgctcgctgtgtctggagtctaccctctgagcattcccgccacacttttcgtgtggtatttctggcaaaagaagaaacagagatccggcgtcctgtgggacaccccttctcccccggaagtggagcgggccgttctggatgacggcatctaccgcattatgcagagagggctcctgggacggagccaggtgggcgtcggggtgtttcaagaaaacgttttccacacgatgtggcacgtgacccgcggagctgtccttatgtatcagggcaagagactggagccttcctgggccagcgtgaaaaaggacctcatctcttacgggggaggctggcggctgcagggctcctggaatacaggggaggaagtgcaggttattgcggtcgagcccggcaagaaccctaagaatgtgcaaaccgctcccggcacatttaagaccccggaaggggaggtgggagccatcgccctcgatttcaaacctggcacaagcgggtctcccattgtcaacagagaaggaaagatcgtgggcctgtacggcaatggggttgtgacgacctccggaacatatgtcagcgctatcgcccaggcgaaggcttcccaggagggccctcttcccgagattgaagacgaggtgtttcgcaagcggaacctgaccatcatggatctgcatcccgggtctggaaaaaccagacgctacctccctgccattgttcgggaagccatcaagagaaagctgcgcacacttattctggctccgacgcgggtggtcgccagcgagatggctgaagccctcaaaggcatgcccatcagatatcaaaccacagcggtgaagtccgagcacaccgggaaagagatcgttgacctgatgtgccatgccacattcaccatgcgcctgctcagccctgtgcgggtccccaattacaacatgattatcatggatgaagctcactttacggacccttcttccattgccgctagaggctatatcagcacacgggtgggaatgggcgaggccgccgctattttcatgaccgcgacaccccctgggtctgtggaagcctttccgcagagcaatgctgtcatccaggatgaggaacgcgacatccccgagagatcctggaactctggatacgagtggattacagatttccctggcaagaccgtttggtttgtgcccagcatcaaatccgggaatgacattgccaactgtcttcggaagaatggaaagcgcgtgatccagctgtctagaaaaacattcgataccgaatatcaaaagacgaaaaacaacgactgggactacgtcgtgacaaccgatattagcgagatgggcgccaatttccgggctgacagagttatcgatcctcgccggtgcctgaagcccgtgattctcaaagacgggccggaaagagtcatcctggccggccctatgcccgtgacagttgcgtccgctgcccagcgccggggaagagtgggccgcaaccataataaggagggggatcagtacatctatatgggacagccccttaacaatgacgaggatcacgcccactggaccgaagctaagatgctgctcgacaacattaatacgcctgagggcatcattcccgccctgtttgaacctgagcgggaaaagagcgcggccatcgatggggagtacagactgcgcggagaggctagaaagaccttcgtcgagctcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatttggacaaaggagggagaacgcaaaaagctccggcccagatggctggacgctcgcacctattccgaccctcttgccctgcgggagtttaaagagttcgctgccggcagacgctctgtgagcggggatctcatcctggagatcggaaagctgccccagcatctcacacagcgggcgcaaaatgcccttgacaacctggtgatgctgcacaattccgaacagggcgggagagcttaccggcatgccatggaggagctccctgataccattgaaacactgatgcttctggctctcatcgccgtcctgaccggaggcgttacgctgtttttcctctctggccgcgggcttggaaagacaagcattggcctgctgtgtgtgatggcctccagcgtgctcctgtggatggcttctgtcgagccccactggatcgcggcctccattatccttgaatttttcctgatggtgctcctgatcccggagcctgacagacagcggacaccccaggataaccaactggcttatgttgtgattgggctcctttttatgatcctgaccgtcgccgccaatgagatgggactgctcgaaacaaccaaaaaggacctgggcattgggcacgtggctgtcgagaaccatcaccatgccgcgatgcttgatgtggacctgcaccctgccagcgcttggacactctacgccgttgctacgaccatcattacacccatgatgcgccataccatcgaaaacacaaccgccaatatttctctgacggcgatcgccaaccaggctgccatcctgatgggactcgataaaggctggcctatttccaagatggacatcggcgtgccccttctggctctggggtgctacagccaggtcaatccgctcaccctgacagccgctgtgcttatgctggttgcccactatgcgattatcggacctggcctccaagccaaagctaccagagaggcccagaagcggacagctgccgggattatgaagaaccccaccgtggatggaatcgtcgccatcgacctggatcccgtggtgtacgacgcgaaattcgaaaagcagctgggccagattatgctccttatcctgtgtacgtctcaaattctgctcatgcgcacaacctgggctctgtgcgagagcatcacacttgccaccgggcctctgaccacactctgggagggatccccgggcaaattttggaatacgaccattgctgtttctatggccaacatcttcagaggcagctatctggccggggctggactggccttctccctcatgaaaagccttggcgggggacggcgcggcacaggggcgcagggagaaaccctgggcgagaaatggaagagacagctgaatcagctctccaagtctgaatttaacacatacaaacggagcggcatcatggaggtcgacagatccgaagccaaggaggggctgaaacgcggagagaccacgaagcacgctgtgtctcggggcacagccaaacttagatggttcgtggaacgcaatctggtcaagcccgaggggaaggttattgatctcggatgtggcagagggggatggagctattactgcgctggcctgaaaaaggtgaccgaagtgaaaggctataccaaagggggacctggccatgaggaacccatccctatggccacatacgggtggaacctggtcaaactccactccggaaaggacgtgtttttcattccccctgagaaatgtgatacccttctgtgcgacatcggcgagtctagcccgaatcccacaattgaagaggggagaacgctgcgcgttctcaagatggtggaaccttggctgcggggaaaccaattttgtatcaagattcttaatccctacatgccttccgtcgtggagaccctggagcagatgcagagaaaacatggcggcatgctcgttcgcaaccccctgagcagaaattctacacacgaaatgtattgggtgtcctgcgggaccggaaacatcgtcagcgcggtgaatatgacatctagaatgctgctcaaccgcttcaccatggcccaccggaagccgacgtacgagagagatgtggacctgggcgctgggacccgccatgtcgccgttgaacctgaggtggctaaccttgatatcattggacagagaatcgaaaatattaaacacgagcataagtccacatggcactatgacgaggataacccctacaaaacctgggcctatcatggcagctacgaagtgaagccctctgggtccgctagctccatggtcaatggagtggttaagctgctcacaaaaccttgggacgtgatccccatggtcacccaaattgccatgacagataccacgccttttggccagcagcgggtgttcaaggagaaagttgacacacgcaccccgaaggcgaaaagaggcaccacacaaatcatggaagtgacggcccggtggctgtgggggtttcttagcagaaacaagaagccccggatctgtacccgcgaggagttcacaagaaaagtccggtctaatgctgccattggagctgtgtttgttgacgagaaccagtggaatagcgccaaggaggccgtggaagatgagcgcttctgggacctggtccacagagaacgggagctccacaaacagggcaagtgcgcgacctgcgtgtataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgtcgagggggagggactgcacaaactcggctacattctgagagacatctctaagattcctgggggaaatatgtatgccgatgacacagctggctgggatacccggatcacagaagacgatcttcagaacgaggccaaaatcaccgacattatggaacccgagcatgcgctgctcgccaaggctatctttaaactgacgtaccaaaataaggtggttcgcgtgcagagacctgccaagaacgggaccgtcatggatgtgattagccggcgcgaccagagaggctccggacaggtgggcacatatgggctgaataccttcacaaacatggaagctcaactcatccggcagatggagtctgagggaatttttagcccctccgaactggagaccccgaaccttgccgaaagagttctggattggctcgagaaatacggcgtggaacgcctgaagcggatggcgatcagcggggacgactgtgtcgtgaaacctatcgatgacagattcgccacggctcttacagccctgaatgatatgggaaaggttcgcaaagacattccccagtgggagccttctaagggctggaacgattggcagcaagtgcccttttgctcccaccacttccatcagctcatcatgaaggacgggcgggagattgtcgtgccttgtagaaatcaggatgaactggtcggccgcgctcgggtgagccagggagccggctggtctctgagagagaccgcttgcctcgggaaatcctatgcccaaatgtggcagctgatgtactttcaccgccgggaccttagactggcggccaacgctatctgtagcgccgttcccgtggattgggtcccgacatcccgcaccacgtggtctattcatgcccaccatcagtggatgaccacagaagacatgctcagcgtgtggaatcgggtttggatcgaggaaaacccttggatggaggataagacccacatttccagctgggaggacgtgccctatctgggaaaaagagaagaccaatggtgcggctctcttatcgggctgacagctcgggccacctgggcgacaaatatccaggtcgctattaaccaggtgagacgcctcatcggaaatgagaactacctggattacatgacctccatgaagcggttcaaaaatgaaagcgaccccgagggcgccctgtggtga

SEQ ID NO: 19421 - RNA, 9879 nt, synthetic construct
  misc_feature 1..9879: note = derived and/or modified CDS sequence (opt5) from DENV-1__KC762620__SS-prME
  source 1..9879: mol_type = other RNA
agcgtgacaatgctgttcatgctcctgcccacagcccttgcttttcacctgacgaccagaggcggggaacctcatatgatcgtgtccaagcaggaacggggaaagtctctcctgttcaagacaagcgccggcgttaacatgtgcacccttattgcgatggacctgggggagctctgtgaagatacaatgacctacaagtgcccccgcatcacagagaccgaacccgacgatgtggactgttggtgcaatgctacggagacctgggtgacatatggaacctgttcccaaacaggcgagcacagacgggataagcgctctgttgccctggcccctcatgtggggctgggactcgaaaccagaacggagacatggatgagctccgaaggcgcttggaaacagattcagaaggttgagacctgggccctgcggcaccccggctttacagtgatcgctcttttcctggcccatgcgattgggacctctatcacccagaagggaatcatttttatcctcctgatgcttgtcacacctagcatggccatgcgctgcgtgggcattgggaacagagacttcgttgagggactgtccggcgctacgtgggtggatgtcgtgctcgaacacgggagctgtgtgaccacaatggccaaagacaagcccaccctggatatcgagctgctcaaaacagaagtcaccaatcctgctgttctgcggaaactttgcattgaggccaaaatctctaacacgacaaccgactcccgctgtccgacccaaggagaagcgacactggtggaggagcaggataccaattttgtgtgcagacggacattcgtcgaccgcggctggggcaacgggtgtggactctttggcaaggggagcctgattacgtgcgccaagttcaaatgcgtgaccaaacttgaaggaaaaatcgttcagtacgagaatctgaagtattctgtgatcgtcacagtgcacaccggcgatcagcatcaagttgggaacgaaacaattgagcacggaaccacggctaccatcacaccccaggcccctacctccgaaattcagctcacagactacggcgctctgaccctggactgtagccccagaacgggcctcgattttaatgagatggtgctgcttacaatgaaagagaagtcttggctggtccataaacagtggttcctcgacctgcctcttccctggacctccggggccagcacatcccaagaaacctggaaccggcaggatctgctcgtgacctttaagacagcccacgctaagaaacaggaggtcgtggttctgggatctcaagaaggcgcgatgcacacggccctgaccggggctacagagatccagaccagcggaacaaccacgattttcgccggccatctcaagtgccgcctgaaaatggacaaacttacactgaaaggggtgtcctatgtcatgtgtaccggcagcttcaagctcgaaaaggaggtggccgagacccagcacggaacagttctggtgcaggtcaaatacgaaggcaccgatgctccgtgcaagatccctttttcttcccaagacgagagaggggtgatccagaatggacggctgattacagccaaccccatcgtgacggataaagaaaagcctgttaatattgaggcggagccgcccttcggcgaaagctatatcgtcgtgggggctggagagaaagcccttaagctctcttggtttaagaaaggcagctccattgggaagatgttcgaagccaccgctagaggcgcccgccggatggctatcctgggagacacagcctgggattttggctctatcgggggagtgttcaccagcgtcggcaaactggtgcatcagatttttgggacagcgtacggagttctcttctccggcgtgagctggaccatgaagatcgggattggcatcctgcttacgtggctgggactcaactctagaaatacctccctgagcatgacatgtattgccgtcggcatggtgaccctgtaccttggggttatggtgcaggctgactctggatgcgtcatcaactggaaaggccgcgagctcaagtgtgggtccggaatttttgtgacaaacgaagttcacacctggacagagcaatataagttccaggccgatagccctaaacggctgtccgctgccatcggcaaggcgtgggaggaaggggtgtgcggcatcagatctgccacccgcctggagaatattatgtggaaacagatcagcaacgaactcaatcatattctgcttgagaacgacatgaagtttacggtcgtggtgggagacgtctccggcatcctggctcaggggaaaaagatgattcggccgcaacccatggaacacaaatactcttggaaaagctggggaaaggccaaaatcatcggcgctgatgttcagaatacaaccttcattatcgacgggcctaacacccccgagtgtcctgataatcagagagcctggaacatttgggaggtggaagactatggatttggcgtgttcacaaccaatatctggctcaagctgcgcgattcctacacgcaggtctgcgaccaccggctgatgagcgccgctattaaagattctaaggcggtgcatgccgacatgggctattggatcgagtccgagaagaatgagacatggaaacttgaaagagctagcttcatcgaggttaagacctgtatttggccccgctctcacacactctggtccaatggggtgctggagagcgaaatgatcattccgaaaacctacggaggccctgtctctcaacataactatcggcccgggtactttacacagaccgccggaccttggcacctgggcaagctcgagctggatttcgacctttgcgaagggacgaccgtggttgtggatgagaattgcggaaacagaggccccagcctgcggacaaccacagtcaccggcaaaatcattcacgagtggtgttgccgctcctgtacgctccctcccctgagatttaagggggaagacggatgctggtacggcatggagatccggccggtgaaagaaaaggaggaaaatctggttaagagcatggtgtctgccgggtccggagaggtcgatagcttctcccttggcctcctgtgtatctctattatgatcgaggaagtgatgagaagccgctggtccgggaaaatgctgatgacaggaaccctcgctgtgtttctgcttctgacaatgggccagctcacctggaacgacctgattcggctgtgcatcatggtcggcgccaacgcgtctgacatgatggggatgggaaccacatatcttgctctgatggccacgttcagaatgcgccctatgtttgccgttggcctcctgttcagacggctcaccagccgcgaggtgctgcttctgacagtggggctctccctggctgcctctgtcgaactgcccaatagccttgaggaactgggagatggcctcgcgatggggattatgatgctgaagctcctgaccgactttcaatcccatcagctttgggctacactgctcagcctgaccttcgtgaaaacgacattttctctgcactacgcctggaagaccatggccatgatcctttccattgttagcctgttccccctctgtctgtctaccacatcccagaaaaccacatggctccctgtgctgcttggaagcctgggctgcaagccgctgacgatgctcctgatcaccgagaacaagatctggggcagacggtcttggcccattaatgaggggatcatggctattggaatcgtctccattcttctgagctccctcctgaaaaacgatgtgcctctcgccggccccctgatcgctgggggaatgcttatcgcctgttatgttattagcggctctagcgcggacctgtccctggaaaaggccgctgaggtgtcttgggaagatgaggccgaacatagcggggcttcccacaatatcctcgtcgaggtgcaggacgatggaacaatgaaaattaaggacgaggaacgcgatgacaccctgacaatccttctgaaagccaccctcctggccatttctggcgtctaccctatgagcatccccgctacgctctttgtgtggtatttctggcaaaagaaaaagcagagatccggcgttctgtgggataccccttctcccccggaggtggaacgggcggtccttgacgatgggatctaccgcattctgcagagaggactgctcggccggagccaggtgggggttggagtgttccaagagggcgtctttcatacaatgtggcacgtgacccgcggggccgtgctgatgtatcagggaaagagacttgagccttcctgggctagcgttaaaaaggacctgatctcttacggcggcgggtggcggttccagggatcctggaacacaggcgaagaggtccaggtgattgccgtggaacccgggaaaaatcctaagaacgtccaaaccacacccggaacgtttaaaaccagcgagggcgaagtgggggccatcgctctcgacttcaagccgggaacatctggctcccctattgttaatagagagggcaagatcgtggggctgtacggaaacggcgtcgtgaccaccagcgggacatatgtttccgccattgcgcaggctaaagcctctcaggagggacccctccctgaaatcgaggatgaagtgtttcgcaagcggaatctgacgatcatggaccttcaccccggcagcgggaaaaccagacgctacctgcccgccattctgcgggaggctatcaagagaaaactccgcacactggtccttgcccctacccgggtggttgcgtccgaaatggctgaggccctgaagggcatgccgattagatatcaaacaaccgccgtcaagagcgagcatacgggaaaagaaatcgtcgatctcatgtgccacgctacattcaccatgcgcctgctgtctcccgtgcgggtgcctaactacaatatgattatcatggacgaggcccattttaccgatcccgcttccatcgccgcgagaggctatattagcacacgggtcgggatgggagaagccgctgccatcttcatgaccgctacacctcccggctctgttgaggcctttcctcagagcaacgccgtgattcaggacgaagaaagagatatcccggagagatcctggaactctgggtacgactggattaccgatttccccggaaagacggtgtggtttgtccctagcatcaaatccggcaacgacatcgctaactgtctccggaagaatgggaaacgcgtggttcagctttctagaaagacattcgataccgaatatcaaaagaccaagaataatgactgggactacgtggtcaccacggatattagcgagatgggcgcgaacttccgggccgacagagtgatcgatccccgccggtgcctgaagcctgttattctgaaagacggacccgaaagagtgatcctcgctggcccgatgcctgtcaccgtggcctccgccgctcagcgccgggggagaattggacgcaatagcaacaaggagggcgatcagtacgtctatatggggcagcccctgaataacgacgaggatcacgcccattggacagaagcgaaaatgcttctggacaatatcaacacccccgagggaattatccctgctctctttgaacccgagcgggaaaagtctgccgccatcgatggcgagtacagactgcgcggggaggctagaaagacattcgtggaactgatgcggcgcggcgacctccctgtttggctttcctataaagtggccagcgagggatttcaatactccgatagacggtggtgcttcgacggcgaacgcaataaccaggtgctggaggaaaatatggatgtcgagatttggaccaaggagggggaacgcaagaagctgcggccgagatggctcgacgcgcgcacatattctgaccccctggcccttcgggagtttaaagagttcgctgccggaagacgcagcgtttccggcgatctgatcctcgagattgggaagctgcctcagcacctgacccagaaagctcaaaacgccctcgacaatcttgtgatgctgcacaactctgaacagggaggcaaggcttaccggcatgccatggaggagctgcccgatacgatcgaaacactcatgctgcttgcgctgattgccgtgctcaccggcggggtcaccctgtttttcctgagcggaagaggcctcgggaagacatccatcggacttctgtgtgtgatggctagctctgccctgctctggatggcttccgttgagcctcactggatcgccgccagcattatcctggaatttttccttatggtgctgctcattcccgagccggaccggcagcgcacccctcaggataaccaactggcttatgtcgtgatcggcctgctctttatgattcttacagtcgcggccaatgagatggggctgctggaaacgaccaaaaaggacctcggaatcggccatgctgccgccgagaaccaccaccatgctgccatgctggatgtggaccttcaccccgcgtctgcctggacactgtacgctgttgccaccacaatcattacccctatgatgagacatacgatcgaaaataccacagctaacatttccctcaccgccatcgcgaatcaggccgctattctgatgggcctggataaagggtggcccatcagcaagatggacattggagtgcctctccttgccctgggctgctactctcaggtcaaccccctgacactcaccgctgccgtgctgatgcttgttgctcactatgccatcatcgggccgggactgcaagcgaaagccacgcgggaggctcagaagcgcacagccgctggcattatgaagaatcctaccgtggatgggatcgtcgccattgacctcgatcccgtggtgtacgacgccaaattcgaaaagcagctgggacagatcatgctgctcattctttgtacaagccaaatcctgctgatgagaaccacctgggcgctctgcgagtccatcacactggctacgggcccccttaccacactgtgggagggctctcctgggaaattttggaacaccacaattgccgttagcatggctaatatcttccggggatcctatctcgccggcgccgggctggctttcagcctgatgaagtccctcggaggcgggcgcagaggaaccggcgcccagggcgaaacgcttggggagaaatggaagcggcagctgaaccagctgtctaagagcgaatttaatatttacaaacgctccggaatcatggaggtcgacagatctgaagcgaaggagggcctcaaaagaggggaaacaaccaagcatgccgtgagccggggaaccgctaaactgcgctggttcgtggaacggaaccttgtcaagccggagggcaaggttattgatctggggtgtggaagaggcggctggtcctattactgcgccgggctcaaaaaggtgacagaagtgaaaggatataccaagggcgggcccggacacgaggaacctgtccccatggctacatacggctggaatctggtgaaactgcactctgggaaggacgtctttttcacgcctcccgagaaatgtgataccctcctttgcgacatcggagagagctcccctaacccgacaatcgaagagggccgcaccctgcgggtgctgaagatggtcgaaccctggctcagaggcaatcaattttgtattaagatcctgaacccttacatgcccagcgtggttgagacacttgagcagatgcagcgcaaacatgggggaatgctggtgcggaatcctctctctagaaactccacccacgaaatgtattgggtcagctgcggcacggggaacattgtgtctgccgtgaatatgacctcccgcatgctgctgaaccggttcacaatggcgcatagaaagcccacctacgagaaagatgtcgacctcggagccggcacacgccacgttgctgtggaaccggaggtggccaatctggatatcattgggcagcggatcgaaaacattaagaatgagcacaaaagcacctggcattatgacgaggataacccttacaagacatgggcttatcacggatcttacgaagtcaagccctccggcagcgcctccagcatggtgaatggcgttgtgagacttctgaccaaaccctgggacgtcatccctatggtgacgcaaatcgctatgacagataccaccccctttgggcagcagcgcgttttcaaggagaaagtggacacaagaacgcctaaggccaaacggggaaccgcgcaaattatggaagtcacagccaagtggctctggggctttctgtctcgcaacaagaaaccgagaatctgtacccgggaggagttcacaagaaaggtgcggagcaatgctgccattggggctgtttttgtggacgagaaccagtggaactccgccaaagaggccgtcgaagatgagcgcttctgggaccttgtgcatagagaacgggagctgcacaagcagggaaaatgcgcgacctgcgtctataacatgatgggcaagcgcgaaaagaaactcggggagtttggcaaggctaaaggatctagagccatctggtacatgtggctgggcgcccggttcctggagttcgaagctctcgggtttatgaatgaggatcattggttcagccgcgaaaactccctgtctggagtggagggcgaggggcttcacaagctgggatacattctcagagacatcagcaaaatccccggcgggaatctgtatgccgatgacacagctggctgggatacccggattacggaagacgatcttcagaacgaggccaagatcaccgacattatggaacctgagcacgcgctgctcgccacatccatctttaaactgacctaccaaaacaaggttgtgcgcgtccagagacccgctaagaatggaacagtgatggatgtgatttctcggcgcgaccagagaggcagcgggcaggttggaacctatggcctgaacacgttcacaaatatggaagcccaactcatccggcagatggagtccgaggggatctttagcccttctgaactggagacccccaaccttgctaaacgcgtgctggattggctcgaaaagcatggaattgagagactgaaacggatggccatctccggcgacgactgtgtcgtgaagccgattgatgacagattcgcgacagcccttaccgctctgaatgatatggggaaagttcgcaaggacatccctcagtgggaacccagcaagggctggaacgattggcagcaagtgcctttttgctctcaccatttccaccagctcattatgaaagacggacgggagatcgtcgtgccctgtagaaatcaggatgagctgatcggccgcgcccgggtctcccagggggctggatggagcctgagagaaacggcctgcctcggcaagtcctacgctcaaatgtggcagctgatgtattttcaccgccgggaccttagactggccgcgaacgccatttgttctgctgtgcctgttgattgggtgcccaccagccgcacaacctggtccatccatgcccaccatcagtggatgacaaccgaggacatgctcagcgtctggaatcgggtgtggattgaagagaacccgtggatggaagataaaacacacgtttcttcctgggaggacgtgccttacctggggaagagagaggaccaatggtgcggaagccttatcggcctgaccgcccgcgctacgtgggcctctaatattcaggtcgcgatcaaccaggtgcggagactcattgggaatgaaaactatctggattacatgacaagcatgaaacggttcaagaatgagtccgaccccgaaggcgctctgtggtga

SEQ ID NO: 19422 - RNA, 9879 nt, synthetic construct
  misc_feature 1..9879: note = derived and/or modified CDS sequence (opt5) from DENV-1__KC762631__SS-prME
  source 1..9879: mol_type = other RNA
agcgtgaccatgctgcttatgctgatgcccacagcccttgctttccacctgacgaccagaggaggggagcctcatatgacagtgtccaagcaggaacggggaaaatctctcctgtttaagaccagcgccggcgttaacatgtgcacacttatcgcgatggacctgggggagctctgtgaagataccctgacatacaaatgcccccgcattaccgaggctgaacccgacgatgtggactgttggtgcaatgccacggatacctgggtgacatatggaacctgttcccaaacaggcgagcaccggcgggacaagcgctctgtcgccctggctcctcatgtggggctcggactggagaccagaacggaaacatggatgagctccgagggcgcctggaaacagatccagcgggttgaaacctgggctcttagacaccccggcttcacagtgattgccctgtttctcgcgcatgccatcgggacctctattacccagaagggaatcatcttcattctgcttatgctggtcacacctagcatggctatgagatgcgtgggcatcgggtcccgggattttgttgagggactcagcggcgccacgtgggtggacgtcgtgctggagcacgggtcttgtgtgaccacaatggctaaggataaacccaccctggacattgaactcctgaagacagaggtcaccaaccctgccgttcttcgcaaactgtgcatcgaagcgaagatttccaatacgacaaccgatagcagatgtccgacccaaggagaggccacactcgtggaagaacaggacgctaacttcgtgtgccggcgcacctttgtcgatagaggctggggcaatgggtgtggactgttcggcaaagggtctcttatcacatgcgccaagtttaagtgcgtgacgaaactggagggaaagattgttcagtacgaaaacctcaaatattccgtgatcgtcaccgtgcacacaggcgaccagcatcaagttgggaatgagagcaccgaacacggaacaaccgctacgatcacaccccaggcccctacaaccgagattcagctgacagactacggcgccctgaccctcgattgttctccccggacgggcctggacttcaacgaaatggtgcttctgacaatgaaggagaaatcctggctcgtccataagcagtggtttctggatcttcctctgccctggaccagcggggcttccacatctcaagagacctggaatcgccaggacctcctggtgaccttcaaaacagcgcacgccaagaagcaggaagtcgtggttctgggaagccaagagggcgctatgcacacggccctcaccggggccacagaaatccagacctccggaacaaccacgatttttgctggccatctgaaatgcagacttaagatggataaactgacactcaaggggatgagctatgtgatgtgtaccggctctttcaaactggagaaggaagtcgccgagacccagcacggaacagtgctggttcagatcaagtacgagggcaccgacgcgccgtgcaaaattcctttctccacacaagatgaaaagggggtgacgcagaacggacggcttatcaccgctaatcccatcgtcacagacaaagagaagcctgtgaacattgaagccgagccgccctttggcgagagctatatcgtgattggggccggagaaaaagctctcaagctgtcttggttcaagaaaggcagctccatcgggaagatgtttgaggccaccgctagaggcgcccgccggatggcgattctgggagatacagcctgggacttcggctctatcgggggagtttttaccagcgtcggcaaactcgtgcatcagatcttcgggacggcttacggagtgctgttttccggcgtcagctggaccatgaagattgggatcggcgtgcttctgacatggctcggactcaattctagatccaccagcctgtctatgacatgtattgccgttggccttgtgaccctctacctgggggtcatggtgcaggctgattccggatgcgttatcaactggaaaggccgcgaactgaagtgtgggagcggaattttcgtgacaaatgaggtccacacctggacggaacaatataagtttcaggccgactcccctaaacggctctctgcggccatcggcaaggcttgggaggagggggtgtgcggcattagaagcgccacacgcctggaaaacatcatgtggaaacagatctccaacgagcttaatcatattctgctcgaaaacgacatgaagttcaccgttgtggtcggagatgtggctggcatcctggcccaggggaaaaagatgattcggccgcaacccatggagcacaaatactcttggaaaagctggggaaaggccaagatcattggcgctgacgtgcagaataccacatttatcatcgatgggcctaacacccccgaatgtcctgacgatcagagagcgtggaatatttgggaggtcgaggactatggattcggcatctttacgacaaacatttggctgaaacttcgcgattcctacacccaggtttgcgaccaccggctcatgagcgccgctatcaaagattctaaggccgtgcatgccgacatgggctattggattgaatccgagaaaaatgaaacatggaagctggctagagccagcttcatcgaggtgaagacctgtatctggcccaaatctcacacactgtggtccaacggggtcctcgaaagcgagatgattatcccgaagatttacggaggccctatctctcaacataattatcgccccgggtacttcacccagacggcgggaccttggcacctgggcaaacttgagctggattttgacctctgcgaagggaccacagtggttgtggatgagcactgcggaaaccggggccccagcctgagaaccacaaccgtcacgggcaagattatccatgaatggtgttgccggtcctgtacactgcctccccttcgcttcagaggggaggacggatgctggtacggcatggagatccggccggtgaaagaaaaggaggaaaatctcgttaagagcatggtgtctgctgggtccggagaggtcgacagcttttccctgggcctgctctgtatttctatcatgattgaagaggtgatgagaagccgctggtcccggaaaatgctgatgaccgggacacttgccgttttctttctgctcatcatgggacagctgacctggaacgatctgattagactttgcatcatggtgggcgccaatgcttctgaccgcatgggcatggggaccacatatctggccctcatggcgacgttcaagatgagacctatgtttgctgtcggactgctgttccggcgcctgaccagcagagaggtgcttctgctcacaattggcctgtccctggtggcctctgtcgaacttcccaacagcctggaggaactcggggatggactggccatgggcatcatgatcctcaaactgcttaccgactttcaatcccaccagctgtgggctacactcctgagcctgaccttcattaagacgacattttctcttcattacgcctggaaaaccatggctatggttctgtccatcgtgagcctcttccccctgtgtctctctaccacatcccagaagaccacatggctgcctgtgcttctggggagcctgggatgcaagccgctcacgatgtttctgattgccgagaataaaatctggggccggaagtcttggccccttaacgaaggcattatggcggtcgggatcgtgtccatcctgctcagctccctgctcaaaaacgatgttcctctggccggaccccttattgctggcgggatgctgatcgcctgttatgtgattagcggatctagcgctgacctgtccctcgagaaggccgccgaggtctcttgggaagaggaagctgagcacagcggcgcgtcccataatatcctggtggaagttcaggatgacgggaccatgaaaattaaggatgaggagcgcgacgatacacttaccatcctgctcaaagccacactgctcgctgtgtctggagtctaccctctgagcatccccgccacccttttcgtgtggtatttctggcaaaagaagaaacagagatccggcgtcctgtgggacacgccttctcccccggaagtggagcgggccgttctggatgacggcatttaccgcatcatgcagagagggctcctgggacggagccaggtgggcgtcggggtgtttcaagaaaaccttttccacaccatgtggcacgttacacgcggagctgtgctgatgtatcagggcaagagactcgagccttcctgggccagcgtcaaaaaggacctgatttcttacgggggaggctggcggctccagggctcctggaataccggggaggaagtccaggtgatcgcggttgagcccggcaagaatcctaagaatgtccaaacagctcccggcacctttaagacaccggaaggggaggtgggagccattgccctggatttcaaacctggcacgagcgggtctcccatcgtgaacagagaaggaaagattgtcggcctttacggcaatggggtggttaccacatccggaacctatgtgagcgctatcgcccaggcgaaggcttcccaggagggccctctgcccgagatcgaagacgaggtctttcgcaagcggaacctgaccattatggatctccatcccgggtctggaaaaacaagacgctacctgcctgccatcgtgcgggaagccattaagagaaaacttcgcacgctgatcctcgctccgacccgggttgtggccagcgagatggctgaagccctgaaaggcatgcccattagatatcaaacaaccgcggtcaagtccgagcacacagggaaagagatcgtggacctgatgtgccatgccaccttcacgatgcgcctccttagccctgttcgggtgcccaattacaacatgatcattatggatgaagctcactttacagacccttcttccatcgccgctagaggctatattagcacccgggtcggaatgggcgaggccgccgctatcttcatgaccgcgacaccccctgggtctgtggaagcctttccgcagagcaatgctgtgattcaggatgaggaacgcgacatccccgagagatcctggaacctgggatacgagtggatcaccgatttccctggcaagacagtctggtttgttccctctattaaaagcgggaatgacatcgccaactgtctgcggaagaatggaaagcgcgtgattcagctctccagaaaaaccttcgatacggaatatcaaaagaccaagaacaacgactgggactacgtggtcaccacagatatctctgagatgggcgccaatttccgggctgacagagtgattgatcctcgccggtgcctgaagcccgttatccttaaagacgggccggaaagagtgattctggccggccctatgcccgtcaccgtggcgagcgctgcccagcgccggggaagagttggccgcaaccataataaggagggggatcagtacatctatatgggacagcccctcaacaatgacgaggatcacgcccactggacggaagctaagatgctgctggacaacatcaatacccctgagggcattatccccgccctctttgaacctgagcgggaaaaatccgcggccattgatggggagtacagacttcgcggagaggctagaaagacattcgtggaactgatgcggcgcggcgacctgccggtctggctcagctataaagtggcctctgaggggtttcaatactccgatagacggtggtgcttcgacggcgaacgcaacaatcaggtcctggaggaaaacatggatgtggagatctggaccaaggagggagaacgcaagaaacttcggcccagatggctggacgctcgcacatatagcgaccctctcgccctgcgggagtttaaagagttcgctgccggcagacgctccgtttctggggatctgattctcgagatcggaaaacttccccagcatctgacccagcgggcgcaaaatgccctggacaacctcgtgatgctgcacaatagcgaacagggcgggagagcttaccggcatgccatggaggagcttcctgaaacaatcgagaccctgatgctcctggctctgattgccgtgctcacgggaggcgtcacactctttttcctgtccggccgcgggctgggaaagacctctatcggcctcctgtgtgttatggccagctccgtgcttctgtggatggctagcgtggaaccccactggattgcggcctctatcattctcgagtttttcctgatggtcctgctcatcccggagcctgatagacagcggacaccccaggacaaccaacttgcttatgtggttatcgggctgctgtttatgattctcacagtggccgccaatgaaatgggactgcttgagaccaccaagaaggatctgggcatcgggcacgtcgctgtggaaaaccatcaccatgccgcgatgctcgacgtcgatctgcaccctgcctccgcttggacgctgtacgccgtggctaccacaattatcacccccatgatgcgccatacaattgagaacaccacggccaatatcagcctcaccgcgattgccaaccaggctgccatccttatgggactggacaaaggctggcctatctctaagatggatattggcgttcccctgctcgctctggggtgctactcccaggtgaatccgcttacactgaccgccgctgtcctcatgctggtggcccactatgcgatcattggacctggcctgcaagccaaagctacaagagaagcccagaagcggaccgctgccgggatcatgaagaaccccacggttgacggaattgtggccatcgatctcgaccccgtcgtgtacgatgcgaaattcgagaagcagcttggccagatcatgctgctgattctctgtacaagccaaatcctgcttatgcgcaccacatgggctctgtgcgagtctattaccctcgccaccgggcctctgacaacgctgtgggaaggaagcccgggcaaattttggaataccacaatcgctgtgtccatggccaacattttcagaggctcttatctcgccggggctggacttgccttcagcctgatgaagtccctgggcgggggacggcgcggcaccggggcgcagggagagacactcggcgaaaaatggaagagacagctgaatcagcttagcaagtccgagtttaacacctacaaacggtctggcatcatggaagttgacagaagcgaggccaaggaggggctgaaacgcggagaaacgacaaagcacgctgtctcccggggcaccgccaaactcagatggttcgtggagcgcaatctggtgaagcccgaagggaaggtcatcgacctgggatgtggcagagggggatggtcttattactgcgctggcctcaaaaaggttaccgaggtgaaaggctatacaaaagggggacctggccatgaggaacccattcctatggccacctacgggtggaaccttgtgaaactgcacagcggaaaggatgtctttttcattccccctgagaaatgtgacacactgctctgcgatatcggcgaatcctctccgaatcccacgatcgaggaagggagaaccctgcgcgtgcttaagatggttgagccttggctgcggggaaaccaattttgtattaagatcctcaatccctacatgcctagcgtggtcgagacactggaacagatgcagagaaaacatggcggcatgctggtgcgcaaccccctctcccggaatagcacccacgagatgtattgggtttcttgcgggacaggaaacattgtgtccgcggtcaatatgaccagcagaatgctgcttaaccgcttcacgatggcccaccggaagccgacctacgaaagagacgtggatctgggcgctgggacacgccatgtggccgtcgagcctgaagttgctaacctcgacatcatcggacagagaattgagaatatcaaacacgagcataagtctacctggcactatgatgaagacaacccctacaaaacatgggcctatcatggctcctacgaggtgaagcccagcgggtctgcttccagcatggtgaatggagtcgtgaagctgcttaccaaaccttgggatgttattcccatggtgacacaaatcgccatgaccgacacgacaccttttggccagcagcgggtcttcaaggaaaaagtggatacccgcaccccgaaggcgaaaagaggcacaacgcaaattatggaggttaccgcccggtggctgtgggggtttctctccagaaacaagaagccccggatctgtacacgcgaagagttcaccagaaaagtgcggagcaatgctgccatcggagctgtctttgtggacgagaaccagtggaactctgccaaggaagccgttgaggacgaacgcttctgggagctggtgcacagagaacgggagctgcacaaacagggcaagtgcgcgacatgcgtctataacatgatggggaaacgcgagaagaagctcggagaatttggcaaagctaaggggagcagagccatttggtacatgtggctgggcgcccggttccttgagttcgaagctctgggatttatgaatgaggatcattggttctcccgcgagaactctctcagcggcgtggaaggggagggactgcacaaacttggctacatcctgagagacatttccaagatccctgggggaaatatgtatgccgatgacaccgctggctgggatacacggattaccgaagacgatctccagaacgaggccaaaatcacggacatcatggaacccgagcatgcgctgctggccaaggctatttttaaactcacctaccaaaataaggtcgtgcgcgttcagagacctgccaagaacgggacagtgatggatgtcatctctcggcgcgaccagagaggcagcggacaggtgggcacctatgggctgaatacattcaccaacatggaggctcaacttattcggcagatggaatccgagggaatcttttctcccagcgaactggagacgccgaacctcgccgaaagagtgctggattggcttgagaaatacggcgttgagcgcctgaagcggatggcgatttccggggacgattgtgtggtcaaacctatcgacgacagattcgccacagctctcaccgccctgaatgatatgggaaaggtgcgcaaagacatcccccagtgggaacctagcaagggctggaacgattggcagcaagttcccttttgctctcaccacttccatcagctgattatgaaggacgggcgggagatcgtggtcccttgtagaaatcaggatgaactcgtgggccgcgctcgggtctcccagggagccggctggagcctgagagagacagcttgccttgggaaatcttatgcccaaatgtggcagctgatgtactttcaccgccgggacctcagactggcggccaacgctatttgttccgccgtgcccgttgattgggtgccgaccagccgcacgacctggtccatccatgcccaccatcagtggatgacaaccgaagacatgctttctgtctggaatcgggtgtggattgaggagaacccttggatggaagataagacacacatcagctcctgggaggacgttccctatctgggaaaaagagaagatcaatggtgcggcagcctcattgggctgaccgctcgggccacatgggcgaccaatatccaggtggctatcaaccaggtcagacgcctgattggaaatgagaactacctcgactacatgacgtctatgaagcggttcaaaaatgagtccgaccccgaaggcgccctgtggtga

SEQ ID NO: 19423 - RNA, 9879 nt, synthetic construct
  misc_feature 1..9879: note = derived and/or modified CDS sequence (opt5) from DENV-1__KC762621__SS-prME
  source 1..9879: mol_type = other RNA
agcgtgacaatgctgctcatgctgatgcccacagcccttgctttccacctgacgacccggggaggggaacctcatatgatcgtctccaagcaggaacggggaaaatctctcctgtttaagacaagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcgtgcatcagattttcgggaccgcttacggagtgctgttttccggcgtcagctggacgatgaagatcgggattggcgtgcttctgacctggctcggactcaattctagatccacaagcctgtctatgacctgtatcgccgttggccttgtgacactctacctgggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacgacatgaagttcacagttgtggtcggagatgtggctggcattctggcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaaacttcgcgattcctacacacaggtttgcgaccaccggctcatgagcgccgctattaaagattctaaggccgtgcatgccgacatgggctattggatcgaatccgagaaaaatgaaacctggaagctggctagagccagcttcatcgaggtgaagacatgtatttggcccaaatctcacaccctgtggtccaacggggtcctcgaaagcgagatgatcattccgaagatctacggaggccctacatctcaacataattatcgccccgggtacttcacccagacggcgggaccttggcacctgggcaaacttgagctggattttgacctctgcgaagggaccacagtggttgtggatgagcactgcggaaaccggggccccagcctgagaaccacaaccgtcacgggcaagattatccatgaatggtgttgccggtcctgtacactgcctccccttcgcttcagaggggaggacggatgctggtacggcatggagatccggccggtgaaagaaaaggaggaaaatctcgttaagagcatggtgtctgctgggtccggagaggtcgacagcttttccctgggcctgctctgtatttctatcatgattgaagaggtgatgagaagccgctggtcccggaaaatgctgatgaccgggacacttgccgttttctttctgctcatcatgggacagctgacctggaacgatctgattagactttgcatcatggtgggcgccaatgcttctgaccgcatgggcatggggaccacatatctggccctcatggcgacgttcaagatgagacctatgtttgctgtcggactgctgttccggcgcctgaccagcagagaggtgcttctgctcacaattggcctgtccctggtggcctctgtcgaacttcccaacagcctggaggaactcggggatggactggccatgggcatcatgatcctcaaactgcttaccgactttcaatcccaccagctgtgggctacactcctgagcctgaccttcattaagacgacattttctcttcattacgcctggaaaaccatggctatggttctgtccatcgtgagcctcttccccctgtgtctctctaccacatcccagaagaccacatggctgcctgtgcttctggggagcctgggatgcaagccgctcacgatgtttctgattgccgagaataaaatctggggccggaagtcttggccccttaacgaaggcattatggcggtcgggatcgtgtccatcctgctcagctccctgctcaaaaacgatgttcctctggccggaccccttattgctggcgggatgctgatcgcctgttatgtgattagcggatctagcgctgacctgtccctcgagaaggccgccgaggtctcttgggaagaggaagctgagcacagcggcgcgtcccataatatcctggtggaagttcaggatgacgggaccatgaaaattaaggatgaggagcgcgacgatacacttaccatcctgctcaaagccacactgctcgctgtgtctggagtctaccctctgagcatccccgccacccttttcgtgtggtatttctggcaaaagaagaaacagagatccggcgtcctgtgggacacgccttctcccccggaagtggagcgggccgttctggatgacggcatttaccgcatcatgcagagagggctcctgggacggagccaggtgggcgtcggggtgtttcaagaaaacgttttccacaccatgtggcacgtgacacgcggagctgtccttatgtatcagggcaagagactggagccttcctgggccagcgtgaaaaaggacctcatttcttacgggggaggctggcggctgcagggctcctggaataccggggaggaagtgcaggttatcgcggtcgagcccggcaagaaccctaagaatgtgcaaacagctcccggcacctttaagacaccggaaggggaggtgggagccattgccctcgatttcaaacctggcacgagcgggtctcccatcgtcaacagagaaggaaagattgtgggcctgtacggcaatggggttgtgaccacatccggaacctatgtcagcgctatcgcccaggcgaaggcttcccaggagggccctcttcccgagatcgaagacgaggtgtttcgcaagcggaacctgaccattatggatctgcatcccgggtctggaaaaacaagacgctacctccctgccatcgttcgggaagccattaagagaaagctgcgcacgcttatcctggctccgacccgggtggtcgccagcgagatggctgaagccctcaaaggcatgcccattagatatcaaacaaccgcggtgaagtccgagcacacagggaaagagatcgttgacctgatgtgccatgccaccttcacgatgcgcctgctcagccctgtgcgggtccccaattacaacatgatcattatggatgaagctcactttacagacccttcttccatcgccgctagaggctatattagcacccgggtgggaatgggcgaggccgccgctatcttcatgaccgcgacaccccctgggtctgtggaagcctttccgcagagcaatgctgtcattcaggatgaggaacgcgacatccccgagagatcctggaactctggatacgagtggatcaccgatttccctggcaagacagtttggtttgtgcccagcattaaatccgggaatgacatcgccaactgtcttcggaagaatggaaagcgcgtgattcagctgtctagaaaaaccttcgatacggaatatcaaaagaccaagaacaacgactgggactacgtcgtgaccacagatatcagcgagatgggcgccaatttccgggctgacagagttattgatcctcgccggtgcctgaagcccgtgatcctcaaagacgggccggaaagagtcattctggccggccctatgcccgtgaccgttgcgtccgctgcccagcgccggggaagagtgggccgcaaccataataaggagggggatcagtacatctatatgggacagccccttaacaatgacgaggatcacgcccactggacggaagctaagatgctgctcgacaacatcaatacccctgagggcattatccccgccctgtttgaacctgagcgggagaaaagcgcggccattgatggggagtacagactgcgcggagaggctagaaagacattcgtcgaactcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatctggaccaaggagggagaacgcaaaaagctccggcccagatggctggacgctcgcacatattccgaccctcttgccctgcgggagtttaaagagttcgctgccggcagacgctctgtgagcggggatctcattctggagatcggaaagctgccccagcatctcacccagcgggcgcaaaatgcccttgacaacctggtgatgctgcacaattccgaacagggcgggagagcttaccggcatgccatggaggagctccctgatacaatcgaaaccctgatgcttctggctctcattgccgtcctgacgggaggcgttacactgtttttcctctctggccgcgggcttggaaagaccagcatcggcctgctgtgtgtgatggcctccagcgtgctcctgtggatggcttctgtcgagccccactggattgcggcctccatcattcttgaatttttcctgatggtgctcctgatcccggagcctgacagacagcggacaccccaggataaccaactggcttatgttgtgatcgggctcctttttatgattctgacagtcgccgccaatgagatgggactgctcgaaaccaccaaaaaggacctgggcatcgggtacgtggctgtcgagaaccaccatcacgccgcgatgcttgatgtggacctgcatcctgccagcgcttggacgctctacgccgttgctaccacaattatcacccccatgatgcgccacacaattgaaaacaccacggccaatatctctctgaccgcgattgccaaccaggctgccatcctgatgggactcgataaaggctggcctatctccaagatggacattggcgtgccccttctggctctggggtgctatagccaggtcaatccgctcacactgaccgccgctgtgcttatgctggttgcccattacgcgatcattggacctggcctccaagccaaagctacaagagaggcccagaagcggaccgctgccgggatcatgaagaaccccacggtggatggaattgtcgccatcgacctggatcccgtggtgtatgacgcgaaattcgaaaagcagctgggccagatcatgctccttattctgtgtacatctcaaatcctgctcatgcgcaccacatgggctctgtgcgagagcattacccttgccaccgggcctctgacaacgctctgggagggatccccgggcaaattttggaataccacaatcgctgtttctatggccaacattttcagaggcagctacctggccggggctggactggccttctccctcatgaaaagccttggcgggggacggcgcggcaccggggcgcagggagaaacactgggcgagaaatggaagagacagctgaatcagctctccaagtctgaatttaacacctataaacggagcggcatcatggaggtcgacagatccgaagccaaggaggggctgaaacgcggagagacgacaaagcacgctgtgtctcggggcaccgccaaacttagatggttcgtggaacgcaatctggtcaagcccgaggggaaggttatcgatctcggatgtggcagagggggatggagctactattgcgctggcctgaaaaaggtgaccgaagtgaaaggctacacaaaagggggacctggccacgaggaacccattcctatggccacctacgggtggaacctggtcaaactccattccggaaaggacgtgtttttcattccccctgagaaatgtgatacacttctgtgcgacatcggcgagtctagcccgaatcccacgatcgaagaggggagaaccctgcgcgttctcaagatggtggaaccttggctgcggggaaaccaattttgtattaagatccttaatccctatatgccttccgtcgtggagacactggagcagatgcagagaaaacacggcggcatgctcgttcgcaaccccctgagcagaaattctacccatgaaatgtactgggtgtcctgcgggacaggaaacattgtcagcgcggtgaatatgacctctagaatgctgctcaaccgcttcacgatggcccaccggaagccgacctatgagagagatgtggacctgggcgctgggacacgccacgtcgccgttgaacctgaggtggctaaccttgatatcatcggacagagaattgaaaatatcaaacatgagcacaagtccacctggcattacgacgaggataacccctataaaacatgggcctaccacggcagctatgaagtgaagccctctgggtccgctagctccatggtcaatggagtggttaagctgctcaccaaaccttgggacgtgattcccatggtcacacaaatcgccatgaccgatacgacaccttttggccagcagcgggtgttcaaggagaaagttgacacccgcaccccgaaggcgaaaagaggcacaacgcaaattatggaagtgaccgcccggtggctgtgggggtttcttagcagaaacaagaagccccggatctgtacacgcgaggagttcaccagaaaagtccggtctaatgctgccatcggagctgtgtttgttgacgagaaccagtggaatagcgccaaggaggccgtggaagatgagcgcttctgggacctggtccatagagaacgggagctccacaaacagggcaagtgcgcgacatgcgtgtacaacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtcgagggggagggactgcataaactcggctatatcctgagagacatttctaagatccctgggggaaatatgtacgccgatgacaccgctggctgggatacacggattaccgaagacgatcttcagaacgaggccaaaatcacggacatcatggaacccgagcacgcgctgctcgccaaggctatttttaaactgacctatcaaaataaggtggttcgcgtgcagagacctgccaagaacgggacagtcatggatgtgatcagccggcgcgaccagagaggctccggacaggtgggcacctacgggctgaatacattcaccaacatggaagctcaactcattcggcagatggagtctgagggaatctttagcccctccgaactggagacgccgaaccttgccgaaagagttctggattggctcgagaaatatggcgtggaacgcctgaagcggatggcgattagcggggacgactgtgtcgtgaaacctatcgatgacagattcgccacagctcttaccgccctgaatgatatgggaaaggttcgcaaagacatcccccagtgggagccttctaagggctggaacgattggcagcaagtgcccttttgctcccatcacttccaccagctcattatgaaggacgggcgggagatcgtcgtgccttgtagaaatcaggatgaactggtcggccgcgctcgggtgagccagggagccggctggtctctgagagagacagcttgcctcgggaaatcctacgcccaaatgtggcagctgatgtattttcatcgccgggaccttagactggcggccaacgctatttgtagcgccgttcccgtggattgggtcccgacctcccgcacgacctggtctatccacgcccatcaccagtggatgacaaccgaagacatgctcagcgtgtggaatcgggtttggattgaggaaaacccttggatggaggataagacacatgtgtccagctgggaggacgtcccctacctgggaaaaagagaagaccaatggtgcggctctcttatcgggctgaccgctcgggccacatgggcgaccaatattcaggtggctatcaaccaggtgagacgcctcatcggaaatgagaactacctggattatatgacgtccatgaagcggttcaaaaatgaaagcgaccccgagggcgccctgtggtga

SEQ ID NO: 19424 - RNA, 9879 nt, synthetic construct
  misc_feature 1..9879: note = derived and/or modified CDS sequence (opt5) from DENV-1__KC762643__SS-prME
  source 1..9879: mol_type = other RNA
agcgtgaccatgctgctgatgctgatgcccacagcccttgctttccacctgacgacccggggaggggaacctcatatgatcgtctccaagcaggaacggggaaaatctctcctgtttaagacaagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgttgccctggctcctcatgtggggctcggactggagacaagaaccgaaacgtggatgagctccgagggcgcctggaaacagattcagcgggttgaaacatgggctcttagacaccccggcttcaccgtgatggccctgtttctcgcgcatgccatcgggacatctattacccagaagggaatcatcttcattctgcttatgctggtcacccctagcatggctatgagatgcgtgggcatcgggtcccgggattttgttgagggactcagcggcgccacatgggtggacgtcgtgctggagcacgggtcttgtgtgacgaccatggctaaggataaacccacactggacattgaactcctgaagaccgaggtcacaaaccctgccgttcttcgcaaactgtgcatcgaagcgaagatttccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttatcacatgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagccgccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagttctcacaagcgtcggcaaactggtgcatcagatctttgggaccgcttacggagtgcttttctccggcgtcagctggacgatgaagattgggatcggcgtgctgctcacctggctgggactcaattctagatccacaagcctttctatgacctgtattgccgttggcctcgtgacactgtacctgggggtcatggtgcaggctgattccggatgcgttatcaactggaaaggccgcgaactcaagtgtgggagcggaatttttgtgaccaatgaggtccacacatggaccgaacaatataagttccaggccgactcccctaaacggctgtctgcggccatcggcaaggcttgggaggagggggtgtgcggcattagaagcgccacgcgccttgaaaacatcatgtggaaacagatctccaacgagctgaatcatattctcctggaaaacgacatgaagtttacagttgtggtcggagatgtggctggcatcctggcccaggggaaaaagatgattcggccgcaacccatggagcacaaatactcttggaaaagctggggaaaggccaagatcattggcgctgacgtgcagaataccaccttcatcatcgatgggcctaacacacccgaatgtcctgacgatcagagagcgtggaatatttgggaggtcgaggactatggatttggcatcttcaccacgaacatttggcttaagctccgcgattcctacacacaggtttgcgaccaccggctgatgagcgccgctatcaaagattctaaggccgtgcatgccgacatgggctattggattgaatccgagaaaaatgaaacctggaagctggctagagccagctttatcgaggtgaagacatgtatctggcccaaatctcacaccctctggtccaacggggtcctggaaagcgagatgattatcccgaagatttacggaggccctacatctcaacataattatcgccccgggtacttcacccagacggcgggaccttggcaccttggcaaactggagctcgatttcgacctgtgcgaagggaccacagtggttgtggatgagcactgcggaaaccggggccccagcctgagaaccacaaccgtcacgggcaagatcattcatgaatggtgttgccggtcctgtacacttcctcccctccgctttagaggggaggacggatgctggtacggcatggagatccggccggtgaaagaaaaggaggaaaatctggttaagagcatggtgtctgctgggtccggagaggtcgacagcttctccctgggcctcctgtgtatctctattatgatcgaagaggtgatgagaagccgctggtcccggaaaatgcttatgaccgggacactggccgtctttttcctcctgattatgggacagctgacctggaacgatcttatcagactgtgcattatggtgggcgccaatgcttctgaccgcatgggcatggggaccacatatctcgccctgatggcgacgtttaagatgagacctatgttcgctgtcggactcctgtttcggcgccttaccagcagagaggtgctgctcctgacaatcggcctgtcccttgtggcctctgtcgaactgcccaacagcctcgaggaactgggggatggactcgccatgggcattatgatcctgaaacttctgaccgacttccaatcccaccagctctgggctacactgctgagccttacctttatcaagacgacattctctctgcattacgcctggaaaaccatggctatggttctctccattgtgagcctgtttcccctctgtctgtctaccacatcccagaagaccacatggcttcctgtgctgctggggagcctcggatgcaagccgctgacgatgttccttatcgccgagaataaaatttggggccggaagtcttggcccctgaacgaaggcatcatggcggtcgggattgtgtccatcctcctgagctccctcctgaaaaacgatgttcctcttgccggacccctgatcgctggcgggatgctgattgcctgttatgtgatcagcggatctagcgctgacctctccctggagaaggccgccgaggtctcttgggaagaggaagctgagcacagcggcgcgtcccataatattcttgtggaagttcaggatgacgggaccatgaaaatcaaggatgaggagcgcgacgatacactgaccattctcctgaaagccacactcctggctgtgtctggagtctaccctcttagcatccccgccaccctgtttgtgtggtatttctggcaaaagaagaaacagagatccggcgtcctgtgggacacgccttctcccccggaagtggagcgggccgttctcgatgacggcatctaccgcattatgcagagagggctgcttggacggagccaggtgggcgtcggggtgttccaagaaaacgtttttcacaccatgtggcacgtgacacgcggagctgtcctgatgtatcagggcaagagactcgagccttcctgggccagcgtgaaaaaggacctgatctcttacgggggaggctggcggctccagggctcctggaataccggggaggaagtgcaggttattgcggtcgagcccggcaagaaccctaagaatgtgcaaacagctcccggcaccttcaagacaccggaaggggaggtgggagccatcgccctggattttaaacctggcacgagcgggtctcccattgtcaacagagaaggaaagatcgtgggcctttacggcaatggggttgtgaccacatccggaacctatgtcagcgctattgcccaggcgaaggcttcccaggagggccctctgcccgagatcgaagacgaggtgttccgcaagcggaacctgaccatcatggatctccatcccgggtctggaaaaacaagacgctacctgcctgccattgttcgggaagccatcaagagaaaacttcgcacgctgattctcgctccgacccgggtggtcgccagcgagatggctgaagccctgaaaggcatgcccatcagatatcaaacaaccgcggtgaagtccgagcacacagggaaagagattgttgacctgatgtgccatgccacctttacgatgcgcctccttagccctgtgcgggtccccaattacaacatgatcatcatggatgaagctcacttcacagacccttcttccattgccgctagaggctatatcagcacccgggtgggaatgggcgaggccgccgctatttttatgaccgcgacaccccctgggtctgtggaagccttcccgcagagcaatgctgtcatccaggatgaggaacgcgacattcccgagagatcctggaactctggatacgagtggatcaccgattttcctggcaagacagtttggttcgtgcccagcatcaaatccgggaatgacattgccaactgtctgcggaagaatggaaagcgcgtgatccagctgtctagaaaaacctttgatacggaatatcaaaagaccaagaacaacgactgggactacgtcgtgaccacagatattagcgagatgggcgccaatttccgggctgacagagttatcgatcctcgccggtgcctcaagcccgtgattctgaaagacgggccggaaagagtcatccttgccggccctatgcccgtgaccgttgcgtccgctgcccagcgccggggaagagtgggccgcaaccataataaggagggggatcagtacatttatatgggacagcccctgaacaatgacgaggatcacgcccactggacggaagctaagatgctcctggacaacatcaatacccctgagggcatcattcccgccctgttcgaacctgagcgggagaaaagcgcggccatcgatggggagtacagactccgcggagaggctagaaagacatttgtcgaacttatgcggcgcggcgacctgccggtgtggctgtcttataaagtcgcctccgaggggttccaatacagcgatagacggtggtgctttgacggcgaacgcaacaatcaggtgctcgaggaaaacatggatgttgagatttggaccaaggagggagaacgcaaaaagctgcggcccagatggcttgacgctcgcacatattccgaccctctggccctccgggagttcaaagaatttgctgccggcagacgctctgtgagcggggatctgatcctggagattggaaagctcccccagcatcttacccagcgggcgcaaaatgccctggacaacctggtgatgctccacaattccgaacagggcgggagagcttaccggcatgccatggaggagctgcctgatacaatcgaaacccttatgctgctcgctctgatcgccgtcctgacgggaggcgttacactcttctttctttctggccgcgggctgggaaagaccagcattggcctgctctgtgtgatggcctccagcgtgctgctttggatggcttctgtcgagccccactggatcgcggcctccattatcctggagttctttctcatggtgctgctgattccggagcctgacagacagcggacaccccaggataaccaactcgcttatgttgtgatcgggcttctgttcatgatcctgacagtcgccgccaatgagatgggactcctggaaaccaccaaaaaggaccttggcattgggcacgtggctgtcgagaaccatcaccatgccgcgatgctggatgtggacctccaccctgccagcgcttggacgctgtacgccgttgctaccacaatcattacccccatgatgcgccatacaatcgaaaacaccacggccaatatttctctgaccgcgatcgccaaccaggctgccattctcatgggacttgataaaggctggcctatctccaagatggacatcggcgtgcccctgctggctctcgggtgctacagccaggtcaatccgctgacacttaccgccgctgtgctgatgctcgttgcccactatgcgattatcggacctggcctgcaagccaaagctacaagagaggcccagaagcggaccgctgccgggattatgaagaaccccacggtggatggaatcgtcgccattgacctggatcccgtggtgtacgacgcgaaatttgaaaagcagctcggccagatcatgcttctgatcctgtgtacatctcaaattctcctgatgcgcaccacatgggctctttgcgagagcatcaccctggccaccgggcctctcacaacgctgtgggagggatccccgggcaaattctggaataccacaattgctgtttctatggccaacatctttagaggcagctatctggccggggctggactcgccttctcccttatgaaaagcctgggcgggggacggcgcggcaccggggcgcagggagaaacactgggcgagaaatggaagagacagctcaatcagctgtccaagtctgagttcaacacctacaaacggagcggcattatggaggtcgacagatccgaagccaaggaggggcttaaacgcggagagacgacaaagcacgctgtgtctcggggcaccgccaaactgagatggtttgtggaacgcaatctcgtcaagcccgaggggaaggttatcgatctgggatgtggcagagggggatggagctattactgcgctggcctgaaaaaggtgaccgaagtgaaaggctatacaaaagggggacctggccatgaggaacccatccctatggccacctacgggtggaacctcgtcaaacttcactccggaaaggacgtgttctttattccccctgagaaatgtgatacactgctgtgcgacatcggcgagtctagcccgaatcccacgattgaagaggggagaaccctccgcgttctgaagatggtggaaccttggcttcggggaaaccaattctgtatcaagattctgaatccctacatgccttccgtcgtggagacactcgagcagatgcagagaaaacatggcggcatgctggttcgcaaccccctgagcagaaattctacccacgaaatgtattgggtgtcctgcgggacaggaaacatcgtcagcgcggtgaatatgacctctagaatgctcctgaaccgctttacgatggcccaccggaagccgacctacgagagagatgtggaccttggcgctgggacacgccatgtcgccgttgaacctgaggtggctaacctggatattatcggacagagaatcgaaaatattaaacacgagcataagtccacctggcactatgacgaggataacccctacaaaacatgggcctatcatggcagctacgaagtgaagccctctgggtccgctagctccatggtcaatggagtggttaagctcctgaccaaaccttgggacgtgatccccatggtcacacaaattgccatgaccgatacgacacctttcggccagcagcgggtgtttaaggagaaagttgacacccgcaccccgaaggcgaaaagaggcacaacgcaaatcatggaagtgaccgcccggtggctttgggggttcctgagcagaaacaagaagccccggatttgtacacgcgaggaatttatcagaaaagtccggtctaatgctgccatcggagctgtgttcgttgacgagaaccagtggaatagcgccaaggaggccgtggaagatgagcgcttttgggacctcgtccacagagaacgggagctgcacaaacagggcaagtgcgcgacctgcgtgtataacatgatggggaaacgcgaaaagaagctgggagagttcggcaaagctaaggggtccagagccatttggtacatgtggctcggcgcccggtttctggagttcgaagctcttggattcatgaatgaggatcattggttttctcgcgaaaacagcctgtccggcgtcgagggggagggactccacaaactgggctacatccttagagacatttctaagatccctgggggaaatatgtatgccgatgacacagctggctgggatacccggattacagaagacgatctgcagaacgaggccaaaatcaccgacatcatggaacccgagcatgcgctcctggccaaggctattttcaaactgacgtaccaaaataaggtggttcgcgtgcagagacctgccaagaacgggaccgtcatggatgtgatcagccggcgcgaccagagaggctccggacaggtgggcacatatgggctcaatacctttacaaacatggaagctcaactgattcggcagatggagtctgagggaatcttcagcccctccgaacttgagaccccgaacctggccgaaagagttctcgattggctggagaaatacggcgtggaacgccttaagcggatggcgattagcggggacgactgtgtcgtgaaacctatcgatgacagatttgccacggctctgacagccctcaatgatatgggaaaggttcgcaaagacatcccccagtgggagccttctaagggctggaacgattggcagcaagtgcccttctgctcccaccactttcatcagctgattatgaaggacgggcgggagatcgtcgtgccttgtagaaatcaggatgaactggtcggccgcgctcgggtgagccagggagccggctggtctctcagagagaccgcttgcctggggaaatcctatgcccaaatgtggcagcttatgtacttccaccgccgggacctgagactcgcggccaacgctatttgtagcgccgttcccgtggattgggtcccgacatcccgcaccacgtggtctatccatgcccaccatcagtggatgaccacagaagacatgctgagcgtgtggaatcgggtttggattgaggaaaacccttggatggaggataaggctcacgtgtccagctgggaggacgtcccctatcttggaaaaagagaagaccaatggtgcggctctctgatcgggctcaccgcccgggcgacatgggctaccaatattcaggtggccatcaaccaggtgagacgcctgatcggaaatgagaactacctggattacatgacatccatgaagcggtttaaaaatgaaagcgaccccgagggcgccctctggtga

SEQ ID NO: 19425 - RNA, 9879 nt, synthetic construct
  misc_feature 1..9879: note = derived and/or modified CDS sequence (opt5) from DENV-1__KC762651__SS-prME
  source 1..9879: mol_type = other RNA
agcgtgaccatgctgttcatgctcctgcccaccgcccttgcttttcacctgacgaccagaggcggggaacctcatatgatcgtgtccaagcaggaacgggggaagtctctcctgttcaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggagacctgggtgacatatggaacctgttcccaaacaggcgagcacagacgggataagcgctctgtcgccctggcccctcatgtggggctgggactcgaaaccagaacggagacatggatgagctccgaaggcgcttggaaacagattcagaaggttgagacctgggccctgcggcaccccggctttacagtgatcgctcttttcctggcccatgcgattgggacctctatcacccagaagggaatcatttttatcctcctgatgcttgtcacacctagcatggccatgcgctgcgtgggcattgggaacagagacttcgttgagggactgtccggcgctacgtgggtggatgtcgtgctcgaacacgggagctgtgtgaccacaatggccaaagacaagcccaccctggatatcgagctgctcaaaacagaagtcaccaatcctgctgttctgcggaaactttgcattgaggccaaaatctctaacacgacaaccgactcccgctgtccgacccaaggagaagcgacactggtggaggagcaggataccaattttgtgtgcagacggacattcgtcgaccgcggctggggcaacgggtgtggactctttggcaaggggagcctgattacgtgcgccaagttcaaatgcgtgaccaaacttgaaggaaaaatcgttcagtacgagaatctgaagtattctgtgatcgtcacagtgcacaccggcgatcagcatcaagttgggaacgaaacaaccgagcacggaacgaccgctacaattacaccccaggcccctacatccgaaatccagctcaccgactacggcgctctgacgctggactgtagccccagaacaggcctcgattttaatgagatggtgctgcttaccatgaaagagaagtcttggctggtccataaacagtggttcctcgacctgcctcttccctggacatccggggccagcacctcccaagaaacctggaaccggcaggatctgctcgtgacatttaagacggcccacgctaagaaacaggaggtcgtggttctgggatctcaagaaggcgcgatgcacaccgccctgacaggggctaccgagattcagacaagcggaaccacgacaatcttcgccggccatctcaagtgccgcctgaaaatggacaaacttaccctgaaaggggtgtcctatgtcatgtgtaccggcagcttcaagctcgaaaaggaggtggccgagacacagcacggaaccgttctggtgcaggtcaaatacgaaggcacagatgctccgtgcaagattcctttttcttcccaagacgagagaggggtgatccagaatggacggctgatcacggccaaccccattgtgaccgataaagaaaagcctgttaatatcgaggcggagccgcccttcggcgaaagctatattgtcgtgggggctggagagaaagcccttaagctctcttggtttaagaaaggcagctccatcgggaagatgttcgaagccacagctagaggcgcccgccggatggctattctgggagacaccgcctgggattttggctctatcgggggagtgttcacaagcgtcggcaaactggtgcatcagatctttgggaccgcgtacggagttctcttctccggcgtgagctggacgatgaagattgggatcggcattctgcttacctggctgggactcaactctagatccacaagcctgtctatgacctgtatcgccgtcggcatggtgacactgtaccttggggttatggtgcaggctgactccggatgcgtcattaattggaaaggccgcgagctcaagtgtgggagcggaatctttgtgaccaacgaagttcacacatggaccgagcaatataagttccaggccgattcccctaaacggctgtctgctgccattggcaaggcgtgggaggaaggggtgtgcggcatcagaagcgccacgcgcctggagaacatcatgtggaaacagatttccaatgaactcaaccatatcctgcttgagaatgacatgaagtttacagtcgtggtgggagacgtctctggcattctggctcaggggaaaaagatgatccggccgcaacccatggaacacaaatacagctggaagtcctggggaaaggccaaaattatcggcgctgatgttcagaacaccaccttcatcattgacgggcctaatacacccgagtgtcctgataaccagagagcctggaatatctgggaggtggaagactatggatttggcgtgttcaccacgaacatttggctcaagctgcgcgatagctacacacaggtctgcgaccaccggctgatgtctgccgctatcaaagattccaaggcggtgcatgccgacatgggctattggattgagagcgagaagaatgagacctggaaacttgaaagagcttctttcatcgaggttaagacatgtatctggccccgctcccacaccctctggagcaacggggtgctggagtctgaaatgattatcccgaaaacatacggaggccctgtcagccaacataattatcggcccgggtactttacccagacggccggaccttggcacctgggcaagctcgagctggatttcaacctttgcgaagggaccacagtggttgtggacgagaattgcggaaacagaggcccctccctgcggaccacaaccgtcacgggcaaaattatccacgagtggtgttgccgcagctgtacactccctcccctgagatttaagggggaagatggatgctggtacggcatggagattcggccggtgaaagaaaaggaggaaaatctggttaagtctatggtgtccgccgggagcggagaggtcgactccttctctcttggcctcctgtgtatcagcatcatgattgaggaagtgatgagatcccgctggtctgggaaaatgctgatgaccggaacactcgctgtgtttctgcttctgaccatgggccagctcacctggaacgatctgatccggctgtgcattatggtcggcgccaacgcgagcgacatgatggggatgggaacaacgtatcttgctctgatggccaccttcagaatgcgccctatgtttgccgttggcctcctgttcagacggctcacatcccgcgaggtgctgcttctgaccgtggggctctctctggtcgctagcgtggaactgcccaattcccttgaggaactgggagacggcctcgccatggggatcatgatgctgaagctcctgacagattttcaaagccatcagctttgggcgaccctgctctctctgacgttcgttaaaacagctttttccctgcactacgcctggaagaccatggccatgattcttagcatcgtgtctctgttccccctctgtctgtccaccacaagccagaaaaccacatggctccctgtcctgcttggatctctgggctgcaagccgctgacgatgctcctgattaccgagaacaagatctggggcagacggtcctggccccttaatgaggggatcatggctattggaatcgtgagcattctgctctccagcctgctcaaaaacgacgttcctctggccggcccccttatcgctgggggaatgctgattgcctgttatgtgatctctggcagctccgcggatctgtctctcgaaaaggccgctgaggtcagctgggaagacgaggccgaacattccggggcttctcacaatatcctggtggaggtccaggatgacggaacaatgaaaattaaggatgaggaacgcgacgatacccttacaatcctgctcaaagccaccctgctcgccattagcggcgtgtaccctatgtccatccccgctacgctgtttgtttggtatttctggcaaaagaaaaagcagagatctggcgtgctttgggacacccctagccctcccgaggtcgaacgggcggtgctggatgacgggatttaccgcatcctgcagagaggactcctgggccggtcccaggttggggtgggagtcttccaagagggcgtgtttcatacaatgtggcacgtgacccgcggggccgttcttatgtatcagggaaagagactggagcccagctgggcttctgtcaaaaaggatctcatctcctacggcggcgggtggcggttccagggaagctggaacacaggcgaagaggtccaggtgattgccgtcgaacccgggaaaaatcctaagaacgtgcaaaccacacccggaacgtttaaaacctctgagggcgaagttggggccatcgctctggacttcaagccgggaacatccggcagccctattgtgaatagagagggcaagatcgtcgggctctacggaaacggcgtggttaccacctccgggacatatgtgtctgccattgcgcaggctaaagccagccaggagggacccctgcctgaaatcgaggacgaagtctttcgcaagcggaatcttacgattatggatctgcaccccggctccgggaaaaccagacgctacctgcccgccatcctccgggaggctatcaagagaaaactgcgcacacttgtgctggcccctacccgggttgtggcgagcgaaatggctgaggccctcaagggcatgccgattagatatcaaacaaccgccgtcaagtctgagcatacgggaaaagaaatcgtggacctgatgtgccacgctacattcaccatgcgcctgctctcccccgtgcgggtccctaactacaatatgattatcatggatgaggcccattttaccgaccccgctagcattgccgcgagaggctatatctctacacgggttgggatgggagaagccgctgccatcttcatgaccgctacacctcccggcagcgtggaggcctttcctcagtccaacgccgtgattcaggatgaagaaagagacatcccggagagatcttggaatagcgggtacgattggattaccgacttccccggaaagacggtctggtttgtgccttccatcaaatctggcaacgatattgctaactgtcttcggaagaatgggaaacgcgttgtgcagctgagcagaaagacattcgacaccgaatatcaaaagaccaagaataatgattgggactacgtcgtgaccacggacatctccgagatgggcgcgaacttccgggccgatagagttatcgacccccgccggtgcctgaagcctgtgattctcaaagatggacccgaaagagtcatcctggctggcccgatgcctgtgaccgtcgccagcgccgctcagcgccgggggagaattggacgcaatcccaacaaggagggcgaccagtacgtgtatatggggcagccccttaataacgatgaggaccacgcccattggacagaagcgaaaatgctgctcgataatatcaacacccctgagggaattatccccgctctgtttgaacctgagcgggaaaagtctgccgccattgacggcgagtacagactgcgcggggaggctagaaagacattcgttgaactcatgcggcgcggcgatcttccggtgtggctgtcctataaagtggccagcgagggatttcaatactccgacagacggtggtgcttcgatggcgaacgcaataaccaggtcctggaggaaaatatggacgttgagatctggaccaaggagggggaacgcaagaagctccggcccagatggctggatgcgcgcacatattctgaccctcttgccctgcgggagtttaaagagttcgctgccggaagacgcagcgtgtccggcgacctcatcctggagattgggaagctgccccagcacctcacccagaaagctcaaaacgcccttgataatctggtgatgctgcacaactctgaacagggaggcaaggcttaccggcatgccatggaggagctccctgacacgatcgaaacactgatgcttctggcgctcattgccgtcctgaccggcggggtgaccctgtttttcctcagcggaagaggccttgggaagacatccatcggactgctgtgtgttatggctagctctgccctcctgtggatggcttccgtggagccccactggattgccgccagcatcatccttgaatttttcctgatggtcctcctgattccggagcctgatcggcagcgcacaccccaggacaaccaactggcttatgtggtcatcggcctcctttttatgattctgacagtggcggccaatgagatggggctgctcgaaacgaccaaaaaggatctgggaatcggccatgctgccgccgagaaccaccaccatgctgccatgcttgacgttgatctgcaccctgcgtctgcctggacactctacgctgtggccaccacaattatcacccccatgatgagacatacgatcgaaaataccacagctaacatttccctgaccgccatcgcgaatcaggccgctattctgatgggcctcgacaaagggtggcctatcagcaagatggatattggagtcccccttctggccctgggctgctactctcaggtgaacccgctcacactgaccgctgccgttcttatgctggtggctcactatgccatcattgggcctggactccaagcgaaagccacgcgggaggctcagaagcgcacagccgctggcatcatgaagaatcccaccgtcgacgggatcgtggccattgatctggaccccgtggtttacgatgccaaattcgaaaagcagctgggacagatcatgctccttattctgtgtacaagccaaatcctgctcatgagaaccacctgggcgctgtgcgagtccattacacttgctacgggccctctgaccacactctgggagggctctccggggaaattttggaacaccacaatcgccgtcagcatggctaatatcttccggggatcctatctggccggcgccgggctggctttcagcctcatgaagtcccttggaggcgggcgcagaggaaccggcgcccagggcgaaacgctgggggagaaatggaagcggcagctgaaccagctctctaagagcgaatttaatatttacaaacgctccggaatcatggaggtggacagatctgaagcgaaggagggcctgaaaagaggggaaacaaccaagcatgccgtgagccggggaaccgctaaacttcgctggttcgtcgaacggaacctggttaagcccgagggcaaggtgattgacctcgggtgtggaagaggcggctggtcctattactgcgccgggctgaaaaaggtgacagaagtcaaaggatataccaagggcgggcctggacacgaggaacccgtgcctatggctacatacggctggaatctggttaaactccactctgggaaggatgtgtttttcacgccccctgagaaatgtgacacccttctgtgcgatatcggagagagctccccgaaccccacaattgaagagggccgcaccctgcgggtcctcaagatggtggaaccttggctgagaggcaatcaattttgtatcaagatccttaacccctacatgcctagcgttgtggagacactggagcagatgcagcgcaaacatgggggaatgctcgtccggaatcccctgtctagaaactccacccacgaaatgtattgggtgagctgcggcacggggaacattgtgtctgccgtcaatatgacctcccgcatgctgctcaaccggttcacaatggcgcatagaaagccgacctacgagcgcgacgttgatctgggagccggcacacggcacgtggctgtggaacctgaggtcgccaatcttgacatcattgggcagagaatcgaaaacattaaaaatgagcacaagagcacctggcattatgatgaggacaacccctacaaaacatgggcttatcacggatcttacgaagtgaagccctccggcagcgcctccagcatggttaatggcgtggtccgcctgctcaccaagccttgggatgtgatccccatggttacgcaaattgctatgacagacaccaccccttttgggcagcagagagtgttcaaagagaaggtcgatacacggacgccgaaagccaagcgcggaaccgcgcaaatcatggaagtgacagccaaatggctgtggggctttctttctagaaacaagaagccccggatctgtaccagagaggagttcacacggaaagttcgcagcaatgctgccattggggctgtgtttgtcgacgagaaccagtggaactccgccaaggaggccgtggaagacgagagattctgggatctggtccatcgggaacgcgagctccacaaacagggaaagtgcgcgacctgcgtgtataacatgatgggcaaaagagaaaagaagctgggggagtttggcaaagctaagggatctcgggccatctggtacatgtggctgggcgcccgcttcctcgagttcgaagctctggggtttatgaatgaggaccattggttcagcagagaaaactccctttctggagttgagggcgaggggctgcacaaactcggatacattctgcgggatatcagcaagattcctggcgggaatctttatgccgacgatacagctggctgggacacccgcatcacggaagatgacctgcagaacgaggccaaaatcaccgatattatggaacccgagcacgcgctcctggccacatccatctttaagctgacctaccaaaacaaagtggtcagagtgcagcggcctgctaagaatggaacagtgatggacgttatttctcgcagagatcagcggggcagcggacaggtgggaacctatggcctcaacacgttcacaaatatggaagcccaactgatccgccagatggagtccgaggggatttttagcccctctgaacttgagaccccgaacctggctaagagagtcctcgactggctggaaaaacatggaatcgagcggcttaagagaatggccatctccggcgatgactgtgtggttaaacctattgacgatcgcttcgcgacagccctgaccgctctcaatgacatggggaaggtgcggaaagatatcccccagtgggaacctagcaagggctggaacgactggcagcaagtccccttttgctctcaccatttccaccagctgattatgaaggatggaagagagatcgtggtcccttgtcgcaatcaggacgagctgattggccgggccagagtgtcccagggggctggatggagcctccgcgaaacggcctgcctgggcaaatcctacgctcaaatgtggcagcttatgtattttcaccggagagatctgcgcctcgccgcgaacgccatctgttctgctgttcccgtggactgggtcccgaccagccggacaacctggtccatccatgcccaccatcagtggatgacaaccgaggatatgctgagcgtgtggaatagagtttggattgaagagaacccttggatggaagacaagacacacgtgtcttcctgggaggatgtcccctaccttgggaaacgcgaggaccaatggtgcggaagcctgatcggcctcaccgcccgggctacgtgggcctctaatattcaggtggcgatcaaccaggtgagacggctgattgggaatgaaaactatctggactacatgacaagcatgaagagattcaaaaatgagtccgatcccgaaggcgctctctggtga

SEQ ID NO: 19426 - RNA, 9879 nt, synthetic construct
  misc_feature 1..9879: note = derived and/or modified CDS sequence (opt5) from DENV-1__KC762653__SS-prME
  source 1..9879: mol_type = other RNA
tccgtgaccatgctgctcatgctgcttcccacagccctggctttccaccttacgaccagaggcggggagcctcatatgatcgtctccaagcaggaacggggaaagtctctgctttttaagaccagcgccggcgttaacatgtgcaccctgattgccatggacctcggggagctgtgtgaagatacaatgacctacaagtgcccgcgcatcacagagaccgaacccgacgatgtggactgttggtgcaatgctacggagacctgggtgacatatggaacctgttaccagacaggcgagcacagacgggataagcgctccgtcgccctggcccctcatgtggggctcggactggaaaccagaacggagacatggatgtctagcgaaggcgcttggcggcagattcagaaggttgagacctgggcccttcgccaccccggcttcacagtgatcgctctgtttctcgcccatgcgattgggacctccatcacccagaagggaatcattttcatcctgcttatgctggtcacaccttctatggccatgagatgcgtgggcattgggaaccgggactttgttgagggactcagcggcgctacgtgggtggatgtcgtgctggaacacgggtcctgtgtgaccacaatggccaaggacaaacccaccctggatatcgagctcctgaagacagaagtcaccaatcctgctgttcttcgcaaactgtgcattgaggccaagatcagcaacacgacaaccgactctagatgtccgacccaaggagaagcgacactcgtggaggagcaggataccaatttcgtgtgccggcgcacatttgtcgacagaggctggggcaacgggtgtggactgttcggcaaagggtcccttattacgtgcgccaagtttaagtgcgtgaccaaactggaaggaaagatcgttcagtatgagaatctcaaatacagcgtgatcgtcacagtgcacaccggcgatcagcatcaagttgggaacgaaacaaccgagcacggaacgaccgctacaattacaccccaagcccctacctctgaaatccagctgaccgactatggcgctctgacgctcgactgtagcccccggacaggcctggatttcaatgagatggtgcttctgaccatgaaggagaaaagctggctcgtccataagcagtggtttctggaccttcctctgccctggacatctggggcctccaccagccaagaaacctggaaccgccaggatctcctggtgacattcaaaacggcccacgctaagaagcaggaggtcgtggttctgggatcccaagaaggcgcgatgcacaccgccctcacaggggctaccgagattcagacatctggaaccacgacaatctttgccggccatctgaaatgcagacttaagatggacaaactgaccctcaaggggatgagctacgtgatgtgtaccggctccttcaaactggaaaaggaggtcgccgagacacagcacggaaccgtgctggttcaggtgaagtatgaaggcacagatgctccgtgcaaaattcctttcagctctcaagacgagaagggggtcacgcagaatggacggcttatcaccgccaaccccatcgtgacagataaagaaaagcctgtgaatattgaggcggagccgccctttggcgaatcctacctcgttgtcggggctggagagaaagccctgaagctgagctggttcaagaaaggctctagcatcgggaagatgtttgaagccaccgctagaggcgcccgccggatggctattctcggagacacagcctgggatttcggctccatcgggggagtgtttacctctgtgggcaaactgattcatcagatcttcgggacggcgtacggagtcctttttagcggcgtgtcctggaccatgaagatcgggattggcatcctgctcacatggctgggactgaacagcagatctacctcccttagcatgacatgtattgccgttggcatgatcaccctctatctgggggtgatggtccaggctgactctggatgcgtgattaattggaaaggccgcgagctgaagtgtgggtccggaatcttcgttacaaacgaagtgcacacctggacggagcaatacaagtttcaggccgatagccctaaacggctctccgctgccattggcaaggcgtgggaggaaggggtctgcggcatcagatctgccacacgcctggagaacatcatgtggaaacagattagcaatgaacttaaccatatcctgctcgagaatgacatgaagttcaccgtggttgtgggagaagtcaacggcattctggctcaggggaaaaagatgatccggccgcaacccatggagcacaaatattcctggaagtcttggggaaaggccaaagtgattggcgctgacgtgcagaataccacatttatcatcgatgggcctaacacccccgagtgtcctgacaatcagagagcctggaacatttgggaagtcgaggattacggattcggcatctttacgacaaatatttggctgaaacttcgcgacagctatacccaggtttgcgatcaccggctcatgtccgccgctatcaaagacagcaaggcggtgcatgccgatatgggctactggattgaatctgagaaaaacgaaacatggaagctggctagagcctccttcatcgaggtgaagacctgtatctggcccaaaagccacacactgtggtctaatggggtcctcgagtccgaaatgattatcccgaagatttatggaggccctatcagccaacataactaccgccccgggtacttcacccagacggccggaccttggcacctgggcaaacttgagctggactttgaactctgcgaggggaccacagtggttgtggatgagcactgcggaaatcggggcccctctctgagaaccacaaccgtcacgggcaagattatccatgaatggtgttgccggagctgtacactgcctccccttcgcttcaaaggggaggacggatgctggtatggcatggaaatcagaccggtgaaggagaaggaagagaacctcgttaaatccatggtgagcgctgggtctggagaggtcgattcctttagcctgggcctgctctgtatttccatcatgattgaagaggtgatgcggtctagatggagccgcaagatgctgatgaccgggacacttgccgttttcctgctcctgaccatgggacagctgacctggaatgaccttatccggctgtgcattatggtgggcgcgaacgcttccgataaaatgggcatggggacaacgtacctcgccctgatggccacctttagaatgcgccctatgctcgctgtcggactgcttttcagacggctgacatctcgcgaagtgctcctgctgaccgtgggccttagcctggtcgcctccgttgagctccccaactctctggaggaactgggggacggactggcgatgggcatcatgatgcttaagctgctcacagactttcaaagccaccagctgtgggctgccctgctttccctgaccttcgtgaaaacgacactcagcctgcattatgcctggaagaccatggctatgattctctctatcgtgtccctgtttcccctttgtctgagcaccacatctcagaagaccacatggctgcctgtcctcctggggtcccttggatgcaaaccgctgacgatgttcctcatcaccgagaataagatttggggcagaaaaagctggcccctgaacgaaggcatcatggccgtggggattgtttctatcctcctgtccagccttctgaagaatgatgtgcctctggctggacccctcattgccggcgggatgctgatcgcgtgttacgtcatctccggaagctctgccgaccttagcctggagaaagctgccgaagtgtcctgggaggaagaggctgagcactctggcgccagccataacattctcgttgaagtgcaggatgacgggacaatgaagatcaaagatgaggaacgggacgataccctgacaattctcctgaaggccacccttctggctatctccggagtctatcctatgtctattcccgcgacgctgtttgtgtggtacttctggcaaaagaaaaagcagcgcagcggcgtcctctgggacacccctagccctcccgaggtggagaaagccgttctggatgacggcatctatagaatccttcagcgggggctgctcggaaagtctcaggtgggcgtcggggtgtttcaagaaggagttttccacacaatgtggcacgtgacccgcggcgctgtcctgatgtaccaggggaaaagactcgagcccagctgggcctccgtgaagaaggatctgattagctacggaggcggctggcggttccaggggtcttggaatacaggagaagaggtgcaggttatcgccgtcgaacccggcaaaaaccctaagaatgtgcaaaccgctcccgggacatttaaaacgccggagggagaggtgggcgccattgcgcttgacttcaagcctgggacctccggaagccccatcgtcaaccgcgaaggcaaaattgtgggcctgtatgggaatggagttgtgacaacctctggcacctacgtctccgctatcgcccaggccaaggctagccaggaggggcctctgcccgaaattgaggatgaagtgtttagaaagcggaacctcacaatcatggacctgcatcccggatccggcaaaacgagacgctatcttcctgccatcgttcgggaggcgattaagagaaaactgcgcaccctcgtgctggctccgacacgggtcgtggcctctgagatggccgaagctctgaaggggatgcccatcagataccaaaccacagccgttaaaagcgagcacaccggcaaggaaattgtggacctcatgtgccatgctacgttcacaatgcgccttctgtcccctgtccgggtgcccaattataacatgatcattatggatgaggcccactttaccgaccctgcgagcatcgccgctagaggatacatctctacccgcgtgggcatgggggaagccgctgccattttcatgacagccacaccccctggatccatggaggcttttccgcagagcaatgcggccatccaggatgaggaacgggacattcccgagagatcttggaacagcggctatgattggatcacagacttccctgggaagaccgtctggtttgttccctccattaaatctggaaatgatatcgctaactgtctgcggaagaacggcaaacgcgtgatccagctcagcagaaagacgttcgacacagaataccagaagaccaagaataacgattgggactacgtggtcacaaccgatatttccgagatgggggccaattttcgggccgaccgcgtgatcgaccctagacggtgcctgaagcccgttattcttaaagatggcccggagagagtgatcctggctggacctatgcccgtcacggtggcctctgcggctcagcgccggggcagaattgggcgcaaccagaataaggaaggagaccagtatatctacatgggccaacccctcaacaatgatgaggaccatgcccactggaccgaagccaaaatgctgctggataacattaatacacctgaggggatcatccccgctctcttcgaacctgagcgggaaaagtccgccgcgattgacggagaatatagacttcgcggcgaggcccggaaaaccttcgttgaactgatgagacgcggggatctgccggtgtggctctcctacaaggtcgctagcgagggctttcagtattctgacagacggtggtgcttcgatggagaacgcaacaatcaggtgctggaggagaacatggacgtcgaaatctggacaaaagagggcgaaagaaagaaacttcggccccgctggctggatgccagaacctactccgaccctctcgctctgcgggagtttaaagagttcgccgctgggagacgcagcgtgtccggagatctgattctcgagatcggcaaacttccccagcacctgacacaacgggcccagaatgcgctggacaacctcgttatgctgcataattctgagcaagggggaaaagcctatagacacgctatggaggaacttcctgacaccattgaaacgctgatgctcctggccctgatcgctgtgctcacaggcggcgtgaccctctttttcctgagcgggcgcggactgggcaagacctccatcgggctcctgtgtgtcatggcctctagcgcccttctgtggatggcttccgttgagccccattggattgcggccagcatcattctcgagtttttcctgatggtgctgctcatcccggaacctgatcggcagagaacaccccaagacaaccagcttgcttacgtggtcattggactgctgtttatgatcctcaccgtggccgccaacgagatgggcctgcttgaaacaacgaaaaaggatctggggatcggacacgctgccgcggagaatcaccatcacgccgctatgctcgacgttgatctgcatcctgcctctgcttggaccctgtacgccgtggcgacaaccattatcacacccatgatgcggcacaccattgaaaacacgaccgccaatatctccctcacagctattgccaaccaggctgccatccttatgggcctggacaagggctggcctattagcaaaatggatatcggggtccccctgctcgctctgggatgctattctcaagtgaatccgcttaccctgacagccgcggtcctcatgctggtggcccattacgctatcattggccctgggctgcaggccaaggctacccgcgaggcccagaaaagaacggccgcgggaatcatgaagaaccccacagttgacggcattgtggctatcgatctcgaccccgtcgtgtatgatgccaaattcgagaagcagcttgggcaaattatgctgctgatcctctgtacctcccagatcctgcttatgcggacaacctgggctctgtgcgaaagcattaccctcgccacaggacctctgacgaccctgtgggagggctctccgggcaagttttggaatacaaccatcgccgttagcatggctaacattttccgcgggtcctacctcgccggagcgggccttgccttttctctgatgaaaagcctcgggggaggcagacgggggacaggagctcagggcgaaaccctcggcgagaagtggaaacgccagctgaatcaactttccaagagcgagttcaacacgtataaaagatccgggatcatggaggtggaccggtctgaggccaaggaaggactgaagcgcggcgagacaaccaaacacgctgtcagcagagggaccgccaagctccggtggttcgtggaaagaaatctggtgaaacccgagggaaaggttattgatctgggctgtgggcgcggaggctggtcctactattgcgcgggcctcaaaaaggtcacagaagtgaaagggtacaccaagggaggccctgggcacgaggagcccatccctatggccacatacggatggaaccttgtgaagctgcattctggcaaagacgtctttttcacgccccctgaaaagtgtgacaccctgctctgcgatatcggggagagctccccgaatcccacaattgaagagggacggaccctgagagttcttaaaatggtggagccttggctgcgcggcaaccagttttgtatcaaggtgctcaatccctatatgccttctgtcattgaaacactggagcagatgcagcggaaacacggcgggatgctggtgagaaaccccctcagccgcaattccacccatgaaatgtactgggttagctgcggaacgggcaacatcgtgtctgctgtcaacatgacctcccggatgctgcttaatagattcacaatggcccaccgcaagccgacctatgagcgggacgtggatctgggggctggaacaagacacgttgccgtggaacctgaggtcgctaacctcgacattatcggccaacgcattgagaatatcaagaacgaacataaaagcacctggcactacgatgaggacaatccctataagacatgggcctaccatgggtcttatgaagtgaaaccctccggaagcgcgtcttccatggtgaacggcgtcgttcggctgcttaccaagccttgggatgtgatccccatggtgacgcagattgccatgacagacaccaccccttttggccagcaaagagtcttcaaagagaaggtggatacacgcacgccgaaggctaaaagagggaccgcccagatcatggaagttacagctcggtggctgtggggatttctcagccgcaataagaaacccagaatttgtacccgggaggagttcacaagaaaggtgcggtccaacgccgccatcggcgcggtctttgtggacgaaaatcagtggaacagcgctaaagaggccgttgaagatgagcgcttctgggacctggtgcacagagaacgggagctgcataagcaggggaagtgcgcgacctgcgtctacaatatgatgggaaaacgcgagaagaaactcggcgaatttgggaaggctaaaggctctagagccatttggtacatgtggctgggagctcggttccttgagtttgaagccctgggcttcatgaacgaggaccactggttcagccgcgaaaattccctctctggggtggaaggagagggcctgcacaaacttgggtatatcctgagagatatcagcaaaattcctggaggcaacatgtacgcggacgatacagccgggtgggacacccggatcacggaagatgacctccaaaatgaggctaagattaccgatatcatggaacccgagcatgccctgctggctacatccatttttaagctcacctatcagaacaaagttgtgcgcgtccagagacctgccaagaacggcacagtgatggacgtcatctctcggcgcgatcagagaggaagcggccaagtggggacctacggactgaatacgttcacaaacatggaggcgcagcttatccggcagatggaatccgagggcatttttaccccctctgaactggagacaccgaatctcgccgaacgcgttctggactggcttgagaaacacgggatcgagagactgaagcggatggctattagcggagatgactgtgtggtcaaacctatcgatgacagattcgccaccgctctcacggccctgaacgacatgggcaaggtgcgcaaggatattccccagtgggaaccttccaaagggtggaatgactggcaacaggtgcccttttgcagccatcacttccaccagctgatcatgaaggatggccgggagatcgttgtgccttgtagaaaccaggacgaactcgtcggacgcgctcgggtgtctcaaggcgccgggtggtccctgagagagaccgcgtgccttggaaaaagctatgcccagatgtggcagctgatgtactttcatcgccgggatctcagactggctgccaatgccatttgttctgctgttcccgtggactgggtcccgacatcccgcaccacatggagcatccacgcccatcaccaatggatgaccacagaagatatgctttccgtgtggaaccgggtctggattgaggagaatccttggatggaagacaagacccatgtgtctagctgggaggatgttccctatctgggcaaaagagaagaccagtggtgcgggtccctcatcggactgacggcgcgcgctacatgggccaccaacattcaggtggccatcaatcaggtccggagactgattggcaacgagaattacctcgattacatgaccagcatgaagcggttcaagaacgagtctgaccccgaaggggctctgtggtga

SEQ ID NO: 19427 - RNA, 9879 nt, synthetic construct
  misc_feature 1..9879: note = derived and/or modified CDS sequence (opt5) from DENV-1__KC762640__SS-prME
  source 1..9879: mol_type = other RNA
agcgtgaccatgctgctgatgctgcttcccacagccctggctttccaccttacgaccagaggcggggaacctcatatgatcgtctccaagcaggaacggggaaagtctctgctttttaagaccagcgccggcgttaacatgtgcaccctgattgccatggacctcggggagctgtgtgaagatacaatgacctacaagtgcccccgcatcacagagaccgaacccgacgatgtggactgttggtgcaatgctacggagacctgggtgacatatggaacctgttcccagacaggcgagcacagacgggataagcgctctgtcgccctggcccctcatgtggggctcggactggaaaccagaacggagacatggatgagctccgaaggcgcttggcggcagattcagaaagttgagacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggaaccgggactttgttgagggactctccggcgctacgtgggtggatgtcgtgctggaacacgggagctgtgtgaccacaatggccaaggacaaacccaccctggatatcgagctcctgaagacagaagtcaccaatcctgctgttcttcgcaaactgtgcattgaggccaagatctctaacacgacaaccgactccagatgtccgacccaaggagaagcgacactcgtggaggagcaggataccaatttcgtgtgccggcgcacatttgtcgacagaggctggggcaacgggtgtggactgttcggcaaagggagccttattacgtgcgccaagtttaagtgcgtgaccaaactggaaggaaagatcgttcagtacgagaatctcaaatattctgtgatcgtcacagtgcacaccggcgatcagcatcaagttgggaacgaaacaaccgagcacggaacgaccgctacaattacaccccaagcccctacctccgaaatccagctgaccgactacggcgctctgacgctcgactgtagcccccggacaggcctggatttcaatgagatggtgcttctgaccatgaaggagaaatcttggctcgtccataagcagtggtttctggaccttcctctgccctggacatccggggccagcacctcccaagaaacctggaaccgccaggatctcctggtgacattcaaaacggcccacgctaagaagcaggaggtcgtggttctgggatctcaagaaggcgcgatgcacaccgccctcacaggggctaccgagattcagacaagcggaaccacgacaatctttgccggccatctgaaatgcagacttaagatggacaaactgaccctcaagggggtgtcctatgtcatgtgtaccggcagcttcaaactggaaaaggaggtggccgagacacagcacggaaccgttctggtgcaggtcaagtacgaaggcacagatgctccgtgcaaaattcctttctcttcccaagacgagaagggggtgacgcagaatggacggcttatcaccgccaaccccatcgtgacagataaagaaaagcctgttaatattgaggcggagccgccctttggcgaaagctatctcgtcgtgggggctggagagaaagccctgaagctgtcttggttcaagaaaggcagctccatcgggaagatgtttgaagccaccgctagaggcgcccgccggatggctattctcggagacacagcctgggatttcggctctatcgggggagtgtttaccagcgtcggcaaactgattcatcagatcttcgggacggcgtacggagtgctcttttccggcgttagctggaccatgaagatcgggattggcatcctgctcacatggctgggactgaactctagatccaccagcctttctatgacatgtattgccgtgggcatggtcaccctctacctgggggtgatggttcaggctgactccggatgcgtgatcaattggaaaggccgcgagctgaagtgtgggagcggaattttcgtcacaaacgaagtgcacacctggacggagcaatataagtttcaggccgattcccctaaacggctctctgctgccatcggcaaggcgtgggaggaaggggtttgcggcattagaagcgccacacgcctggagaacatcatgtggaaacagatctccaatgaacttaaccatattctgctcgagaatgacatgaagttcaccgtggtcgtgggagaagtgaacggcatcctggctcaggggaaaaagatgattcggccgcaacccatggagcacaaatactcttggaaaagctggggaaaggccaaagtcatcggcgctgacgttcagaataccacatttattatcgatgggcctaacacccccgagtgtcctgacaatcagagagcctggaacatctgggaagtggaggattatggattcggcatttttacgacaaatatctggctgaaacttcgcgactcctacacccaggtgtgcgatcaccggctcatgagcgccgctattaaagactctaaggcggtccatgccgatatgggctattggatcgaatccgagaaaaacgaaacatggaagctggctagagccagcttcattgaggtgaagacctgtatctggcccaaatctcacacactgtggtccaatggggttctcgagagcgaaatgatcattccgaagatctacggaggccctatttctcaacataactatcgccccgggtacttcacccagacggccggaccttggcacctgggcaaacttgagctggactttgaactctgcgaggggaccacagtggtcgtggatgagcactgcggaaatcggggccccagcctgagaaccacaaccgttacgggcaagatcattcatgaatggtgttgccggtcctgtacactgcctccccttcgcttcaaaggggaggacggatgctggtacggcatggaaatcagaccggtgaaggagaaggaagagaacctcgtcaaaagcatggtgtctgctgggtccggagaggttgatagcttttccctgggcctgctctgtatctctattatgatcgaagaggtgatgcggagcagatggtcccgcaagatgctgatgaccgggacacttgccgtcttcctgctcctgaccatgggacagctgacctggaatgaccttattcggctgtgcatcatggtgggcgcgaacgcttctgataaaatgggcatggggacaacgtatctcgccctgatggccacctttagaatgcgccctatgttcgctgtgggactcctgtttagacggcttacaagccgcgaagtcctgctcctgaccgttggcctgtcccttgtggcctctgtggagctgcccaacagcctcgaagaactgggggacggactcgcgatgggcattatgatgctgaaacttctgacagacttccaatcccaccagctctgggctgccctgctgagccttacctttgtcaaaacgacactgtctctccattacgcctggaagaccatggctatgatcctgtccattgtgagcctcttccccctgtgtctttctaccacatcccagaagaccacatggctgcctgttctgctcgggagcctgggatgcaaaccgcttacgatgtttctgatcaccgagaataagatctggggcagaaaatcttggcccctcaacgaaggcattatggccgtggggatcgtctccattctgctcagctccctgcttaagaatgatgtgcctctggctggacccctgatcgccggcgggatgctcattgcgtgttatgttatcagcggatctagcgccgacctgtcccttgagaaagctgccgaagtgtcttgggaggaagaggctgagcacagcggcgcctcccataacatcctggtcgaagtgcaggatgacgggacaatgaagattaaagatgaggaacgggacgataccctcacaatcctgctcaaggccaccctgcttgctatttctggagtctaccctatgagcatccccgcgacgctgttcgtgtggtatttttggcaaaagaaaaagcagcgctccggcgttctgtgggacaccccttctcccccggaggtggagaaagccgtcctcgatgacggcatttacagaatcctgcagcgggggcttctgggaaagagccaggtgggcgttggggtgttccaagaaggagtcttccacacaatgtggcacgtgacccgcggcgctgtgctcatgtatcaggggaaaagactggagccttcctgggccagcgttaagaaggatctcatctcttacggaggcggctggcggtttcaggggtcctggaatacaggagaagaggtccaggtgattgccgtggaacccggcaaaaaccctaagaatgtccaaaccgctcccgggacattcaaaacgccggagggagaggtgggcgccatcgcgctggactttaagcctgggaccagcggatctcccattgttaaccgcgaaggcaaaatcgtgggcctttacgggaatggagtcgtgacaacctccggcacctatgttagcgctattgcccaggccaaggcttcccaggaggggcctctgcccgaaatcgaggatgaagtgttcagaaagcggaacctgacaattatggacctccatcccggatctggcaaaacgagacgctacctgcctgccatcgtccgggaggcgatcaagagaaaacttcgcaccctggtgctcgctccgacacgggttgtggccagcgagatggccgaagctctgaaggggatgcccattagatatcaaaccacagccgtcaaatccgagcacaccggcaaggaaatcgtggacctgatgtgccatgctacgtttacaatgcgcctccttagccctgtgcgggtccccaattacaacatgattatcatggatgaggcccacttcaccgaccctgcgtctattgccgctagaggatatatctccacccgcgttggcatgggggaagccgctgccatctttatgacagccacaccccctggaagcatggaggctttcccgcagtctaatgcggccattcaggatgaggaacgggacatccccgagagaagctggaactccggctacgattggattacagactttcctgggaagaccgtgtggttcgtgccctctatcaaaagcggaaatgatattgctaactgtctgcggaagaacggcaaacgcgtcatccagctgtccagaaagacgtttgacacagaatatcagaagaccaagaataacgattgggactacgtggttacaaccgatatctctgagatgggggccaatttccgggccgaccgcgtgattgaccctagacggtgcctcaagcccgtcatcctgaaagatggcccggagagagtgattcttgctggacctatgcccgttacggtggccagcgcggctcagcgccggggcagaatcgggcgcaaccagaataaggaaggagaccagtacatttatatgggccaacccctgaacaatgatgaggaccatgcccactggaccgaagccaaaatgctcctggataacatcaatacacctgaggggattatccccgctctgttcgaacctgagcgggagaagtccgccgcgatcgacggagaatacagactccgcggcgaggcccggaaaacctttgtcgaacttatgagacgcggggatctgccggtgtggctgagctataaggtcgcttctgagggcttccagtactccgacagacggtggtgctttgatggagaacgcaacaatcaggtgctcgaggagaacatggacgttgaaatttggacaaaagagggcgaaagaaagaagctgcggccccgctggcttgatgccagaacctatagcgaccctctggctctccgggagttcaaagaatttgccgctgggagacgctccgtgtctggagatctgatcctggagattggcaagctcccccagcaccttacacaacgggcccagaatgcgctggacaacctggtgatgctccataatagcgagcaagggggaaaagcctacagacacgctatggaagaactgcctgacaccatcgaaacgcttatgctgctcgccctgattgctgtcctgacaggcggcgttaccctcttctttctttccgggcgcggactgggcaagacctctatcgggctgctctgtgtgatggccagctccgccctgctttggatggctagcgtggagccccattggatcgcggcctctattatcctggagttctttctcatggtcctgctgattccggaacctgatcggcagagaacaccccaagacaaccagctcgcttatgtggttatcggacttctgttcatgattctgaccgtggccgccaacgagatgggcctcctggaaacaacgaaaaaggatcttgggatcggacacgctgccgcggagaatcaccatcacgccgctatgctggacgtcgatctccatcctgcctccgcttggaccctgtacgccgtggcgacaaccatcattacacccatgatgcggcacaccatcgaaaacacgaccgccaatattagcctgacagctatcgccaaccaggctgccattctcatgggccttgacaagggctggcctatctctaaaatggatattggggtccccctgctggctctcggatgctactcccaagtgaatccgctgacccttacagccgcggttctgatgctcgtggcccattatgctatcatcggccctgggctgcaggccaaggctacccgcgaggcccagaaaagaacggccgcgggaattatgaagaaccccacagtcgacggcatcgtggctattgatctggaccccgttgtgtacgatgccaaatttgagaagcagctcgggcaaatcatgcttctgattctgtgtaccagccagatcctcctgatgcggacaacctgggctctttgcgaatctatcaccctggccacaggacctctcacgaccctgtgggagggcagcccgggcaagttctggaatacaaccattgccgtctccatggctaacatctttcgcgggtcttatctggccggagcgggcctcgccttcagccttatgaaatccctcgggggaggcagacgggggacaggagctcagggcgaaaccctgggcgagaagtggaaacgccagctcaatcaactgagcaagtccgagttcaacacgtacaaaagatctgggattatggaggtggaccggagcgaggccaaggaaggacttaagcgcggcgagacaaccaaacacgctgtgtccagagggaccgccaagctgcggtggtttgttgaaagaaatctcgtcaaacccgagggaaaggtgatcgatctgggctgtgggcgcggaggctggtcttattactgcgcgggcctgaaaaaggtgacagaagtcaaagggtataccaagggaggccctgggcacgaggagcccattcctatggccacatacggatggaacctcgttaaactttacagcggcaaagacgtgttctttacgccccctgaaaagtgtgacaccctgctgtgcgatatcggggagtcctctccgaatcccacaatcgaagagggacggaccctcagagtgctgcgcatggtcgagccttggcttcggggcaaccagttctgtattaaagtgctgaatccctatatgcctagcgttatcgaaacactcgagcagatgcagagaaagcatggcgggatgctggtgcgcaaccccctgtcccggaatagcacccacgaaatgtactgggtctcttgcggaacgggcaacattgtgtccgctgttaacatgaccagcagaatgctcctgaatcgctttacaatggcccatcggaaaccgacctatgagagagacgtggatcttggggctggaacacgccacgtcgccgtggaacctgaggtggctaacctggagatcattggccaacggatcgaaaatattaagaacgagcacaagtctacctggcattacgacgaagataatccctataaaacatgggcctaccacgggtcctatgaggtcaagcccagcggatctgcgtccagcatggttaacggcgtggtgagactcctgaccaaaccttgggacgtcatccccatggtgacgcagatcgccatgacagataccacccctttcggccagcaacgcgtttttaaggaaaaagtggacacaagaacgccgaaggctaagcgggggaccgcccagattatggaggtcacagctcgctggctttggggattcctgtccagaaataaaaagccccggatctgtaccagagaggaatttacacggaaagtgcgcagcaacgccgccattggcgcggttttcgtggatgagaatcagtggaactctgctaaggaagccgtcgaggacgaaagattttgggatctcgtgcatcgggagcgcgagctgcacaaacaggggaagtgcgcgacctgcgtttacaatatgatgggaaagagagagaagaagctgggcgagttcgggaaagctaagggcagccgggccatctggtacatgtggctcggagctcgctttctggagttcgaggcccttggcttcatgaacgaggaccattggttttccagagaaaattctctgagcggggtggagggagaaggcctccacaaactggggtatattcttcgggacatctccaagatccctggaggcaacatgtacgcggatgacacagccgggtgggatacccgcattacggaggacgatctgcaaaatgaagctaaaatcaccgacattatggagcccgagcacgccctcctggctacatctatcttcaagctgacctatcagaacaaggtcgtgagagtccagcggcctgccaaaaacggcacagtgatggatgttattagccgcagagaccagcggggatccggccaagtggggacctacggactcaatacgtttacaaacatggaagcgcagctgatccgccagatggagtctgaaggcatcttcacccccagcgagcttgaaacaccgaatctggccgagagagtcctcgattggctggagaagcatgggattgaacggcttaaaagaatggctatctccggagacgattgtgtggtgaagcctattgacgatcgctttgccaccgctctgacggccctcaacgacatgggcaaagttcggaaggacatcccccagtgggagcctagcaaggggtggaatgattggcaacaggtgcccttctgctctcaccattttcaccagctgattatgaaagacggcagagaaatcgtcgtgccttgtcgcaaccaggatgagctggttggacgggctagagtgtcccaaggcgccgggtggagcctccgcgaaaccgcgtgcctgggaaagtcttatgcccagatgtggcagcttatgtacttccaccggagagacctgcgcctcgctgccaatgccatctgttccgctgtccccgtggattgggtcccgacaagccggaccacatggtccattcatgcccaccatcaatggatgaccacagaggacatgctgtctgtgtggaacagagtttggatcgaggaaaatccttggatggaggataaaacccacgtgagctcctgggaagacgtcccctatcttggcaagcgcgaggatcagtggtgcgggagcctgattggactcacggcgcgggctacatgggccaccaacatccaggtggccattaatcaggttagacggctgatcggcaacgagaattacctggactacatgacctctatgaaaagatttaagaacgaatccgatcccgagggggctctctggtga

SEQ ID NO: 19428 - RNA, 9879 nt, synthetic construct
  misc_feature 1..9879: note = derived and/or modified CDS sequence (opt5) from DENV-1__KC762645__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacactgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagcgcgttgaaacatgggctcttagacaccccggcttcaccgtgatcgccctgtttctcgcgcatgccattgggacatctatcacccagaaaggaatcattttcatcctgcttatgctggtcacccctagcatggctatgcggtgcgtgggcattgggtcccgcgattttgttgagggactcagcggcgccacatgggtggacgtcgtgctggagcacgggtcttgtgtgacgaccatggctaaggataagcccacactggacatcgaactcctgaaaaccgaggtcacaaaccctgccgttcttagaaagctgtgcattgaagcgaaaatctccaataccacgacagatagccggtgtccgacccaaggagaggccaccctcgtggaagagcaggacgctaacttcgtgtgccgcagaacatttgtcgatcggggctggggcaatgggtgtggactgttcggcaaggggtctcttattacctgcgccaaatttaagtgcgtgacaaagctggagggaaaaatcgttcagtacgaaaacctcaagtattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccgcaccggcctggacttcaacgaaatggtgcttctgacgatgaaagagaagtcctggctcgtccataaacagtggtttctggatcttcctctgccctggacaagcggggcttccacctctcaagagacatggaatagacaggacctcctggtgaccttcaagaccgcgcacgccaaaaagcaggaagtcgtggttctgggaagccaagagggcgctatgcacacagccctcacgggggccaccgaaattcagacatccggaaccacaaccatctttgctggccatctgaagtgccggcttaaaatggataagctgacgctcaaagggatgagctatgtgatgtgtacaggctctttcaagctggagaaagaagtcgccgagacccagcacggaaccgtgctggttcagattaagtacgagggcacagacgcgccgtgcaagatccctttctccacccaagatgaaaaaggggtgacacagaacggaagacttatcacggctaatcccattgtcaccgacaaggagaaacctgtgaacatcgaagccgagcccccctttggcgagagctatattgtgatcggggccggagaaaaggctctcaaactgtcttggttcaagaagggcagctccattgggaaaatgtttgaggccacagctcgcggcgcccggagaatggcgatcctgggagataccgcctgggacttcggctctatcgggggagtttttacaagcgtcggcaagctcgtgcatcagattttcgggaccgcttacggagtgctgttttccggcgtcagctggacgatgaaaatcgggattggcgtgcttctgacctggctcggactgaattctcgctccacaagcctgtctatgacctgtatcgccgttggccttgtgacactctacctgggggtcatggtgcaggctgattccggatgcgttattaactggaagggccgggaactgaaatgtgggagcggaatcttcgtgaccaatgaggtccacacatggaccgaacaatataagtttcaggccgactcccctaagagactctctgcggccattggcaaagcttgggaggagggggtgtgcggcatccgcagcgccacgcggctggaaaacatcatgtggaagcagatttccaacgagcttaatcatatcctgctcgaaaacgacatgaaattcacagttgtggtcggagatgtggctggcattctggcccaggggaagaaaatgatcagaccgcaacccatggagcacaagtactcttggaaaagctggggaaaggccaagattatcggcgctgacgtgcagaataccacctttatcattgatgggcctaacacacccgaatgtcctgacgatcagcgcgcgtggaatatctgggaggtcgaggactatggattcggcatttttaccacgaacatctggctgaaacttcgggattcctacacacaggtttgcgaccacagactcatgagcgccgctattaaggattctaaagccgtgcatgccgacatgggctattggatcgaatccgagaagaatgaaacctggaaactggctcgcgccagcttcatcgaggtgaagacatgtatttggcccaagtctcacaccctgtggtccaacggggtcctcgaaagcgagatgatcattccgaaaatctacggaggccctatttctcaacataattatcggcccgggtacttcacacagaccgcgggaccttggcacctgggcaagcttgagctggattttaacctctgcgaagggacgaccgtggttgtggacgagcactgcggaaatagaggccccagcctgcggacaaccacagtcaccggcaaaatcatccatgaatggtgttgccgctcctgtacgctgcctccccttagattccggggggaggatggatgctggtacggcatggagattagaccggtgaaggaaaaagaggaaaacctcgttaagagcatggtgtctgctgggtccggagaggtcgacagcttttccctgggcctgctctgtatctctattatgatcgaagaggtgatgcgcagccggtggtccagaaagatgctgatgacagggacccttgccgttttctttctgctcattatgggacagctgacatggaatgacctgatccgcctttgcattatggtgggcgccaacgcttctgatagaatgggcatggggaccacctatctggccctcatggcgacattcaaaatgcggcctatgtttgctgtcggactgctcttccgcagactgacgagccgggaggtgcttctgctcaccatcggcctgtccctggtggcctctgtcgaacttcccaatagcctggaggaactcggggacggactggccatgggcatcatgattctcaagctgcttacagattttcaatcccaccagctgtgggctaccctcctgagcctgacattcatcaaaaccacgttttctcttcattacgcctggaagacaatggctatggttctgtccattgtgagcctcttccccctgtgtctctctaccacctcccagaaaacaacctggctgcctgtgcttctggggagcctgggatgcaagccgctcacaatgtttctgatcgccgagaacaagatttggggccgcaaatcttggccccttaacgaaggcatcatggcggtcgggatcgtgtccattctgctcagctccctgctcaagaatgacgttcctctggccggaccccttatcgctggcgggatgctgattgcctgttatgtgatcagcggatctagcgctgatctgtccctcgagaaagccgccgaggtctcttgggaagaggaagctgagcacagcggcgcgtcccataacattctggtggaagttcaggacgatgggacgatgaagatcaaagacgaggagagagatgacacccttacaatcctgctcaaggccaccctgctcgctgtgtctggagtctaccctctgagcattcccgccacacttttcgtgtggtatttctggcaaaaaaagaagcagcggtccggcgtcctgtgggataccccttctcccccggaagtggagcgcgccgttctggacgatggcatctacagaattatgcagcgggggctcctgggacgcagccaggtgggcgtcggggtgtttcaagaaaatgttttccacacgatgtggcacgtgaccagaggagctgtccttatgtatcagggcaaacggctggagccttcctgggccagcgtgaagaaagacctcatctcttacgggggaggctggagactgcagggctcctggaacacaggggaggaagtgcaggttattgcggtcgagcccggaaagaatcctaaaaacgtgcaaaccgctcccggcacatttaagaccccggaaggggaggtgggagccatcgccctcgacttcaagcctggcacaagcgggtctcccattgtcaatcgcgaaggaaaaatcgtgggcctgtacggcaacggggttgtgacgacctccggaacatatgtcagcgctatcgcccaggcgaaggcttcccaggagggccctcttcccgagattgaagatgaggtgtttcggaaaagaaatctgaccatcatggacctgcatcccgggtctggaaagacccgccggtacctccctgccattgttagagaagccatcaaacgcaagctgcggacacttattctggctccgacgagagtggtcgccagcgagatggctgaagccctcaagggcatgcccatccgctatcaaaccacagcggtgaaatccgagcacaccgggaaggagatcgttgatctgatgtgccatgccacattcaccatgcggctgctcagccctgtgagagtccccaactacaatatgattatcatggacgaagctcactttacggatccttcttccattgccgctcggggctatatcagcacacgcgtgggaatgggcgaggccgccgctattttcatgaccgcgaccccccctgggtctgtggaagcctttccgcagagcaacgctgtcatccaggacgaggaaagagatatccccgagcggtcctggaattctggatacgagtggattacagacttccctggcaaaaccgtttggtttgtgcccagcatcaagtccgggaacgatattgccaattgtcttcgcaaaaacggaaagagagtgatccagctgtctcggaagacattcgacaccgaatatcaaaaaacgaagaacaatgattgggactacgtcgtgacaaccgacattagcgagatgggcgccaacttcagagctgatcgcgttatcgaccctcggagatgcctgaaacccgtgattctcaaggatgggccggaacgcgtcatcctggccggccctatgcccgtgacagttgcgtccgctgcccagcggagaggacgcgtgggccggaatcataacaaagagggggaccagtacatctatatgggacagccccttaataacgatgaggaccacgcccactggaccgaagctaagatgctgctcgataatattaacacgcctgagggcatcattcccgccctgtttgaacctgagagagaaaagagcgcggccatcgacggggagtaccgcctgagaggagaggctcggaaaaccttcgtcgaactcatgcgcagaggcgatcttccggtgtggctgtcttataaggtcgcctccgaggggtttcaatacagcgaccggcgctggtgcttcgatggcgaaagaaataaccaggtgctggaggaaaatatggacgttgagatttggacaaaagagggagaacggaagaaactcagaccccgctggctggatgctcggacctattccgaccctcttgccctgagagagtttaaggaattcgctgccggccgccggtctgtgagcggggacctcatcctggagatcggaaaactgccccagcatctcacacagagagcgcaaaacgcccttgataatctggtgatgctgcacaactccgaacagggcgggcgggcttaccgccatgccatggaggagctccctgacaccattgaaacactgatgcttctggctctcatcgccgtcctgaccggaggcgttacgctgtttttcctctctggcagagggcttggaaagacaagcattggcctgctgtgtgtgatggcctccagcgtgctcctgtggatggcttctgtccagccccactggatcgcggcctccattatccttgagtttttcctgatggtgctcctgatcccggaacctgatcggcagcgcaccccccaagacaatcagctggcttatgttgtgattgggctcctttttatgatcctgaccgtcgccgccaacgagatgggactgctcgagacaaccaagaaagatctgggcattgggcacgtggctgtcgaaaaccatcaccatgccgcgatgcttgacgtggatctgcaccctgccagcgcttggacactctacgccgttgctacgaccatcattacacccatgatgagacataccatcgagaatacaaccgccaacatttctctgacggcgatcgccaatcaggctgccatcctgatgggactcgacaagggctggcctatttccaaaatggatatcggcgtgccccttctggctctggggtgctacagccaagtcaacccgctcaccctgacagccgctgtgcttatgctggttgcccactatgcgattatcggacctggcctccaggccaaggctacccgggaagcccagaaacgcacagctgccgggattatgaagaatcccaccgtggacggaatcgtcgccatcgatctggaccccgtggtgtacgatgcgaagttcgagaaacagctgggccaaattatgctccttatcctgtgtacgtctcagattctgctcatgagaacaacctgggctctgtgcgaaagcatcacacttgccaccgggcctctgaccacactctgggagggatccccgggcaagttttggaacacgaccattgctgtttctatggccaatatcttccggggcagctatctggccggggctggactggccttctccctcatgaaaagccttggcgggggacgcagaggcacaggggcgcagggagagaccctgggcgaaaagtggaaacggcagctgaaccaactctccaagtctgagtttaatacatacaagagaagcggcatcatggaagtcgaccgctccgaggccaaagaagggctgaagcggggagagaccacgaaacacgctgtgtctagaggcacagccaagcttcgctggttcgtggagcggaacctggtcaaacccgaagggaaggttattgacctcggatgtggcagagggggatggagctattactgcgctggcctgaagaaagtgaccgaggtgaagggctataccaaagggggacctggccatgaagagcccatccctatggccacatacgggtggaatctggtcaagctccactccggaaaagatgtgtttttcattccccctgaaaagtgtgacacccttctgtgcgatatcggcgagtctagcccgaaccccacaattgaggaagggcgcacgctgcgggttctcaaaatggtggagccttggctgagaggaaatcagttttgtatcaagattcttaacccctacatgccttccgtcgtggaaaccctggagcagatgcagcgcaagcatggcggcatgctcgttcggaatcccctgagcagaaactctacacacgagatgtattgggtgtcctgcgggaccggaaatatcgtcagcgcggtgaacatgacatctcgcatgctgctcaaccggttcaccatggcccacagaaaaccgacgtacgaacgcgacgtggatctgggcgctgggaccagacatgtcgccgttgagcctgaagtggctaatcttgacatcattggacaacggatcgagaacattaagcacgaacataaatccacatggcactatgatgaggacaatccctacaagacctgggcctatcatggcagctacgaggtgaaaccctctgggtccgctagctccatggtcaacggagtggttaagctgctcacaaagccttgggatgtgatccccatggtcacccagattgccatgacagacaccacgccttttggccagcaacgcgtgttcaaagaaaaggttgatacaagaaccccgaaagcgaagcggggcaccacacagatcatggaggtgacggccagatggctgtgggggtttcttagccggaataaaaagccccgcatctgtaccagagaagagttcacacggaaggtccgctctaacgctgccattggagctgtgtttgttgacgaaaatcagtggaacagcgccaaagaggccgtggaggacgaaagattctgggatctggtccaccgggagcgcgaactccacaagcagggcaaatgcgcgacctgcgtgtataatatgatggggaagagagagaaaaagctgggagaatttggcaaggctaaagggtcccgggccatctggtacatgtggctgggcgcccgcttcctcgagttcgaggctctgggatttatgaacgaagaccattggttctctagagagaatagcctttccggcgtcgaaggggagggactgcacaagctcggctacattctgcgggatatctctaaaattcctgggggaaacatgtatgccgacgatacagctggctgggacacccgcatcacagaggatgaccttcaaaatgaagccaagatcaccgatattatggagcccgaacatgcgctgctcgccaaagctatctttaagctgacgtaccagaacaaagtggttagagtgcagcggcctgccaagaatgggaccgtcatggacgtgattagccgcagagatcagcggggctccggacaagtgggcacatatgggctgaacaccttcacaaacatggaggctcagctcatcagacagatggaatctgagggaatttttagcccctccgagctggaaaccccgaatcttgccgagcgcgttctggactggctcgaaaagtacggcgtggagcggctgaaaagaatggcgatcagcggggatgactgtgtcgtgaagcctatcgacgatcgcttcgccacggctcttacagccctgaacgacatgggaaaagttcggaaggatattccccagtgggaaccttctaaaggctggaatgactggcaacaggtgcccttttgctcccaccacttccatcagctcatcatgaaggatgggagagagattgtcgtgccttgtcgcaaccaggacgagctggtcggccgggctagagtgagccaaggagccggctggtctctgcgcgaaaccgcttgcctcgggaagtcctatgcccagatgtggcagctgatgtactttcaccggagagatcttcgcctggcggccaatgctatctgtagcgccgttcccgtggactgggtcccgacatcccggaccacgtggtctattcatgcccaccatcaatggatgaccacagaggatatgctcagcgtgtggaacagagtttggatcgaagagaatccttggatggaagacaaaacccacatttccagctgggaggatgtgccctatctgggaaagcgggaggaccagtggtgcggctctcttatcgggctgacagctagagccacctgggcgacaaacatccaggtcgctattaatcaggtgcgccggctcatcggaaacgaaaattacctggactacatgacctccatgaaaagattcaagaacgagagcgatcccgaaggcgccctgtggtga

SEQ ID NO: 19429 - RNA, 9879 nt, synthetic construct
  misc_feature 1..9879: note = derived and/or modified CDS sequence (opt5) from DENV-1__KC762628__SS-prME
  source 1..9879: mol_type = other RNA
agcgtgaccatgctgctgatgctgcttcccaccgccctggctttccaccttacgaccagaggaggggagcctcatatgatcgtctccaagcaggaacggggaaagtctctgctttttaagacaagcgccggcgttaatatgtgcaccctgattgccatggacctcggggagctgtgtgaagataccatgacctacaagtgcccgcgcatcacagagaccgaacccgacgatgtggactgttggtgcaatgctacggagacctgggtgacatatggaacctgttcccagacaggcgagcacagacgggataagcgctctgtcgccctggcccctcatgtggggctcggactggaaaccagaacggagacatggatgagctccgaaggcgcttggcggcagattcagaaggttgagacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggaaccgggactttgttgagggactctccggcgctacgtgggtggatgtcgtgctggaacacgggagctgtgtgaccacaatggccaaggacaagcccaccctggatatcgagctcctgaagacagaagtcaccaatcctgctgttcttcgcaagctgtgcattgaggccaagatctctaacacgacaaccgactccagatgtccgacccaaggagaagcgacactcgtggaggagcaggataccaatttcgtgtgccggcgcacatttgtcgacagaggctggggcaacgggtgtggactgttcggcaaagggagccttattacgtgcgccaagtttaagtgcgtgaccaaactggaaggaaagatcgttcagtacgagaatctcaaatattctgtgatcgtcacagtgcacaccggcgatcagcatcaagttgggaacgaaacaaccgagcacggaacgaccgctacaattacaccccaggcccctacatccgaaatccagctgaccgactacggcgctctgacgctcgactgtagcccccggacaggcctggatttcaatgagatggtgcttctgaccatgaaggagaaatcttggctcgtccataagcagtggtttctggaccttcctctgccctggacatccggggccagcacctcccaagaaacctggaaccgccaggatctcctggtgacattcaaaacggcccacgctaagaagcaggaggtcgtggttctgggatctcaagaaggcgcgatgcacaccgccctcacaggggctaccgagattcagacaagcggaaccacgacaatctttgccggccatctgaaatgcagacttaagatggacaaactgaccctcaagggggtgtcctatgtcatgtgtaccggcagcttcaaactggaaaaggaggtggccgagacacagcacggaaccgttctggtgcaggtcaagtacgaaggcacagatgctccgtgcaaaattcctttctcttcccaagacgagaagggggtgacgcagaatggacggcttatcaccgccaaccccatcgtgacagataaagaaaagcctgttaatattgaggcggagccgccctttggcgaaagctatctcgtcgtgggggctggagagaaagccctgaagctgtcttggttcaagaaaggcagctccatcgggaagatgtttgaagccaccgctagaggcgcccgccggatggctattctcggagacacagcctgggatttcggctctatcgggggagtgtttaccagcgtcggcaaactgattcatcagatcttcgggacggcgtacggagtgctcttttccggcgttagctggaccatgaagatcgggattggcatcctgctcacatggctgggactgaactctagatccaccagcctttctatgacatgtattgccgtgggcatggtcaccctctacctgggggtgatggttcaggctgactccggatgcgtgatcaattggaaaggccgcgagctgaagtgtgggagcggaattttcgtcacaaacgaagtgcacacctggacggagcaatataagtttcaggccgattcccctaaacggctctctgctgccatcggcaaggcgtgggaggaaggggtttgcggcattagaagcgccacacgcctggagaacatcatgtggaaacagatctccaatgaacttaaccatattctgctcgagaatgacatgaagttcaccgtggtcgtgggagaagtgaacggcatcctggctcaggggaaaaagatgattcggccgcaacccatggagcacaaatactcttggaaaagctggggaaaggccaaagtcatcggcgctgacgttcagaataccacatttattatcgatgggcctaacacccccgagtgtcctgacaatcagagagcctggaacatctgggaagtggaggattatggattcggcatttttacgacaaatatctggctgaaacttcgcgactcctacacccaggtgtgcgatcaccggctcatgagcgccgctattaaagactctaaggcggtccatgccgatatgggctattggatcgaatccgagaaaaacgaaacatggaagctggctagagccagcttcattgaggtgaagacctgtatctggcccaaatctcacacactgtggtccaatggggttctcgagagcgaaatgatcattccgaagatctacggaggccctatttctcaacataactatcgccccgggtacttcacccagacggccggaccttggcacctgggcaaacttgagctggactttgaactctgcgaggggaccacagtggtcgtggatgagcactgcggaagccggggcccctccctgagaaccacaaccgttacgggcaagatcattcatgaatggtgttgccggagctgtacactgcctccccttcgcttcaaaggggaggacggatgctggtacggcatggaaatcagaccggtgaaggagaaggaagagaatctcgtcaaatctatggtgtccgctgggagcggagaggttgattccttttctctgggcctgctctgtatgagcatcatgattgaagaggtgatgcggtccagatggtctcgcaagatgctgatgaccgggacacttgccgtcttcctgctcctgaccatgggacagctgacctggaacgaccttatccggctgtgcattatggtgggcgcgaatgctagcgataaaatgggcatggggacaacgcacctcgccctgatggccacctttagaatgcgccctatgttcgctgtgggactcctgtttagacggcttacatcccgcgaagtcctgctcctgaccgttggcctgtctcttgtggccagcgtggagctgcccaactccctcgaagaactgggggacggactcgcgatgggcatcatgatgctgaaacttctgacagacttccaaagccatcagctctgggctgccctgctgtctcttacctttgtcaaaacgacactgtccctccactatgcctggaagaccatggctatgattctgagcatcgtgtctctcttccccctgtgtctttccaccacaagccagaagaccacatggctgcctgttctgctcgggtctctgggatgcaaaccgcttacgatgtttctgattaccgagaacaagatctggggcagaaaatcctggcccctcaatgaaggcatcatggccgtggggattgtcagcatcctgctctccagcctgcttaagaacgatgtgcctctggctggacccctgattgccggcgggatgctcatcgcgtgttacgttatttctggaagctccgccgacctgtctcttgagaaagctgccgaagtgagctgggaggaagaggctgagcattccggcgcctctcacaatatcctggtcgaagtgcaggatgacgggacaatgaagatcaaagatgaggaacgggacgataccctcacaattctgctcaaggccaccctgcttgctatcagcggagtctatcctatgtccattcccgcgacgctgttcgtgtggtacttttggcaaaagaaaaagcagcgctctggcgttctgtgggacacccctagccctcccgaggtggagagagccgtcctcgatgacggcatctatcggattctgcagcgcgggcttctgggaaaatcccaggtgggcgttggggtgttccaagaaggagtcttccacacaatgtggcatgtgaccagaggcgctgtgctcatgtaccaggggaagcggctggagcccagctgggcctctgttaaaaaggatctcatctcctatggaggcggctggcgctttcaggggagctggaacacaggagaagaggtccaggtgatcgccgtggaacccggcaagaatcctaaaaacgtccaaaccgctcccgggacattcaagacgccggagggagaggtgggcgccattgcgctggactttaaacctgggacctctggatcccccatcgttaatagagaaggcaagattgtgggcctttacgggaacggagtcgtgacaaccagcggcacctacgtttccgctatcgcccaggccaaggcttctcaggaggggcctctgcccgaaattgaggatgaagtgttccggaagagaaatctgacaatcatggacctccaccccggaagcggcaagacgcgccggtatctgcctgccattgtcagagaggcgatcaaacgcaaacttcggaccctggtgctcgctccgacaagagttgtggcctccgagatggccgaagctctgaaagggatgcccatccgctaccaaaccacagccgtcaagagcgagcataccggcaaagaaattgtggacctgatgtgccacgctacgtttacaatgcggctcctttctcctgtgagagtccccaactataatatgatcattatggatgaggcccatttcaccgaccctgcgtccatcgccgctcgcggatacattagcacccgggttggcatgggggaagccgctgccatctttatgacagccacaccccctggatctatcgaggctttcccgcagagcaacgcggccattcaggatgaggaaagagacatccccgagcggtcctggaactctggctatgattggattacagactttcctgggaagaccgtgtggttcgtgcccagcatcaagtccggaaacgatattgctaattgtctgcgcaaaaacggcaagagagtcatccagctgtctcggaaaacgtttgacacagaataccaaaagaccaaaaacaatgattgggactatgtggttacaaccgatatcagcgagatgggggccaacttccgcgccgacagagtgattgaccctcggagatgcctcaagcccgtcatcctgaaggatggcccggagcgcgtgattcttgctggacctatgcccgttacggtggcctccgcggctcagcggagaggccgcatcgggcggaatcagaacaaagaaggagaccagtacatttacatgggccaacccctgaataacgatgaggaccacgcccactggaccgaagccaagatgctcctggataatatcaacacacctgaggggattatccccgctctgttcgaacctgagagagagaaaagcgccgcgatcgacggagaatatcgcctccggggcgaggccagaaagacctttgtcgaacttatgcgcagaggggatctgccggtgtggctgtcttacaaagtcgcttccgagggcttccagtatagcgaccggcgctggtgctttgatggagaaagaaataaccaggtgctcgaggagaatatggacgttgaaatttggacaaaggagggcgaacggaaaaagctgcgccccagatggcttgatgcccggacctactccgaccctctggctctcagagagttcaaggaatttgccgctgggcgccggtctgtgagcggagatctgatcctggagattggcaaactcccccagcatcttacacaaagagcccagaacgcgctggacaatctggtgatgctccacaactccgagcaagggggaaaggcctatcgccatgctatggaagaactgcctgacaccatcgaaacgcttatgctgctcgccctgattgctgtcctgacaggcggcgttaccctcttctttctttctgggcggggactgggcaaaaccagcatcgggctgctctgtgtgatggcctccagcgccctgctttggatggcttctgtggagccccactggatcgcggcctccattatcctggagttctttctcatggtcctgctgattccggaacctgatagacagcggacaccccaagacaatcagctcgcttacgtggttatcggacttctgttcatgattctgaccgtggccgccaacgagatgggcctcctggaaacaacgaagaaagatcttgggatcggacacgctgccgcggagaaccatcaccatgccgctatgctggacgtcgatctccaccctgccagcgcttggaccctgtatgccgtggcgacaaccatcattacacccatgatgcgccataccatcgaaaatacgaccgccaacatttctctgacagctatcgccaatcaggctgccattctcatgggccttgacaagggctggcctatctccaagatggatattggggtccccctgctggctctcggatgctacagccaagtgaacccgctgacccttacagccgcggttctgatgctcgtggcccactacgctatcatcggccctgggctgcaggccaaagctaccagagaggcccagaagcggacggccgcgggaattatgaaaaatcccacagtcgacggcatcgtggctattgatctggaccccgttgtgtatgatgccaagtttgagaaacagctcgggcaaatcatgcttctgattctgtgtacctctcagatcctcctgatgcgcacaacctgggctctttgcgaaagcatcaccctggccacaggacctctcacgaccctgtgggagggctccccgggcaagttctggaacacaaccattgccgtctctatggctaatatctttagagggagctacctggccggagcgggcctcgccttctcccttatgaaaagcctcgggggaggccggcgcgggacaggagctcagggcgaaaccctgggcgagaaatggaagagacagctcaaccaactgtccaaatctgagttcaatacgtataagcggagcgggattatggaggtggaccgctccgaggccaaagaaggacttaagagaggcgagacaaccaagcacgctgtgtctcgggggaccgccaaactgagatggtttgttgaacgcaacctcgtcaagcccgagggaaaagtgatcgatctgggctgtgggcggggaggctggagctactattgcgcgggcctgaagaaagtgacagaagtcaaggggtacaccaaaggaggccctgggcatgaggagcccattcctatggccacatatggatggaatctcgttaaacttcactccggcaaggacgtgttctttacgccccctgaaaaatgtgacaccctgctgtgcgatatcggggagtctagcccgaaccccacaatcgaagagggaagaaccctccgcgtgctgcggatggtcgagccttggcttagaggcaatcagttctgtattaaggtgctgaacccctacatgccttccgttatcgaaacactcgagcagatgcagcgcaaacatggcgggatgctggtgcggaatcccctgagcagaaactctacccacgaaatgtactgggtctcctgcggaacgggcaatattgtgagcgctgttaacatgacctctcgcatgctcctgaaccggtttacaatggcccacagaaagccgacctatgagcgcgacgtggatcttggggctggaacacggcatgtcgccgtggaacctgaggtggctaatctggacatcattggccaaagaatcgagaacattaaaaatgaacacaagtccacctggcattacgatgaggacaacccctataagacatgggcctaccacgggagctatgaagtcaaaccctctggatccgcgagctccatggttaatggcgtggtgcgcctcctgaccaagccttgggatgtcatccccatggtgacgcagatcgccatgacagacaccacccctttcggccagcaaagagtttttaaagagaaggtggatacacggacgccgaaagctaagcgcgggaccgcccagattatggaagtcacagctagatggctttggggattcctgagccggaacaagaaacccagaatctgtacccgggaggagtttacacgcaaggtgagatctaatgccgccattggcgcggttttcgtggacgaaaaccagtggaatagcgctaaagaggccgtcgaagatgagcggttttgggacctcgtgcatcgcgaaagagagctgcacaagcaggggaaatgcgcgacctgcgtttacaacatgatgggaaagcgggagaagaaactgggcgagttcgggaaggctaaaggctcccgcgccatctggtatatgtggctcggagctagatttctggagttcgaagcccttggcttcatgaatgaggaccactggttttctcgggagaacagcctgtccggggtggaaggagagggcctccataagctggggtacattcttcgcgatatctctaaaatccctggaggcaatatgtacgcggacgatacagccgggtgggacaccagaattacggaagatgacctgcaaaacgaggctaagatcaccgatattatggaacccgagcacgccctcctggctacaagcatcttcaaactgacctatcagaataaggtcgtgcgggtccagcgccctgccaagaacggcacagtgatggacgttatttccagacgggatcagcgcggatctggccaagtggggacctacggactcaacacgtttacaaatatggaggcgcagctgatcagacagatggaaagcgagggcatcttcaccccctccgaacttgagacaccgaacctggccgaacgggtcctcgactggctggagaaacatgggattgagagacttaagcgcatggctatcagcggagatgactgtgtggtgaaacctattgatgaccggtttgccaccgctctgacggccctcaatgacatgggcaaggttagaaaagatatcccccagtgggaaccttctaaggggtggaacgactggcaacaggtgcccttctgctcccaccactttcatcagctgattatgaaggatggccgcgagatcgtcgtgccttgtcggaatcaggacgaactggttggcagagctcgcgtgagccaaggcgccgggtggtctctccgggagaccgcgtgcctgggaaaatcctatgcccagatgtggcagcttatgtacttccacagacgcgatctgcggctcgctgccaacgccatctgtagcgctgtccccgtggactgggtcccgacatccagaaccacatggtctattcatgcccaccatcaatggatgaccacagaagatatgctgagcgtgtggaatcgcgtttggatcgaggagaacccttggatggaagacaagacccacgtgtccagctgggaggatgtcccctatcttggcaaacgggaagaccagtggtgcgggtctctgattggactcacggcgagagctacatgggccaccaatatccaggtggccattaaccaggttcggagactgatcggcaatgagaactacctggattatatgacctccatgaagcgctttaaaaatgagagcgaccccgaaggggctctctggtga

SEQ ID NO: 19430 - RNA, 9879 nt, synthetic construct
  misc_feature 1..9879: note = derived and/or modified CDS sequence (opt5) from DENV-1__KC762624__SS-prME
  source 1..9879: mol_type = other RNA
agcgtgacaatgctgctcatgctgatgcccacagcccttgctttccacctgacgacccggggaggggaacctcatatgatcgtctccaagcaggaacggggaaaatctctcctgtttaagacaagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcgtgcatcagattttcgggaccgcttacggagtgctgttttccggcgtcagctggacgatgaagatcgggattggcgtgcttctgacctggctcggactcaattctagatccacaagcctgtctatgacctgtatcgccgttggccttgtgacactctacctgggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacgacatgaagttcacagttgtggtcggagatgtggctggcattctggcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaaacttcgcgattcctacacacaggtttgcgaccaccggctcatgagcgccgctattaaagattctaaggccgtgcatgccgacatgggctattggatcgaatccgagaaaaatgaaacctggaagctggctagagccagcttcatcgaggtgaagacatgtatttggcccaaatctcacaccctgtggtccaacggggtcctcgaaagcgagatgatcattccgaagatctacggaggccctacatctcaacataattatcgccccgggtacttcacccagacggcgggaccttggcacctgggcaaacttgagctggattttgacctctgcgaagggaccacagtggttgtggatgagcactgcggaaaccggggccccagcctgagaaccacaaccgtcacgggcaagattatccatgaatggtgttgccggtcctgtacactgcctccccttcgcttcagaggggaggacggatgctggtacggcatggagatccggccggtgaaagaaaaggaggaaaatctcgttaagagcatggtgtctgctgggtccggagaggtcgacagcttttccctgggcctgctctgtatttctatcatgattgaagaggtgatgagaagccgctggtcccggaaaatgctgatgaccgggacacttgccgttttctttctgctcatcatgggacagctgacctggaacgatctgattagactttgcatcatggtgggcgccaatgcttctgaccgcatgggcatggggaccacatatctggccctcatggcgacgttcaagatgagacctatgtttgctgtcggactgctgttccggcgcctgaccagcagagaggtgcttctgctcacaattggcctgtccctggtggcctctgtcgaacttcccaacagcctggaggaactcggggatggactggccatgggcatcatgatcctcaaactgcttaccgactttcaatcccaccagctgtgggctacactcctgagcctgaccttcattaagacgacattttctcttcattacgcctggaaaaccatggctatggttctgtccatcgtgagcctcttccccctgtgtctctctaccacatcccagaagaccacatggctgcctgtgcttctggggagcctgggatgcaagccgctcacgatgtttctgattgccgagaataaaatctggggccggaagtcttggccccttaacgaaggcattatggcggtcgggatcgtgtccatcctgctcagctccctgctcaaaaacgatgttcctctggccggaccccttattgctggcgggatgctgatcgcctgttatgtgattagcggatctagcgctgacctgtccctcgagaaggccgccgaggtctcttgggaagaggaagctgagcacagcggcgcgtcccataatatcctggtggaagttcaggatgacgggaccatgaaaattaaggatgaggagcgcgacgatacacttaccatcctgctcaaagccacactgctcgctgtgtctggagtctaccctctgagcatccccgccacccttttcgtgtggtatttctggcaaaagaagaaacagagatccggcgtcctgtgggacacgccttctcccccggaagtggagcgggccgttctggatgacggcatttaccgcatcatgcagagagggctcctgggacggagccaggtgggcgtcggggtgtttcaagaaaacgttttccacaccatgtggcacgtgacacgcggagctgtccttatgtatcagggcaagagactggagccttcctgggccagcgtgaaaaaggacctcatttcttacgggggaggctggcggctgcagggctcctggaataccggggaggaagtgcaggttatcgcggtcgagcccggcaagaaccctaagaatgtgcaaacagctcccggcacctttaagacaccggaaggggaggtgggagccattgccctcgatttcaaacctggcacgagcgggtctcccatcgtcaacagagaaggaaagattgtgggcctgtacggcaatggggttgtgaccacatccggaacctatgtcagcgctatcgcccaggcgaaggcttcccaggagggccctcttcccgagatcgaagacgaggtgtttcgcaagcggaacctgaccattatggatctgcatcccgggtctggaaaaacaagacgctacctccctgccatcgttcgggaagccattaagagaaagctgcgcacgcttatcctggctccgacccgggtggtcgccagcgagatggctgaagccctcaaaggcatgcccattagatatcaaacaaccgcggtgaagtccgagcacacagggaaagagatcgttgacctgatgtgccatgccaccttcacgatgcgcctgctcagccctgtgcgggtccccaattacaacatgatcattatggatgaagctcactttacagacccttcttccatcgccgctagaggctatattagcacccgggtgggaatgggcgaggccgccgctatcttcatgaccgcgacaccccctgggtctgtggaagcctttccgcagagcaatgctgtcattcaggatgaggaacgcgacatccccgagagatcctggaactctggatacgagtggatcaccgatttccctggcaagacagtttggtttgtgcccagcattaaatccgggaatgacatcgccaactgtcttcggaagaatggaaagcgcgtgattcagctgtctagaaaaaccttcgatacggaatatcaaaagaccaagaacaacgactgggactacgtcgtgaccacagatatcagcgagatgggcgccaatttccgggctgacagagttattgatcctcgccggtgcctgaagcccgtgatcctcaaagacgggccggaaagagtcattctggccggccctatgcccgtgaccgttgcgtccgctgcccagcgccggggaagagtgggccgcaaccataataaggagggggatcagtacatctatatgggacagccccttaacaatgacgaggatcacgcccactggacggaagctaagatgctgctcgacaacatcaatacccctgagggcattatccccgccctgtttgaacctgagcgggagaaaagcgcggccattgatggggagtacagactgcgcggagaggctagaaagacattcgtcgaactcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatctggaccaaggagggagaacgcaaaaagctccggcccagatggctggacgctcgcacatattccgaccctcttgccctgcgggagtttaaagagttcgctgccggcagacgctctgtgagcggggatctcattctggagatcggaaagctgccccagcatctcacccagcgggcgcaaaatgcccttgacaacctggtgatgctgcacaattccgaacagggcgggagagcttaccggcatgccatggaggagctccctgatacaatcgaaaccctgatgcttctggctctcattgccgtcctgacgggaggcgttacactgtttttcctctctggccgcgggcttggaaagaccagcatcggcctgctgtgtgtgatggcctccagcgtgctcctgtggatggcttctgtcgagccccactggattgcggcctccatcattcttgaatttttcctgatggtgctcctgatcccggagcctgacagacagcggacaccccaggataaccaactggcttatgttgtgatcgggctcctttttatgattctgacagtcgccgccaatgagatgggactgctcgaaaccaccaaaaaggacctgggcatcgggcacgtggctgtcgagaaccatcaccatgccgcgatgcttgatgtggacctgcaccctgccagcgcttggacgctctacgccgttgctaccacaattatcacccccatgatgcgccatacaattgaaaacaccacggccaatatctctctgaccgcgattgccaaccaggctgccatcctgatgggactcgataaaggctggcctatctccaagatggacattggcgtgccccttctggctctggggtgctacagccaggtcaatccgctcacactgaccgccgctgtgcttatgctggttgcccactatgcgatcattggacctggcctccaagccaaagctacaagagaggcccagaagcggaccgctgccgggatcatgaagaaccccacggtggatggaattgtcgccatcgacctggatcccgtggtgtacgacgcgaaattcgaaaagcagctgggccagatcatgctccttattctgtgtacatctcaaatcctgctcatgcgcaccacatgggctctgtgcgagagcattacccttgccaccgggcctctgacaacgctctgggagggatccccgggcaaattttggaataccacaatcgctgtttctatggccaacattttcagaggcagctatctggccggggctggactggccttctccctcatgaaaagccttggcgggggacggcgcggcaccggggcgcagggagaaacactgggcgagaaatggaagagacagctgaatcagctctccaagtctgaatttaacacctacaaacggagcggcatcatggaggtcgacagatccgaagccaaggaggggctgaaacgcggagagacgacaaagcacgctgtgtctcggggcaccgccaaacttagatggttcgtggaacgcaatctggtcaagcccgaggggaaggttatcgatctcggatgtggcagagggggatggagctattactgcgctggcctgaaaaaggtgaccgaagtgaaaggctatacaaaagggggacctggccatgaggaacccattcctatggccacctacgggtggaacctggtcaaactccactccggaaaggacgtgtttttcattccccctgagaaatgtgatacacttctgtgcgacatcggcgagtctagcccgaatcccacgatcgaagaggggagaaccctgcgcgttctcaagatggtggaaccttggctgcggggaaaccaattttgtattaagatccttaatccctacatgccttccgtcgtggagacactggagcagatgcagagaaaacatggcggcatgctcgttcgcaaccccctgagcagaaattctacccacgaaatgtattgggtgtcctgcgggacaggaaacattgtcagcgcggtgaatatgacctctagaatgctgctcaaccgcttcacgatggcccaccggaagccgacctacgagagagatgtggacctgggcgctgggacacgccatgtcgccgttgaacctgaggtggctaaccttgatatcatcggacagagaattgaaaatatcaaacacgagcataagtccacctggcactatgacgaggataacccctacaaaacatgggcctatcatggcagctacgaagtgaagccctctgggtccgctagctccatggtcaatggagtggttaagctgctcaccaaaccttgggacgtgattcccatggtcacacaaatcgccatgaccgatacgacaccttttggccagcagcgggtgttcaaggagaaagttgacacccgcaccccgaaggcgaaaagaggcacaacgcaaattatggaagtgaccgcccggtggctgtgggggtttcttagcagaaacaagaagccccggatctgtacacgcgaggagttcaccagaaaagtccggtctaatgctgccatcggagctgtgtttgttgacgagaaccagtggaatagcgccaaggaggccgtggaagatgagcgcttctgggacctggtccacagagaacgggagctccacaaacagggcaagtgcgcgacatgcgtgtataacatgatggggaaacgcgaaaagaagctgggagagtttggcaaagctaaggggtccagagccatttggtacatgtggctgggcgcccggttcctcgagttcgaagctctgggatttatgaatgaggatcattggttctctcgcgaaaacagcctttccggcgtcgagggggagggactgcacaaactcggctacatcctgagagacatttctaagatccctgggggaaatatgtatgccgatgacaccgctggctgggatacacggattaccgaagacgatcttcagaacgaggccaaaatcacggacatcatggaacccgagcatgcgctgctcgccaaggctatttttaaactgacctaccaaaataaggtggttcgcgtgcagagacctgccaagaacgggacagtcatggatgtgatcagccggcgcgaccagagaggctccggacaggtgggcacctatgggctgaatacattcaccaacatggaagctcaactcattcggcagatggagtctgagggaatctttagcccctccgaactggagacgccgaaccttgccgaaagagttctggattggctcgagaaatacggcgtggaacgcctgaagcggatggcgattagcggggacgactgtgtcgtgaaacctatcgatgacagattcgccacagctcttaccgccctgaatgatatgggaaaggttcgcaaagacatcccccagtgggagccttctaagggctggaacgattggcagcaagtgcccttttgctcccaccacttccatcagctcattatgaaggacgggcgggagatcgtcgtgccttgtagaaatcaggatgaactggtcggccgcgctcgggtgagccagggagccggctggtctctgagagagacagcttgcctcgggaaatcctatgcccaaatgtggcagctgatgtactttcaccgccgggaccttagactggcggccaacgctatttgtagcgccgttcccgtggattgggtcccgacctcccgcacgacctggtctatccatgcccaccatcagtggatgacaaccgaagacatgctcagcgtgtggaatcgggtttggattgaggaaaacccttggatggaggataagacacacgtgtccagctgggaggacgtcccctatctgggaaaaagagaagaccaatggtgcggctctcttatcgggctgaccgctcgggccacatgggcgaccaatattcaggtggctatcaaccaggtgagacgcctcatcggaaatgagaactacctggattacatgacgtccatgaagcggttcaaaaatgaaagcgaccccgagggcgccctgtggtga

SEQ ID NO: 19431 - RNA, 9879 nt, synthetic construct
  misc_feature 1..9879: note = derived and/or modified CDS sequence (opt5) from DENV-1__KC762644__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagaccagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcgtgcatcagattttcgggaccgcttacggagtgctgttttccggcgtcagctggacgatgaagatcgggattggcgtgcttctgacctggctcggactcaattctagatccacaagcctgtctatgacctgtatcgccgttggccttgtgacactctacctgggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacgacatgaagttcacagttgtggtcggagatgtggctggcattctggcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaaacttcgcgattcctacacacaggtttgcgaccaccggctcatgagcgccgctattaaagattctaaggccgtgcatgccgacatgggctattggatcgaatccgagaaaaatgaaacctggaagctggctagagccagcttcatcgaggtgaagacatgtatttggcccaaatctcacaccctgtggtccaacggggtcctcgaaagcgagatgatcattccgaagatctacggaggccctatttctcaacataattatcgccccgggtacttcacacagaccgcgggaccttggcacctgggcaaacttgagctggattttgacctctgcgaagggacgaccgtggttgtggatgagcactgcggaaaccggggccccagcctgagaacaaccacagtcaccggcaagatcatccatgaatggtgttgccggtcctgtacgctgcctccccttcgcttcagaggggaggacggatgctggtacggcatggagattcggccggtgaaagaaaaggaggaaaatctcgttaagagcatggtgtctgctgggtccggagaggtcgacagcttttccctgggcctgctctgtatctctattatgatcgaagaggtgatgagaagccgctggtcccggaaaatgctgatgacagggacccttgccgttttctttctgctcattatgggacagctgacatggaacgatctgatcagactttgcattatggtgggcgccaatgcttctgaccgcatgggcatggggaccacctatctggccctcatggcgacattcaagatgagacctatgtttgctgtcggactgctgttccggcgcctgacgagcagagaggtgcttctgctcaccatcggcctgtccctggtggcctctgtcgaacttcccaacagcctggaggaactcggggatggactggccatgggcatcatgattctcaaactgcttacagactttcaatcccaccagctgtgggctaccctcctgagcctgacattcatcaagaccacgttttctcttcattacgcctggaaaacaatggctatggttctgtccattgtgagcctcttccccctgtgtctctctaccacctcccagaagacaacctggctgcctgtgcttctggggagcctgggatgcaagccgctcacaatgtttctgatcgccgagaataaaatttggggccggaagtcttggccccttaacgaaggcatcatggcggtcgggatcgtgtccattctgctcagctccctgctcaaaaacgatgttcctctggccggaccccttatcgctggcgggatgctgattgcctgttatgtgatcagcggatctagcgctgacctgtccctcgagaaggccgccgaggtctcttgggaagaggaagctgagcacagcggcgcgtcccataatattctggtggaagttcaggatgacgggacgatgaaaatcaaggatgaggagcgcgacgatacccttacaatcctgctcaaagccaccctgctcgctgtgtctggagtctaccctctgagcattcccgccacacttttcgtgtggtatttctggcaaaagaagaaacagagatccggcgtcctgtgggacaccccttctcccccggaagtggagcgggccgttctggatgacggcatctaccgcattatgcagagagggctcctgggacggagccaggtgggcgtcggggtgtttcaagaaaacgttttccacacgatgtggcacgtgacccgcggagctgtccttatgtatcagggcaagagactggagccttcctgggccagcgtgaaaaaggacctcatctcttacgggggaggctggcggctgcagggctcctggaatacaggggaggaagtgcaggttattgcggtcgagcccggcaagaaccctaagaatgtgcaaaccgctcccggcacatttaagaccccggaaggggaggtgggagccatcgccctcgatttcaaacctggcacaagcgggtctcccattgtcaacagagaaggaaagatcgtgggcctgtacggcaatggggttgtgacgacctccggaacatatgtcagcgctatcgcccaggcgaaggcttcccaggagggccctcttcccgagattgaagacgaggtgtttcgcaagcggaacctgaccatcatggatctgcatcccgggtctggaaaaaccagacgctacctccctgccattgttcgggaagccatcaagagaaagctgcgcacacttattctggctccgacgcgggtggtcgccagcgagatggctgaagccctcaaaggcatgcccatcagatatcaaaccacagcggtgaagtccgagcacaccgggaaagagatcgttgacctgatgtgccatgccacattcaccatgcgcctgctcagccctgtgcgggtccccaattacaacatgattatcatggatgaagctcactttacggacccttcttccattgccgctagaggctatatcagcacacgggtgggaatgggcgaggccgccgctattttcatgaccgcgacaccccctgggtctgtggaagcctttccgcagagcaatgctgtcatccaggatgaggaacgcgacatccccgagagatcctggaactctggatacgagtggattacagatttccctggcaagaccgtttggtttgtgcccagcatcaaatccgggaatgacattgccaactgtcttcggaagaatggaaagcgcgtgatccagctgtctagaaaaacattcgataccgaatatcaaaagacgaaaaacaacgactgggactacgtcgtgacaaccgatattagcgagatgggcgccaatttccgggctgacagagttatcgatcctcgccggtgcctgaagcccgtgattctcaaagacgggccggaaagagtcatcctggccggccctatgcccgtgacagttgcgtccgctgcccagcgccggggaagagtgggccgcaaccataataaggagggggatcagtacatctatatgggacagccccttaacaatgacgaggatcacgcccactggaccgaagctaagatgctgctcgacaacattaatacgcctgagggcatcattcccgccctgtttgaacctgagcgggaaaagagcgcggccatcgatggggagtacagactgcgcggagaggctagaaagaccttcgtcgagctcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatttggacaaaggagggagaacgcaaaaagctccggcccagatggctggacgctcgcacctattccgaccctcttgccctgcgggagtttaaagagttcgctgccggcagacgctctgtgagcggggatctcatcctggagatcggaaagctgccccagcatctcacacagcgggcgcaaaatgcccttgacaacctggtgatgctgcacaattccgaacagggcgggagagcttaccggcatgccatggaggagctccctgataccattgaaacactgatgcttctggctctcatcgccgtcctgaccggaggcgttacgctgtttttcctctctggccgcgggcttggaaagacaagcattggcctgctgtgtgtgatggcctccagcgtgctcctgtggatggcttctgtcgagccccactggatcgcggcctccattatccttgaatttttcctgatggtgctcctgatcccggagcctgacagacagcggacaccccaggataaccaactggcttatgttgtgattgggctcctttttatgatcctgaccgtcgccgccaatgagatgggactgctcgaaacaaccaaaaaggacctgggcattgggcacgtggctgtcgagaaccatcaccatgccgcgatgcttgatgtggacctgcaccctgccagcgcttggacactctacgccgttgctacgaccatcattacacccatgatgcgccataccatcgaaaacacaaccgccaatatttctctgacggcgatcgccaaccaggctgccatcctgatgggactcgataaaggctggcctatttccaagatggacatcggcgtgccccttctggctctggggtgctacagccaggtcaatccgctcaccctgacagccgctgtgcttatgctggttgcccactatgcgattatcggacctggcctccaagccaaagctaccagagaggcccagaagcggacagctgccgggattatgaagaaccccaccgtggatggaatcgtcgccatcgacctggatcccgtggtgtacgacgcgaaattcgaaaagcagctgggccagattatgctccttatcctgtgtacgtctcaaattctgctcatgcgcacaacctgggctctgtgcgagagcatcacacttgccaccgggcctctgaccacactctgggagggatccccgggcaaattttggaatacgaccattgctgtttctatggccaacatcttcagaggcagctatctggccggggctggactggccttctccctcatgaaaagccttggcgggggacggcgcggcacaggggcgcagggagaaaccctgggcgagaaatggaagagacagctgaatcagctctccaagtctgaatttaacacatacaaacggagcggcatcatggaggtcgacagatccgaagccaaggaggggctgaaacgcggagagaccacgaagcacgctgtgtctcggggcacagccaaacttagatggttcgtggaacgcaatctggtcaagcccgaggggaaggttattgatctcggatgtggcagagggggatggagctattactgcgctggcctgaaaaaggtgaccgaagtgaaaggctataccaaagggggacctggccatgaggaacccatccctatggccacatacgggtggaacctggtcaaactccactccggaaaggacgtgtttttcattccccctgagaaatgtgatacccttctgtgcgacatcggcgagtctagcccgaatcccacaattgaagaggggagaacgctgcgcgttctcaagatggtggaaccttggctgcggggaaaccaattttgtatcaagattcttaatccctacatgccttccgtcgtggagaccctggagcagatgcagagaaaacatggcggcatgctcgttcgcaaccccctgagcagaaattctacacacgaaatgtattgggtgtcctgcgggaccggaaacatcgtcagcgcggtgaatatgacatctagaatgctgctcaaccgcttcaccatggcccaccggaagccgacgtacgagagagatgtggacctgggcgctgggacccgccatgtcgccgttgaacctgaggtggctaaccttgatatcattggacagagaatcgaaaatattaaacacgagcataagtccacatggcactatgacgaggataacccctacaaaacctgggcctatcatggcagctacgaagtgaagccctctgggtccgctagctccatggtcaatggagtggttaagctgctcacaaaaccttgggacgtgatccccatggtcacccaaattgccatgacagataccacgccttttggccagcagcgggtgttcaaggagaaagttgacacacgcaccccgaaggcgaaaagaggcaccacacaaatcatggaagtgacggcccggtggctgtgggggtttcttagcagaaacaagaagccccggatctgtacccgcgaggagttcacaagaaaagtccggtctaatgctgccattggagctgtgtttgttgacgagaaccagtggaatagcgccaaggaggccgtggaagatgagcgcttctgggacctggtccacagagaacgggagctccacaaacagggcaagtgcgcgacctgcgtgtataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgtcgagggggagggactgcacaaactcggctacattctgagagacatctctaagattcctgggggaaatatgtatgccgatgacacagctggctgggatacccggatcacagaagacgatcttcagaacgaggccaaaatcaccgacattatggaacccgagcatgcgctgctcgccaaggctatctttgaactgacgtaccaaaataaagtggttcgcgtgcagagacctgccaagaacgggaccgtcatggatgtgattagccggcgcgaccagagaggctccggacaggtgggcacatatgggctgaataccttcacaaacatggaggctcaactcatccggcagatggagtctgaaggaatttttagcccctccgagctggaaaccccgaaccttgccgagagagttctggattggctcgaaaagtacggcgtggagcgcctgaaacggatggcgatcagcggggacgactgtgtcgtgaagcctatcgatgacagattcgccacggctcttacagccctgaatgatatgggaaaagttcgcaaggacattccccagtgggagccttctaaaggctggaacgattggcagcaagtgcccttttgctcccaccacttccatcagctcatcatgaaggacgggcgggaaattgtcgtgccttgtagaaatcaggatgagctggtcggccgcgctcgggtgagccagggagccggctggtctctgagagaaaccgcttgcctcgggaagtcctatgcccaaatgtggcagctgatgtactttcaccgccgggaccttagactggcggccaacgctatctgtagcgccgttcccgtggattgggtcccgacatcccgcaccacgtggtctattcatgcccaccatcagtggatgaccacagaggacatgctcagcgtgtggaatcgggtttggatcgaagagaacccttggatggaggataaaacccacatttccagctgggaagacgtgccctatctgggaaagagagaggaccaatggtgcggctctcttatcgggctgacagctcgggccacctgggcgacaaatatccaggtcgctattaaccaggtgagacgcctcatcggaaatgaaaactacctggattacatgacctccatgaaacggttcaagaatgagagcgaccccgagggcgccctgtggtga

SEQ ID NO: 19432 - RNA, 9879 nt, synthetic construct
  misc_feature 1..9879: note = derived and/or modified CDS sequence (opt5) from DENV-1__KC762630__SS-prME
  source 1..9879: mol_type = other RNA
agcgtgaccgtcctgttcatgctcctgcccacagcccttgcttttcacctgacgaccagaggcggggagcctcatatgatcgtttccaagcaggaacggggaaaatctctcctgttcaagacaagcgccggcgtgaacatgtgcacccttattgcgatggacctgggggagctctgtgaagatacaatgacctacaaatgcccgcgcatcacagagaccgaacccgacgatgtggactgttggtgcaatgctacggagacctgggtcacatatggaacctgttcccaaacaggcgagcacagacgggataagcgctctgtggccctggcccctcatgttgggctgggactcgaaaccagaacggagacatggatgagctccgaaggcgcttggaaacagattcagaaggtggagacctgggccctgcggcaccccggctttacagtcatcgctcttttcctggcccatgcgattgggacctctatcacccagaagggaatcatttttatcctcctgatgcttgtgacacctagcatggccatgcgctgcgttggcattgggaacagagacttcgtggagggactgtccggcgctacgtgggtcgatgtggtgctcgaacacgggagctgtgtcaccacaatggccaaaaataagcccaccctggacatcgagctgctcaaaacagaagttaccaaccctgctattctgcggaagctttgcatcgaggccaaaatttctaatacgacaaccgattcccgctgtccgacccaaggagaagcgacactggtggaggagcaggacaccaactttgtgtgcagacggacattcgtcgatcgcggctggggcaatgggtgtggactctttggcaaggggagcctgatcacgtgcgccaagttcaaatgcgtgaccaagcttgaaggaaaaatcgttcagtacgagaacctgaagtattctgtgattgtcacagtgcacaccggcgaccagcatcaagttgggaatgaaacaaccgagcacggaacgaccgctatcattacaccccaggcccctacctccgaaatccagctcacagattacggcgctctgaccctggactgtagccccagaacgggcctcgactttaacgagatggtgctgcttacaatgaaagagaagtcttggctggtccataaacagtggttcctcgatctgcctcttccctggacctccggggccagcacatcccaagaaacctggaatcggcaggacctgctcgtgacctttaagacagcccacgctaagaaacaggaggtcgtggttctgggatctcaagaaggcgcgatgcacacggccctgaccggggctacagagattcagaccagcggaacaaccacgatcttcgccggccatctcaagtgccgcctgaaaatggataagcttacactgaaaggggtgtcctatgtcatgtgtaccggcagcttcaagctcgaaaaggaggtggccgagacccagcacggaacagttctggtgcaggtcaaatacgaaggcaccgacgctccgtgcaagatccctttttcttcccaagatgagaaaggggtgattcagaacggaagactgatcacagccaatcccattgtgacggacaaggaaaaacctgttaacatcgaggcggagccccccttcggcgaaagctatattgtcgtgggggctggagagaaggcccttaagctctcttggtttaaaaagggcagctccatcgggaaaatgttcgaagccaccgctcggggcgccagacgcatggctatcctgggagatacagcctgggactttggctctattgggggagtgttcaccagcgtcggcaagctggtgcatcagatctttgggacagcgtacggagttctcttctccggcgtgagctggaccatgaaaattgggatcggcattctgcttacgtggctgggactcaattctcggtccaccagcctgtctatgacatgtatcgccgtcggcatggtgaccctgtaccttggggttatggtgcaggctgattccggatgcgtcattaactggaagggcagagagctcaagtgtgggagcggaatctttgtgacaaacgaagttcacacctggacagagcaatataaattccaggccgactcccctaagcgcctgtctgctgccatcggcaaagcgtgggaggaaggggtgtgcggcattcggagcgccaccagactggagaatatcatgtggaagcagatttccaacgaactcaatcatatcctgcttgagaacgatatgaaatttacggtcgtggtgggagacgtctctggcattctggctcaggggaagaaaatgatccgcccgcaacccatggaacacaagtacagctggaagtcctggggaaaagccaagatcattggcgctgacgttcagaatacaaccttcatcattgatgggcctaacacccccgagtgtcctgacaatcagcgggcctggaacatctgggaggtggaagattatggatttggcattttcacaaccaatatctggctcaaactgagagacagctacacgcaggtgtgcgatcaccgcctgatgtctgccgctatcaaggactccaaagcggtccatgccgatatgggctattggattgagagcgaaaagaacgagacatggaagcttgctcgggcctctttcatcgaagtgaaaacctgtatttggcccaagtcccacacactctggagcaatggggttctggagtctgagatgatcattccgaaaatctacggaggccctgtgagccaacataactatagacccgggtactttacccagacagccggaccttggcacctgggcaagctcgaactggacttcgatctttgcgaggggaccacggtcgtggttgacgaaaattgcggaaaccgcggcccctccctgcggaccacaaccgtgacaggcaaaaccatccacgagtggtgttgcagaagctgtacgctccctcccctgcggtttaagggggaggatggatgctggtacggcatggaaattcgcccggtcaaggagaaagaagagaatctggtgaagtctatggtttccgctgggagcggagaagtggactccttctctcttggcctcctgtgtatcagcattatgatcgaggaggtcatgagatcccggtggtctagaaaaatgctgatgacagggaccctcgccgtgtttctgcttctgacaatgggacagctcacctggaacgatctgattcgcctgtgcatcatggtgggcgcgaacgctagcgacatgatgggcatggggaccacatatcttgccctgatggccacgttccggatgagacctatgtttgctgtcggactcctgttccgcagactcacctcccgggaaattctgcttctgacagttggcctctctctggtggccagcgtggagctgcccaattcccttgaagagctgggggacggactcgcgatgggcatcatgatgctgaagctcctgaccgattttcaaccccatcagctttgggctacactgctcagcctgaccttcgtcaaaacgacactgtctcttcactacgcctggaagaccatggccatgatcctgtccattgtgagcctcctgcctctctgtctgtctaccacatcccagaagaccacatggcttccggttctgctggggagcctcggatgcaaacccctgacgatgtttcttatcaccgaaaacaagatttggggccgcagatcttggcctctgaatgagggcatcatggctattgggatcgtgtccatcctcctgagctccctcctgaaaaacgacgtcccccttgccggacctctgattgctggcgggatgctgatcgcctgttatgtgattagcggatctagcgcggatctctccctggagaaggccgctgaagtttcttgggaggacgaagccgagcatagcggcgcttcccacaatatccttgtggaagtccaggatgacgggacaatgaaaattaaggatgaggagcgggacgataccctgacaatcctcctgaaagccaccctcctggtgatctctggagtctaccccatgagcgtgcctgccacgcttttcgtttggtatttttggcaaaagaagaaacagcgctccggcgtgctgtgggacaccccctctccgcctgaagtcgagagagctgtgctggataacggcatttaccggatcctccagcgcgggctgcttggaagaagccaggttggcgtgggggtcttccaagaaggagtgttccatacaatgtggcacgtgacccggggcgcggttctgatgtatcaggggaagcgcctcgagccctcctgggccagcgtcaaaaaggacctgatttcttacggaggcggctggagatttcaggggtcctggaatacaggagaggaagtgcaggtgatcgctgtcgagcctggcaaaaaccccaagaatgtgcaaaccacaccggggacgttcaagacccctgaaggagagattggcgccatcgccctcgattttaaacccgggacaagcggatctcctattgttaaccgggaaggcaagatcgtgggcctgtacgggaatggagtcgtgaccacctccggcacatatgttagcgctatcgcccaggcgaaagtgtcccaggaggggccccttcccgagattgaagacgaggtcttcagaaagcgcaacctgacgatcatggacctgcaccctggatctggcaaaacccggagatacctcccggctattgtgcgcgaagccatcaagcggaagctgagaacacttgttctggcccccacccgcgtggtcgctagcgagatggccgaagcgctcaaagggatgcctattcggtatcaaacaaccgctgtgaagtccgagcatacgggcaaagagatcgtggatctgatgtgccacgccacatttaccatgagactgctcagccccgtccgcgttcctaattacaacatgatcattatggacgaagcccatttcaccgatcccgcttctatcgccgctcggggatatatttccacaagagtgggcatgggggaggccgcggccatctttatgaccgctacacctccgggaagcgtggaagccttcccccagtctaatgctgtcattcaggacgaggaacgggatatccctgagcgcagctggaactccggctacgagtggatcaccgactttcccgggaagacggtgtggttcgttccttctattaaaagcggaaacgatatcgccaattgtcttagaaagaacggcaagcgggtggtccagctgtcccgcaaaacatttgacaccgaatatcaaaagacaaaaaataacgattgggactacgtggttaccacggatatttctgagatgggggccaatttcagagctgaccgggtgatcgaccccagacgctgcctgaagccggtcattctcaaagatggccctgaacgggtgatcctggcgggacccatgcccgtcaccgtggccagcgctgcccagagacgcggccggattgggagaaaccctaataaggagggagaccagtacgtttatatgggccagccccttaacaatgatgaggaccacgcccattggacagaagctaagatgctgctcgataacatcaatacccctgaggggatcattccggccctgttcgaacccgagcgcgaaaaatccgcggctatcgacggagagtaccggctgagaggcgaggcccgcaagacatttgtggaactcatgagacggggggatcttcctgtgtggctgagctataaagtcgcctctgagggcttccaatactccgaccgcagatggtgctttgatggagaacggaacaatcaggttctggaggaaaacatggacgtggagatttggaccaaggagggcgaacgcaaaaagctcagaccccggtggctggatgctagaacatatagcgaccctcttgccctgcgcgagttcaaagaatttgcggccgggcggagatccgtgtctggagatctcatcctggagattggcaagctgccccagcacctcacccttaaggctcagaatgccctggacaacctggtcatgctccacaacagcgaacaagggggaaaagcttaccgccatgccatggaggagctgccggacacgatcgaaacacttatgctgctcgctctgatcgccgtgctgaccggcggcgttaccctcttctttctttccgggcggggactgggcaagacatctattgggctgctctgtgtgatggcgagctccgccctgctttggatggctagcgtcgagcctcactggatcgccgcttctattatcctggaattctttctcatggtgctgctgattcccgagcctgatagacagcggaccccccaggacaatcagctcgcctatgtcgtgatcggacttctgttcatgatcctgacagttgccgctaacgagatgggcctcctggaaacgaccaaaaaggatcttgggattggacatgcggccgctgagaatcaccaccatgccgccatgctggacgtggatctccaccctgcttccgcctggacactgtacgcggtcgccaccacaatcattacccccatgatgcgccatacgatcgaaaacaccacagctaatattagcctgaccgccatcgctaaccaagccgcgattctcatgggccttgacaaaggctggccgatctctaagatggatatcggggtgcctctgctggccctcggatgctactcccaggttaatcccctgacacttaccgctgccgtgctgatgctcgtcgctcactatgccattatcggccccgggctgcaggctaaggccacgagagaggcgcaaaaacggacagccgctggaattatgaagaaccctaccgtggacggcatcgtggccattgatctggacccggttatctacgatgctaaatttgaaaagcagctcgggcagatcatgcttctgattctgtgtacaagccagatcctcctgatgcgcaccacctgggccctttgcgagtctattacactggccacgggacccctcaccacactgtgggagggcagccctggcaaattctggaataccacaatcgcggtctccatggctaacatttttagagggtcttatctggccggagctggcctcgccttcagccttatgaagtccctggggggaggccggcgcgggaccggagcccaaggcgaaacgctgggcgagaagtggaaaagacagctcaatcagctgagcaagtccgaattcaacatctacaaacggtctgggatcattgaggtggaccgcagcgaagctaaggagggacttaaaagaggcgagacaaccaagcatgccgtgtcccgggggaccgcgaagctgagatggtttgtcgaacgcaatctcgttaaacccgagggaaaggtgatcgatctgggctgtgggcggggaggctggtcttattactgcgccggcctgaaaaaggtgacagaagtcaaagggtataccaagggaggccctgggcacgaggaacccattcctatggctacatacggatggaacctcgtgaaacttcacagcggcaaggacgttttctttacgccgcccgagaagtgtgacaccctgctgtgcgatatcggggagtcctctcctaatcccacaattgaagagggaagaaccctccgcgtgctgaaaatggtcgaaccttggcttcggggcaaccagttctgtatcaagattctgaatccctacatgccgagcgtggttgagacactcgagcaaatgcagagaaaacatggcgggatgctggtgcgcaaccctctgtcccggaacagcacccacgaaatgtattgggtctcttgcggaacgggcaatatcgtgtccgccgtgaacatgaccagcagaatgctcctgaatcgctttacaatggctcatcggaagcccacctacgagagagacgtcgatcttggggccggaacacgccacgttgcggtggaacccgaggtggccaacctggacatcattggccagcggatcgaaaatattaaaaacgagcacaagtctacctggcattatgatgaggacaatccttacaagacatgggcttatcacgggtcctacgaagtcaaacccagcggatctgcctccagcatggtgaacggcgttgtgagactcctgaccaagccttgggatgtcatcccgatggtgacgcagattgctatgacagacaccacccccttcggccaacagcgcgtttttaaagagaaggtggatacaagaacgcctaaagccaagcgggggaccgctcagatcatggaagtcacagcccgctggctttggggattcctgtccagaaataagaaaccccggatctgtaccagagaggaatttacacggaaggtgcgcagcaacgcggccattggcgctgttttcgtggacgagaatcaatggaactctgccaaagaggctgtcgaagatgagagattttgggacctcgtgcatcgggaacgcgagctgcacaagcaggggaaatgcgccacctgcgtctataatatgatgggaaagagagaaaagaaactgggcgagttcgggaaggccaaaggcagccgggcgatctggtacatgtggctcggagctcgctttctggagttcgaagcccttggcttcatgaacgaggaccattggttttccagagaaaattctctgagcggggtggagggagagggcctccacaagctggggtacattcttcgggatatctccaaaattcctggaggcaacatgtatgccgacgatacagctgggtgggacacccgcatcacggaagatgacctgcagaacgaggccaagatcaccgatattatggaacccgagcacgctctcctggccacatctatcttcaaactgacctaccagaataaggttgtgagagtccaacggccgggcaagaacggaacagtgatggacgtgattagccgcagagatcagcggggctccgggcaggttggaacctatggcctcaatacgtttacaaacatggaagcgcagctgatccgccaaatggagtctgaggggattttcagcccttccgaacttgagacccccaatctggccgaaagagtgtttgactggctcgagaaacatggaatcgaacggctgaagagaatggctatcagcggcgatgactgtgtcgtgaaacctattgatgaccgcttcgccacagctcttaccgccctgaacgacatggggaaggttcggaaagatatcccccagtgggagccttctaagggctggaatgactggcagcaggtgcccttttgctcccaccatttccaccaactcattatgaaggatggaagagagatcgtcgtgccgtgtcgcaaccaggacgaactggtcggccgggcgagagtgagccagggggccggatggtctctgcgcgagacggcttgcctcggcaaatcctacgcccagatgtggcaactgatgtattttcaccggagagatcttcgcctggctgccaatgctatttgtagcgccgttcctgtggactgggtccccacctcccggacaacctggtctatccatgcgcaccatcagtggatgacaaccgaagatatgctcagcgtgtggaacagagtttggattgaggaaaatccctggatggaggacaagacacacgtgtccagctgggaggatgtcccttacctggggaaacgcgaagaccagtggtgcggatctcttatcggcctgaccgcccgggctacgtgggccacaaacatccaagtggccattaatcaggtgagacggctcatcgggaacgagaattatctggattacatgacctccatgaagagattcaaaaacgaaagcgacccggagggcgctctgtggtga

SEQ ID NO: 19433 - RNA, 9879 nt, synthetic construct
  misc_feature 1..9879: note = derived and/or modified CDS sequence (opt5) from DENV-1__KC762641__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagaccagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcgtgcatcagattttcgggaccgcttacggagtgctgttttccggcgtcagctggacgatgaagatcgggattggcgtgcttctgacctggctcggactcaattctagatccacaagcctgtctatgacctgtatcgccgttggccttgtgacactctacctgggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacgacatgaagttcacagttgtggtcggagatgtggctggcattctggcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaaacttcgcgattcctacacacaggtttgcgaccaccggctcatgagcgccgctattaaagattctaaggccgtgcatgccgacatgggctattggatcgaatccgagaaaaatgaaacctggaagctggctagagccagcttcatcgaggtgaagacatgtatttggcccaaatctcacaccctgtggtccaacggggtcctcgaaagcgagatgatcattccgaagatctacggaggccctatttctcaacataattatcgccccgggtacttcacacagaccgcgggaccttggcacctgggcaaacttgagctggattttgacctctgcgaagggacgaccgtggttgtggatgagcactgcggaaaccggggccccagcctgagaacaaccacagtcaccggcaagatcatccatgaatggtgttgccggtcctgtacgctgcctccccttcgcttcagaggggaggacggatgctggtacggcatggagattcggccggtgaaagaaaaggaggaaaatctcgttaagagcatggtgtctgctgggtccggagaggtcgacagcttttccctgggcctgctctgtatctctattatgatcgaagaggtgatgagaagccgctggtcccggaaaatgctgatgacagggacccttgccgttttctttctgctcattatgggacagctgacatggaacgatctgatcagactttgcattatggtgggcgccaatgcttctgaccgcatgggcatggggaccacctatctggccctcatggcgacattcaagatgagacctatgtttgctgtcggactgctgttccggcgcctgacgagcagagaggtgcttctgctcaccatcggcctgtccctggtggcctctgtcgaacttcccaacagcctggaggaactcggggatggactggccatgggcatcatgattctcaaactgcttacagactttcaatcccaccagctgtgggctaccctcctgagcctgacattcatcaagaccacgttttctcttcattacgcctggaaaacaatggctatggttctgtccattgtgagcctcttccccctgtgtctctctaccacctcccagaagacaacctggctgcctgtgcttctggggagcctgggatgcaagccgctcacaatgtttctgatcgccgagaataaaatttggggccggaagtcttggccccttaacgaaggcatcatggcggtcgggatcgtgtccattctgctcagctccctgctcaaaaacgatgttcctctggccggaccccttatcgctggcgggatgctgattgcctgttatgtgatcagcggatctagcgctgacctgtccctcgagaaggccgccgaggtctcttgggaagaggaagctgagcacagcggcgcgtcccataatattctggtggaagttcaggatgacgggacgatgaaaatcaaggatgaggagcgcgacgatacccttacaatcctgctcaaagccaccctgctcgctgtgtctggagtctaccctctgagcattcccgccacacttttcgtgtggtatttctggcaaaagaagaaacagagatccggcgtcctgtgggacaccccttctcccccggaagtggagcgggccgttctggatgacggcatctaccgcattatgcagagagggctcctgggacggagccaggtgggcgtcggggtgtttcaagaaaacgttttccacacgatgtggcacgtgacccgcggagctgtccttatgtatcagggcaagagactggagccttcctgggccagcgtgaaaaaggacctcatctcttacgggggaggctggcggctgcagggctcctggaatacaggggaggaagtgcaggttattgcggtcgagcccggcaagaaccctaagaatgtgcaaaccgctcccggcacatttaagaccccggaaggggaggtgggagccatcgccctcgatttcaaacctggcacaagcgggtctcccattgtcaacagagaaggaaagatcgtgggcctgtacggcaatggggttgtgacgacctccggaacatatgtcagcgctatcgcccaggcgaaggcttcccaggagggccctcttcccgagattgaagacgaggtgtttcgcaagcggaacctgaccatcatggatctgcatcccgggtctggaaaaaccagacgctacctccctgccattgttcgggaagccatcaagagaaagctgcgcacacttattctggctccgacgcgggtggtcgccagcgagatggctgaagccctcaaaggcatgcccatcagatatcaaaccacagcggtgaagtccgagcacaccgggaaagagatcgttgacctgatgtgccatgccacattcaccatgcgcctgctcagccctgtgcgggtccccaattacaacatgattatcatggatgaagctcactttacggacccttcttccattgccgctagaggctatatcagcacacgggtgggaatgggcgaggccgccgctattttcatgaccgcgacaccccctgggtctgtggaagcctttccgcagagcaatgctgtcatccaggatgaggaacgcgacatccccgagagatcctggaactctggatacgagtggattacagatttccctggcaagaccgtttggtttgtgcccagcatcaaatccgggaatgacattgccaactgtcttcggaagaatggaaagcgcgtgatccagctgtctagaaaaacattcgataccgaatatcaaaagacgaaaaacaacgactgggactacgtcgtgacaaccgatattagcgagatgggcgccaatttccgggctgacagagttatcgatcctcgccggtgcctgaagcccgtgattctcaaagacgggccggaaagagtcatcctggccggccctatgcccgtgacagttgcgtccgctgcccagcgccggggaagagtgggccgcaaccataataaggagggggatcagtacatctatatgggacagccccttaacaatgacgaggatcacgcccactggaccgaagctaagatgctgctcgacaacattaatacgcctgagggcatcattcccgccctgtttgaacctgagcgggaaaagagcgcggccatcgatggggagtacagactgcgcggagaggctagaaagaccttcgtcgagctcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatttggacaaaggagggagaacgcaaaaagctccggcccagatggctggacgctcgcacctattccgaccctcttgccctgcgggagtttaaagagttcgctgccggcagacgctctgtgagcggggatctcatcctggagatcggaaagctgccccagcatctcacacagcgggcgcaaaatgcccttgacaacctggtgatgctgcacaattccgaacagggcgggagagcttaccggcatgccatggaggagctccctgataccattgaaacactgatgcttctggctctcatcgccgtcctgaccggaggcgttacgctgtttttcctctctggccgcgggcttggaaagacaagcattggcctgctgtgtgtgatggcctccagcgtgctcctgtggatggcttctgtcgagccccactggatcgcggcctccattatccttgaatttttcctgatggtgctcctgatcccggagcctgacagacagcggacaccccaggataaccaactggcttatgttgtgattgggctcctttttatgatcctgaccgtcacagccaatgagatgggactgctcgaaaccaccaaaaaggacctgggcattgggcacgtggccgtcgagaaccatcaccatgctgccatgcttgatgtggacctgcaccctgcgagcgcctggacgctctacgctgttgccaccacaatcattacccccatgatgcgccatacaatcgaaaacaccacggctaatatttctctgaccgccatcgcgaaccaggccgctatcctgatgggactcgataaaggctggcctatttccaagatggacatcggcgtgccccttctggccctggggtgctacagccaggtcaatccgctcacactgaccgctgccgtgcttatgctggttgctcactatgccattatcggacctggcctccaagcgaaagccacaagagaggctcagaagcggaccgccgctgggattatgaagaaccccacggtggatggaatcgtcgccatcgacctggatcccgtggtgtacgacgccaaattcgaaaagcagctgggccagattatgctccttatcctgtgtacatctcaaattctgctcatgcgcaccacatgggcgctgtgcgagagcatcacccttgctaccgggcctctgacaacgctctgggagggatccccgggcaaattttggaataccacaattgccgtttctatggctaacatcttcagaggcagctatctggccggggccggactggctttctccctcatgaaaagccttggcgggggacggcgcggcaccggggcccagggagaaacactgggcgagaaatggaagagacagctgaatcagctctccaagtctgaatttaacacctacaaacggagcggcatcatggaggtcgacagatccgaagcgaaggaggggctgaaacgcggagagacgacaaagcacgccgtgtctcggggcaccgctaaacttagatggttcgtggaacgcaatctggtcaagcccgaggggaaggttattgatctcggatgtggcagagggggatggagctattactgcgccggcctgaaaaaggtgaccgaagtgaaaggctatacaaaagggggacctggccatgaggaacccatccctatggctacctacgggtggaacctggtcaaactccactccggaaaggacgtgtttttcattccccctgagaaatgtgatacacttctgtgcgacatcggcgagtctagcccgaatcccacgattgaagaggggagaaccctgcgcgttctcaagatggtggaaccttggctgcggggaaaccaattttgtatcaagattcttaatccctacatgccttccgtcgtggagacactggagcagatgcagagaaaacatggcggcatgctcgttcgcaaccccctgagcagaaattctacccacgaaatgtattgggtgtcctgcgggacaggaaacatcgtcagcgccgtgaatatgacctctagaatgctgctcaaccgcttcacgatggcgcaccggaagccgacctacgagagagatgtggacctgggcgccgggacacgccatgtcgctgttgaacctgaggtggccaaccttgatatcattggacagagaatcgaaaatattaaacacgagcataagtccacctggcactatgacgaggataacccctacaaaacatgggcttatcatggcagctacgaagtgaagccctctgggtccgccagctccatggtcaatggagtggttaagctgctcaccaaaccttgggacgtgatccccatggtcacacaaattgctatgaccgatacgacaccttttggccagcagcgggtgttcaaggagaaagttgacacccgcaccccgaaggccaaaagaggcacaacgcaaatcatggaagtgaccgcgcggtggctgtgggggtttcttagcagaaacaagaagccccggatctgtacacgcgaggagttcaccagaaaagtccggtctaatgccgctattggagccgtgtttgttgacgagaaccagtggaatagcgctaaggaggccgtggaagatgagcgcttctgggacctggtccacagagaacgggagctccacaaacagggcaagtgcgccacatgcgtgtataacatgatggggaaacgcgaaaagaagctgggagagtttggcaaagcgaaggggtccagagctatctggtacatgtggctgggcgcccggttcctcgagttcgaagccctgggatttatgaatgaggatcattggttctctcgcgaaaacagcctttccggcgtcgagggggagggactgcacaaactcggctacattctgagagacatctctaagattcctgggggaaatatgtatgctgatgacaccgccggctgggatacacggatcaccgaagacgatcttcagaacgaggctaaaatcacggacattatggaacccgagcatgccctgctcgcgaaggccatctttaaactgacctaccaaaataaggtggttcgcgtgcagagacctgctaagaacgggacagtcatggatgtgattagccggcgcgaccagagaggctccggacaggtgggcacctatgggctgaatacattcaccaacatggaagcccaactcatccggcagatggagtctgagggaatttttagcccctccgaactggagacgccgaaccttgctgaaagagttctggattggctcgagaaatacggcgtggaacgcctgaagcggatggccatcagcggggacgactgtgtcgtgaaacctatcgatgacagattcgcgacagcccttaccgctctgaatgatatgggaaaggttcgcaaagacattccccagtgggagccttctaagggctggaacgattggcagcaagtgcccttttgctcccaccacttccatcagctcatcatgaaggacgggcgggagattgtcgtgccttgtagaaatcaggatgaactggtcggccgcgcccgggtgagccagggagctggctggtctctgagagagacagcctgcctcgggaaatcctatgctcaaatgtggcagctgatgtactttcaccgccgggaccttagactggccgcgaacgccatctgtagcgctgttcccgtggattgggtcccgacctcccgcacgacctggtctattcatgcccaccatcagtggatgacaaccgaagacatgctcagcgtgtggaatcgggtttggatcgaggaaaacccttggatggaggataagacacacatttccagctgggaggacgtgccctatctgggaaaaagagaagaccaatggtgcggctctcttatcgggctgaccgcccgggctacatgggccaccaatatccaggtcgcgattaaccaggtgagacgcctcatcggaaatgagaactacctggattacatgacgtccatgaagcggttcaaaaatgaaagcgaccccgagggcgctctgtggtga

SEQ ID NO: 19434 - RNA, 9879 nt, synthetic construct
  misc_feature 1..9879: note = derived and/or modified CDS sequence (opt5) from DENV-1__KC762648__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagaccagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcgtgcatcagattttcgggaccgcttacggagtgctgttttccggcgtcagctggacgatgaagatcgggattggcgtgcttctgacctggctcggactcaattctagatccacaagcctgtctatgacctgtatcgccgttggccttgtgacactctacctgggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacgacatgaagttcacagttgtggtcggagatgtggctggcattctggcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaaacttcgcgattcctacacacaggtttgcgaccaccggctcatgagcgccgctattaaagattctaaggccgtgcatgccgacatgggctattggatcgaatccgagaaaaatgaaacctggaagctggctagagccagcttcatcgaggtgaagacatgtatttggcccaaatctcacaccctgtggtccaacggggtcctcgaaagcgagatgatcattccgaagatctacggaggccctatttctcaacataattatcgccccgggtacttcacacagaccgcgggaccttggcacctgggcaaacttgagctggattttgacctctgcgaagggacgaccgtggttgtggatgagcactgcggaaaccggggccccagcctgagaacaaccacagtcaccggcaagatcatccatgaatggtgttgccggtcctgtacgctgcctccccttcgcttcagaggggaggacggatgctggtacggcatggagattcggccggtgaaagaaaaggaggaaaatctcgttaagagcatggtgtctgctgggtccggagaggtcgacagcttttccctgggcctgctctgtatctctattatgatcgaagaggtgatgagaagccgctggtcccggaaaatgctgatgacagggacccttgccgttttctttctgctcattatgggacagctgacatggaacgatctgatcagactttgcattatggtgggcgccaatgcttctgaccgcatgggcatggggaccacctatctggccctcatggcgacattcaagatgagacctatgtttgctgtcggactgctgttccggcgcctgacgagcagagaggtgcttctgctcaccatcggcctgtccctggtggcctctgtcgaacttcccaacagcctggaggaactcggggatggactggccatgggcatcatgattctcaaactgcttacagactttcaatcccaccagctgtgggctaccctcctgagcctgacattcatcaagaccacgttttctcttcattacgcctggaaaacaatggctatggttctgtccattgtgagcctcttccccctgtgtctctctaccacctcccagaagacaacctggctgcctgtgcttctggggagcctgggatgcaagccgctcacaatgtttctgatcgccgagaataaaatttggggccggaagtcttggccccttaacgaaggcatcatggcggtcgggatcgtgtccattctgctcagctccctgctcaaaaacgatgttcctctggccggaccccttatcgctggcgggatgctgattgcctgttatgtgatcagcggatctagcgctgacctgtccctcgagaaggccgccgaggtctcttgggaagaggaagctgagcacagcggcgcgtcccataatattctggtggaagttcaggatgacgggacgatgaaaatcaaggatgaggagcgcgacgatacccttacaatcctgctcaaagccaccctgctcgctgtgtctggagtctaccctctgagcattcccgccacacttttcgtgtggtatttctggcaaaagaagaaacagagatccggcgtcctgtgggacaccccttctcccccggaagtggagcgggccgttctggatgacggcatctaccgcattatgcagagagggctcctgggacggagccaggtgggcgtcggggtgtttcaagaaaacgttttccacacgatgtggcacgtgacccgcggagctgtccttatgtatcagggcaagagactggagccttcctgggccagcgtgaaaaaggacctcatctcttacgggggaggctggcggctgcagggctcctggaatacaggggaggaagtgcaggttattgcggtcgagcccggcaagaaccctaagaatgtgcaaaccgctcccggcacatttaagaccccggaaggggaggtgggagccatcgccctcgatttcaaacctggcacaagcgggtctcccattgtcaacagagaaggaaagatcgtgggcctgtacggcaatggggttgtgacgacctccggaacatatgtcagcgctatcgcccaggcgaaggcttcccaggagggccctcttcccgagattgaagacgaggtgtttcgcaagcggaacctgaccatcatggatctgcatcccgggtctggaaaaaccagacgctacctccctgccattgttcgggaagccatcaagagaaagctgcgcacacttattctggctccgacgcgggtggtcgccagcgagatggctgaagccctcaaaggcatgcccatcagatatcaaaccacagcggtgaagtccgagcacaccgggaaagagatcgttgacctgatgtgccatgccacattcaccatgcgcctgctcagccctgtgcgggtccccaattacaacatgattatcatggatgaagctcactttacggacccttcttccattgccgctagaggctatatcagcacacgggtgggaatgggcgaggccgccgctattttcatgaccgcgacaccccctgggtctgtggaagcctttccgcagagcaatgctgtcatccaggatgaggaacgcgacatccccgagagatcctggaactctggatacgagtggattacagatttccctggcaagaccgtttggtttgtgcccagcatcaaatccgggaatgacattgccaactgtcttcggaagaatggaaagcgcgtgatccagctgtctagaaaaacattcgataccgaatatcaaaagacgaaaaacaacgactgggactacgtcgtgacaaccgatattagcgagatgggcgccaatttccgggctgacagagttatcgatcctcgccggtgcctgaagcccgtgattctcaaagacgggccggaaagagtcatcctggccggccctatgcccgtgacagttgcgtccgctgcccagcgccggggaagagtgggccgcaaccataataaggagggggatcagtacatctatatgggacagccccttaacaatgacgaggatcacgcccactggaccgaagctaagatgctgctcgacaacattaatacgcctgagggcatcattcccgccctgtttgaacctgagcgggaaaagagcgcggccatcgatggggagtacagactgcgcggagaggctagaaagaccttcgtcgagctcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatttggacaaaggagggagaacgcaaaaagctccggcccagatggctggacgctcgcacctattccgaccctcttgccctgcgggagtttaaagagttcgctgccggcagacgctctgtgagcggggatctcatcctggagatcggaaagctgccccagcatctcacacagcgggcgcaaaatgcccttgacaacctggtgatgctgcacaattccgaacagggcgggagagcttaccggcatgccatggaggagctccctgataccattgaaacactgatgcttctggctctcatcgccgtcctgaccggaggcgttacgctgtttttcctctctggccgcgggcttggaaagacaagcattggcctgctgtgtgtgatggcctccagcgctctcctgtggatggcgtctgtggagccccactggatcgccgcttccattatccttgaatttttcctgatggtcctcctgatcccggagcctgacagacagcggacaccccaggataaccaactggcctatgtggttattgggctcctttttatgatcctgaccgtggccgctaatgagatgggactgctcgaaacaaccaaaaaggacctgggcattgggcacgtcgccgtggagaaccatcaccatgcggccatgcttgatgtcgacctgcaccctgctagcgcctggacactctacgctgtggccacgaccatcattacacccatgatgcgccataccatcgaaaacacaaccgcgaatatttctctgacggccatcgctaaccaggccgctatcctgatgggactcgataaaggctggcctatttccaagatggacatcggcgttccccttctggccctggggtgctacagccaggtgaatccgctcaccctgacagctgccgtccttatgctggtggcgcactatgccattatcggacctggcctccaagctaaagccaccagagaggctcagaagcggacagccgccgggattatgaagaaccccaccgttgatggaatcgtggcgatcgacctggatcccgtcgtgtacgacgctaaattcgaaaagcagctgggccagattatgctccttatcctgtgtacgtctcaaattctgctcatgcgcacaacctgggccctgtgcgagagcatcacacttgctaccgggcctctgaccacactctgggagggatccccgggcaaattttggaatacgaccattgccgtgtctatggccaacatcttcagaggcagctatctggctggggccggactggcgttctccctcatgaaaagccttggcgggggacggcgcggcacaggggcccagggagaaaccctgggcgagaaatggaagagacagctgaatcagctctccaagtctgaatttaacacatacaaacggagcggcatcatggaggttgacagatccgaagctaaggaggggctgaaacgcggagagaccacgaagcacgccgtctctcggggcacagctaaacttagatggttcgtggaacgcaatctggtgaagcccgaggggaaggtcattgatctcggatgtggcagagggggatggagctattactgcgccggcctgaaaaaggttaccgaagtgaaaggctataccaaagggggacctggccatgaggaacccatccctatggcgacatacgggtggaacctggtgaaactccactccggaaaggacgtctttttcattccccctgagaaatgtgatacccttctgtgcgacatcggcgagtctagcccgaatcccacaattgaagaggggagaacgctgcgcgtgctcaagatggttgaaccttggctgcggggaaaccaattttgtatcaagattcttaatccctacatgccttccgtggtcgagaccctggagcagatgcagagaaaacatggcggcatgctcgtgcgcaaccccctgagcagaaattctacacacgaaatgtattgggtttcctgcgggaccggaaacatcgtgagcgccgtcaatatgacatctagaatgctgctcaaccgcttcaccatggctcaccggaagccgacgtacgagagagatgtggacctgggcgccgggacccgccatgtggctgtcgaacctgaggttgccaaccttgatatcattggacagagaatcgaaaatattaaacacgagcataagtccacatggcactatgacgaggataacccctacaaaacctgggcttatcatggcagctacgaagtgaagccctctgggtccgccagctccatggtgaatggagtcgtgaagctgctcacaaaaccttgggacgttatccccatggtgacccaaattgcgatgacagataccacgccttttggccagcagcgggtcttcaaggagaaagtggacacacgcaccccgaaggccaaaagaggcaccacacaaatcatggaagttacggctcggtggctgtgggggtttcttagcagaaacaagaagccccggatctgtacccgcgaggagttcacaagaaaagtgcggtctaatgccgctattggagccgtctttgtggacgagaaccagtggaatagcgccaaggaggcggttgaagatgagcgcttctgggacctggtgcacagagaacgggagctccacaaacagggcaagtgcgctacctgcgtctataacatgatggggaaacgcgaaaagaagctgggagagtttggcaaagccaaggggtccagagccatctggtacatgtggctgggcgctcggttcctcgagttcgaagccctgggatttatgaatgaggatcattggttctctcgcgaaaacagcctttccggcgtggagggggagggactgcacaaactcggctacattctgagagacatctctaagattcctgggggaaatatgtatgctgatgacacagccggctgggatacccggatcacagaagacgatcttcagaacgaggcgaaaatcaccgacattatggaacccgagcatgccctgctcgctaaggccatctttaaactgacgtaccaaaataaggtcgtgcgcgttcagagacctgctaagaacgggaccgtgatggatgtcattagccggcgcgaccagagaggctccggacaggtgggcacatatgggctgaataccttcacaaacatggaagcccaactcatccggcagatggagtctgaggaaatttttagcccctccgagctggaaaccccgaaccttgcggagagagtgctggattggctcgaaaaatacggagttgagcgcctgaagcggatggccatcagcggcgacgactgtgtggtcaaacctatcgatgacagattcgctacggcccttacagctctgaatgatatggggaaggtgcgcaaagacattccccagtgggagccttctaagggatggaacgattggcagcaagttcccttttgctcccaccacttccatcagctcatcatgaaggacggccgggaaattgtggtcccttgtagaaatcaggatgagctggtggggcgcgcccgggtcagccagggcgctggatggtctctgagagaaaccgcctgcctcggcaaatcctatgcgcaaatgtggcagctgatgtactttcaccgccgggaccttagactggccgctaacgccatctgtagcgccgtgcccgttgattgggtgccgacatcccgcaccacgtggtctattcatgctcaccatcagtggatgaccacagaggacatgctcagcgtctggaatcgggtgtggatcgaagagaacccttggatggaggataagacccacatttccagctgggaagacgttccctatctggggaaaagagaggaccaatggtgcggatctcttatcggcctgacagcccgggcgacctgggctacaaatatccaggtggccattaaccaggtcagacgcctcatcgggaatgaaaactacctggattacatgacctccatgaagcggttcaaaaatgagagcgaccccgagggagccctgtggtga

SEQ ID NO: 19435 - RNA, 9879 nt, synthetic construct
  misc_feature 1..9879: note = derived and/or modified CDS sequence (opt5) from DENV-1__KC762622__SS-prME
  source 1..9879: mol_type = other RNA
agcgtgaccatgctgctcatgctgatgcccacagcccttgctttccacctgacgacccggggaggggaacctcatatgatcgtctccaagcaggaacggggaaaatctctcctgtttaagacaagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatggccctgtttctcgcgcatgccatcgggacatctattacccagaagggaatcatcttcattctgcttatgctggtcacccctagcatggctatgagatgcgtgggcatcgggtcccgggattttgttgagggactcagcggcgccacatgggtggacgtcgtgctggagcacgggtcttgtgtgacgaccatggctaaggataaacccacactggacattgaactcctgaagaccgaggtcacaaaccctgccgttcttcgcaaactgtgcatcgaagcgaagatttccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttatcacatgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagccgccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagcacaaatactcttggaaaagctggggaaaggccaagatcattggcgctgacgtgcagaataccacctttatcatcgatgggcctaacacacccgaatgtcctgacgatcagagagcgtggaatatttgggaggtcgaggactatggattcggcatctttaccacgaacatttggctgaaacttcgcgattcctacacacaggtttgcgaccaccggctcatgagcgccgctatcaaagattctaaggccgtgcatgccgacatgggctattggattgaatccgagaaaaatgaaacctggaagctggctagagccagcttcatcgaggtgaagacatgtatctggcccaaatctcacaccctgtggtccaacggggtcctcgaaagcgagatgattatcccgaagatttacggaggccctacatctcaacataattatcgccccgggtacttcacccagacggcgggaccttggcacctgggcaaacttgagctggattttgacctctgcgaagggaccacagtggttgtggatgagcactgcggaaaccggggccccagcctgagaaccacaaccgtcacgggcaagatcattcatgaatggtgttgccggtcctgtacactgcctccccttcgcttcagaggggaggacggatgctggtacggcatggagatccggccggtgaaagaaaaggaggaaaatctcgttaagagcatggtgtctgctgggtccggagaggtcgacagcttttccctgggcctgctctgtatctctattatgatcgaagaggtgatgagaagccgctggtcccggaaaatgctgatgaccgggacacttgccgttttctttctgctcattatgggacagctgacctggaacgatctgatcagactttgcattatggtgggcgccaatgcttctgaccgcatgggcatggggaccacatatctggccctcatggcgacgttcaagatgagacctatgtttgctgtcggactgctgttccggcgcctgaccagcagagaggtgcttctgctcacaatcggcctgtccctggtggcctctgtcgaacttcccaacagcctggaggaactcggggatggactggccatgggcattatgatcctcaaactgcttaccgactttcaatcccaccagctgtgggctacactcctgagcctgaccttcatcaagacgacattttctcttcattacgcctggaaaaccatggctatggttctgtccattgtgagcctcttccccctgtgtctctctaccacatcccagaagaccacatggctgcctgtgcttctggggagcctgggatgcaagccgctcacgatgtttctgatcgccgagaataaaatttggggccggaagtcttggccccttaacgaaggcatcatggcggtcgggattgtgtccatcctgctcagctccctgctcaaaaacgatgttcctctggccggaccccttatcgctggcgggatgctgattgcctgttatgtgatcagcggatctagcgctgacctgtccctcgagaaggccgccgaggtctcttgggaagaggaagctgagcacagcggcgcgtcccataatattctggtggaagttcaggatgacgggaccatgaaaatcaaggatgaggagcgcgacgatacacttaccattctgctcaaagccacactgctcgctgtgtctggagtctaccctctgagcatccccgccacccttttcgtgtggtatttctggcaaaagaagaaacagagatccggcgtcctgtgggacacgccttctcccccggaagtggagcgggccgttctggatgacggcatctaccgcattatgcagagagggctcctgggacggagccaggtgggcgtcggggtgtttcaagaaaacgttttccacaccatgtggcacgtgacacgcggagctgtccttatgtatcagggcaagagactggagccttcctgggccagcgtgaaaaaggacctcatctcttacgggggaggctggcggctgcagggctcctggaataccggggaggaagtgcaggttattgcggtcgagcccggcaagaaccctaagaatgtgcaaacagctcccggcacctttaagacaccggaaggggaggtgggagccatcgccctcgatttcaaacctggcacgagcgggtctcccattgtcaacagagaaggaaagatcgtgggcctgtacggcaatggggttgtgaccacatccggaacctatgtcagcgctattgcccaggcgaaggcttcccaggagggccctcttcccgagatcgaagacgaggtgtttcgcaagcggaacctgaccatcatggatctgcatcccgggtctggaaaaacaagacgctacctccctgccattgttcgggaagccatcaagagaaagctgcgcacgcttattctggctccgacccgggtggtcgccagcgagatggctgaagccctcaaaggcatgcccatcagatatcaaacaaccgcggtgaagtccgagcacacagggaaagagattgttgacctgatgtgccatgccaccttcacgatgcgcctgctcagccctgtgcgggtccccaattacaacatgatcatcatggatgaagctcactttacagacccttcttccattgccgctagaggctatatcagcacccgggtgggaatgggcgaggccgccgctattttcatgaccgcgacaccccctgggtctgtggaagcctttccgcagagcaatgctgtcatccaggatgaggaacgcgacattcccgagagatcctggaactctggatacgagtggatcaccgatttccctggcaagacagtttggtttgtgcccagcatcaaatccgggaatgacattgccaactgtcttcggaagaatggaaagcgcgtgatccagctgtctagaaaaaccttcgatacggaatatcaaaagaccaagaacaacgactgggactacgtcgtgaccacagatattagcgagatgggcgccaatttccgggctgacagagttatcgatcctcgccggtgcctgaagcccgtgattctcaaagacgggccggaaagagtcatcctggccggccctatgcccgtgaccgttgcgtccgctgcccagcgccggggaagagtgggccgcaaccataataaggagggggatcagtacatttatatgggacagccccttaacaatgacgaggatcacgcccactggacggaagctaagatgctgctcgacaacatcaatacccctgagggcatcattcccgccctgtttgaacctgagcgggagaaaagcgcggccatcgatggggagtacagactgcgcggagaggctagaaagacattcgtcgaactcatgcggcgcggcgaccttccggtgtggctgtcttataaagtcgcctccgaggggtttcaatacagcgatagacggtggtgcttcgacggcgaacgcaacaatcaggtgctggaggaaaacatggatgttgagatttggaccaaggagggagaacgcaaaaagctccggcccagatggctggacgctcgcacatattccgaccctcttgccctgcgggagtttaaagagttcgctgccggcagacgctctgtgagcggggatctcatcctggagattggaaagctgccccagcatctcacccagcgggcgcaaaatgcccttgacaacctggtgatgctgcacaattccgaacagggcgggagagcttaccggcatgccatggaggagctccctgatacaatcgaaaccctgatgcttctggctctcatcgccgtcctgacgggaggcgttacactgtttttcctctctggccgcgggcttggaaagaccagcattggcctgctgtgtgtgatggcctccagcgtgctcctgtggatggcttctgtcgagccccactggatcgcggcctccattatccttgaatttttcctgatggtgctcctgattccggagcctgacagacagcggacaccccaggataaccaactggcttatgttgtgatcgggctcctttttatgatcctgacagtcgccgccaatgagatgggactgctcgaaaccaccaaaaaggacctgggcattgggcacgtggctgtcgagaaccatcaccatgccgcgatgcttgatgtggacctgcaccctgccagcgcttggacgctctacgccgttgctaccacaatcattacccccatgatgcgccatacaatcgaaaacaccacggccaatatttctctgaccgcgatcgccaaccaggctgccattctgatgggactcgataaaggctggcctatctccaagatggacatcggcgtgccccttctggctctggggtgctacagccaggtcaatccgctcacactgaccgccgctgtgcttatgctggttgcccactatgcgattatcggacctggcctccaagccaaagctacaagagaggcccagaagcggaccgctgccgggattatgaagaaccccacggtggatggaatcgtcgccattgacctggatcccgtggtgtacgacgcgaaattcgaaaagcagctgggccagatcatgctccttatcctgtgtacatctcaaattctgctcatgcgcaccacatgggctctgtgcgagagcatcacccttgccaccgggcctctgacaacgctctgggagggatccccgggcaaattttggaataccacaattgctgtttctatggccaacatcttcagaggcagctatctggccggggctggactggccttctccctcatgaaaagccttggcgggggacggcgcggcaccggggcgcagggagaaacactgggcgagaaatggaagagacagctgaatcagctctccaagtctgaatttaacacctacaaacggagcggcattatggaggtcgacagatccgaagccaaggaggggctgaaacgcggagagacgacaaagcacgctgtgtctcggggcaccgccaaacttagatggttcgtggaacgcaatctggtcaagcccgaggggaaggttatcgatctcggatgtggcagagggggatggagctattactgcgctggcctgaaaaaggtgaccgaagtgaaaggctatacaaaagggggacctggccatgaggaacccatccctatggccacctacgggtggaacctggtcaaactccactccggaaaggacgtgtttttcattccccctgagaaatgtgatacacttctgtgcgacatcggcgagtctagcccgaatcccacgattgaagaggggagaaccctgcgcgttctcaagatggtggaaccttggctgcggggaaaccaattttgtatcaagattcttaatccctacatgccttccgtcgtggagacactggagcagatgcagagaaaacatggcggcatgctcgttcgcaaccccctgagcagaaattctacccacgaaatgtattgggtgtcctgcgggacaggaaacatcgtcagcgcggtgaatatgacctctagaatgctgctcaaccgcttcacgatggcccaccggaagccgacctacgagagagatgtggacctgggcgctgggacacgccatgtcgccgttgaacctgaggtggctaaccttgatattatcggacagagaatcgaaaatattaaacacgagcataagtccacctggcactatgacgaggataacccctacaaaacatgggcctatcatggcagctacgaagtgaagccctctgggtccgctagctccatggtcaatggagtggttaagctgctcaccaaaccttgggacgtgatccccatggtcacacaaattgccatgaccgatacgacaccttttggccagcagcgggtgttcaaggagaaagttgacacccgcaccccgaaggcgaaaagaggcacaacgcaaatcatggaagtgaccgcccggtggctgtgggggtttcttagcagaaacaagaagccccggatttgtacacgcgaggagttcatcagaaaagtccggtctaatgctgccatcggagctgtgtttgttgacgagaaccagtggaatagcgccaaggaggccgtggaagatgagcgcttctgggacctggtccacagagaacgggagctccacaaacagggcaagtgcgcgacctgcgtgtataacatgatggggaaacgcgaaaagaagctgggagagtttggcaaagctaaggggtccagagccatttggtacatgtggctgggcgcccggttcctcgagttcgaagctctgggatttatgaatgaggatcattggttctctcgcgaaaacagcctttccggcgtcgagggggagggactgcacaaactcggctacatcctgagagacatttctaagatccctgggggaaatatgtatgccgatgacacagctggctgggatacccggattacagaagacgatcttcagaacgaggccaaaatcaccgacatcatggaacccgagcatgcgctgctcgccaaggctatttttaaactgacgtaccaaaataaggtggttcgcgtgcagagacctgccaagaacgggaccgtcatggatgtgatcagccggcgcgaccagagaggctccggacaggtgggcacatatgggctgaataccttcacaaacatggaagctcaactcattcggcagatggagtctgagggaatctttagcccctccgaactggagaccccgaaccttgccgaaagagttctggattggctcgagaaatacggcgtggaacgcctgaagcggatggcgattagcggggacgactgtgtcgtgaaacctatcgatgacagattcgccacggctcttacagccctgaatgatatgggaaaggttcgcaaagacatcccccagtgggagccttctaagggctggaacgattggcagcaagtgcccttttgctcccaccacttccatcagctcattatgaaggacgggcgggagatcgtcgtgccttgtagaaatcaggatgaactggtcggccgcgctcgggtgagccagggagccggctggtctctgagagagaccgcttgcctcgggaaatcctatgcccaaatgtggcagctgatgtactttcaccgccgggaccttagactggcggccaacgctatttgtagcgccgttcccgtggattgggtcccgacatcccgcaccacgtggtctatccatgcccaccatcagtggatgaccacagaagacatgctcagcgtgtggaatcgggtttggattgaggaaaacccttggatggaggataaggctcacgtgtccagctgggaggacgtcccctatctgggaaaaagagaagaccaatggtgcggctctcttatcgggctgaccgcccgggcgacatgggctaccaatattcaggtggccatcaaccaggtgagacgcctcatcggaaatgagaactacctggattacatgacatccatgaagcggttcaaaaatgaaagcgaccccgagggcgccctgtggtga

SEQ ID NO: 19436 - RNA, 9879 nt, synthetic construct
  misc_feature 1..9879: note = derived and/or modified CDS sequence (opt5) from DENV-1__KC762629__SS-prME
  source 1..9879: mol_type = other RNA
agcgtgaccatgctgctcatgctgatgcccacagcccttgctttccacctgacgaccagaggcggggaacctcatatggtggtttccaagcaggaacggggaaaatctctcctgtttaagacaagcgccggcgtgaatatgtgcacccttatcgcgatggacctgggggagctctgtgaagatacactgacctacaaatgcccccgcatcacagaggctgaacccgacgatgtggactgttggtgcaatgccaccgatacgtgggttacctatggaacatgttcccaaaccggcgagcacagacgggacaagcgctctgtggccctggctcctcatgttgggctcggactggagacaagaaccgaaacgtggatgagctccgagggcgcctggcggcagatccagcgcgtggaaacatgggctcttagacaccccggcttcaccgtcatcgccctgtttctcgcgcatgccatcgggacatctattacccagaaaggaatcatcttcattctgcttatgctggtgacccctagcatggctatgcggtgcgttggcatcgggtcccgcgattttgtggagggactcagcggcgccacatgggtcgacgtggtgctggagcacgggtcttgtgtcacgaccatggctaaggataagcccacactggacattgaactcctgaaaaccgaggttacaaaccctgccgtgcttagaaagctgtgcatcgaagcgaaaatttccaataccacgacagatagccggtgtccgacccaaggagaggccaccctcgtggaagaacaagacgctaacttcgtctgccgcagaacatttgtggatcggggctggggcaatgggtgtggactgttcggcaaggggtctcttattacctgcgccaaatttaagtgcgttacaaagctggagggaaaaattgtgcagtacgaaaacctcaagtattccgtcatcgtgacggttcacaccggcgaccagcatcaagtggggaatgagagcacagaacacggaaccacagctaccatcacgccccaggcccctaccacagagattcagctgaccgactacggcgccctgacactcgattgttctccccgcaccggcctggacttcaacgaaatggtccttctgacgatgaaagagaagtcctggctcgtgcataaacagtggtttctggatcttcctctgccctggacaagcggggcttccacctctcaagagacatggaatagacaggacctcctggtcaccttcaagaccgcgcacgccaaaaagcaggaagtggttgtgctgggaagccaagagggcgctatgcacacagccctcacgggggccaccgaaatccagacatccggaaccacaaccatttttgctggccatctgaagtgccggcttaaaatggataagctgacgctcaaagggatgagctatgtcatgtgtacaggctctttcaagctggagaaagaagtggccgagacccagcacggaaccgttctggtgcagatcaagtacgagggcacagacgcgccgtgcaagattcctttctccacccaagatgaaaaaggggtcacacagaacggaagacttatcacggctaatcccatcgtgaccgacaaggagaaacctgtgaacattgaagccgagccgccctttggcgagagctatatcgttattggggccggagaaaagacactcaaactgtcttggttcaagaagggcagctccatcgggaaaatgtttgaggctaccgcccgcggcgctcggagaatggccattctgggagatacagcgtgggacttcggctctatcgggggagtctttaccagcgtgggcaagctcgtgcatcagatcttcgggacggcctacggagtcctgttttccggcgtgagctggaccatgaaaattgggatcggcgttcttctgacatggctcggactcaattctcgctccaccagcctgtctatgacatgtattgctgtgggccttgtcaccctctacctgggggtgatggttcaggccgattccggatgcgtgatcaactggaagggccgggaactgaaatgtgggagcggaattttcgtcacaaatgaggtgcacacctggacggaacaatataagtttcaggctgactcccctaagagactctctgccgcgatcggcaaagcctgggaggagggggtttgcggcattcgcagcgctacacggctggaaaacatcatgtggaagcagatctccaacgagcttaatcatattctgctcgaaaacgacatgaaattcaccgtggtcgtgggagatgtggccggcatcctggctcaggggaagaaaatgattagaccgcaacccatggagcacaagtactcttggaaaagctggggaaaggccaagatcattggcgccgacgtccagaataccacatttatcatcgatgggcctaacacccccgaatgtcctgacgatcagcgcgcttggaatatttgggaggttgaggactatggattcggcatctttacgacaaacatttggctgaaacttcgggattcctacacccaggtgtgcgaccacagactcatgagcgcggccatcaaggattctaaagctgtgcatgccgacatgggctattggattgaatccgagaagaatgaaacatggaaactggcccgcgctagcttcatcgaggtcaagacctgtatctggcccaagtctcacacactgtggtccaacggggtgctcgaaagcgagatgattatcccgaaaatttacggaggccctatctctcaacataattatcggcccgggtacttcacccagacggccggaccttggcacctgggcaaacttgagctggattttaacctctgcgaagggaccacagttgtggtcgacgagcactgcggaaatagaggccccagcctgcggaccacaaccgtgacgggcaaaattatccatgaatggtgttgccgctcctgtacactgcctccccttagattcagaggggaagatggatgctggtacggcatggagatccggccggttaaggaaaaagaggaaaacctcgtcaagagcatggtctctgcggggtccggagaggtggacagcttttccctgggcctgctctgtatttctatcatgattgaagaggttatgcgcagccggtggtccagaaagatgctgatgaccgggacacttgctgtgttctttctgctcatcatgggacagctgacctggaatgacctgattcgcctttgcatcatggtcggcgccaacgcctctgatagaatgggcatggggaccacatatctggctctcatggccacgttcaaaatgcggcctatgtttgcggtgggactgctgttccgcagactgaccagccgggaggtgcttctgctcacaattggcctgtccctggtcgcttctgttgaacttcccaatagcctggaggaactcggggacggactggccatgggcatcatgatcctcaagctgcttaccgattttcaatcccaccagctgtgggccacactcctgagcctgaccttcattaaaacgacattttctcttcattacgcttggaagaccatggccatggtgctgtccatcgtgagcctcttccccctgtgtctctctaccacatcccagaaaaccacatggctgcctgtccttctggggagcctgggatgcaagccgctcacgatgtttctgattgctgagaacaagatctggggccgcaaatcttggccccttaacgaaggcattatggccgtggggatcgtttccatcctgctcagctccctgctcaagaatgacgtgcctctggcgggaccccttattgccggcgggatgctgatcgcttgttatgtcattagcggatctagcgccgatctgtccctcgagaaagctgccgaggtgtcttgggaagaggaagccgagcacagcggcgcttcccataacatcctggttgaagtgcaggacgatgggaccatgaagattaaagacgaggagagagatgacacacttaccatcctgctcaaggcgacactgctcgccgtctctggagtgtaccctctgagcatccccgctacccttttcgtctggtatttctggcagaagaagaagcagcggtccggcgtgctgtgggatacgccttctcccccggaagttgagcgcgccgtgctggacgatggcatttacagaatcatgcagcgggggctcctgggacgcagccaggtcggcgtgggggtttttcaagaaaatgtgttccacaccatgtggcacgtcacaagaggagccgtgcttatgtatcagggcaaacggctggagccttcctgggctagcgtgaagaaagacctcatttcttacgggggaggctggagactgcagggctcctggaacaccggggaggaagttcaggtcatcgccgtggagcccggaaagaatcctaaaaacgtgcaaacagcgcccggcacctttaagacaccggaaggggaggtcggagctattgccctcgacttcaagcctggcacgagcgggtctcccatcgtgaatcgcgaaggaaaaattgttggcctgtacggcaacggggtggtcaccacatccggaacctatgtgagcgccatcgctcaggccaaggcgtcccaggagggccctcttcccgagatcgaagatgaggtttttcggaaaagaaatctgaccattatggacctgcatcccgggtctggaaagacacgccggtacctccctgctatcgtgagagaagccattaaacgcaagctgcggacgcttatcctggccccgaccagagtcgtggctagcgagatggccgaagctctcaagggcatgcccattcgctatcaaacaaccgccgttaaatccgagcacacagggaaggagatcgtggatctgatgtgccatgcgaccttcacgatgcggctgctcagccctgtcagagtgcccaactacaatatgatcattatggacgaagcccactttacagatccttcttccatcgctgcccggggctatattagcacccgcgtgggaatgggcgaggctgccgccatcttcatgaccgctacaccccctgggtctgtcgaagcgtttccgcagagcaacgccgttattcaggacgaggaaagagatatccccgagcggtcctggaactctggatacgagtggatcaccgacttccctggcaaaacagtgtggtttgtgcccagcattaagtccgggaacgatatcgctaattgtcttcgcaaaaacggaaagagagtcattcagctgtctcggaagaccttcgacacggaatatcagaagacaaagaacaatgattgggactacgtggttaccacagacatcagcgagatgggcgccaacttcagagccgatcgcgtgattgaccctcggagatgcctgaaacccgtcatcctcaaggatgggccggaacgcgtgattctggctggccctatgcccgttaccgtggcctccgcggctcagcggagaggacgcgtcggccggaatcataacaaagagggggaccagtacatctatatgggacagccccttaataacgatgaggaccacgcccactggacggaagccaagatgctgctcgataatatcaacacccctgagggcattatccccgctctgtttgaacctgagagagaaaagagcgccgcgattgacggggagtaccgcctgagaggagaggcccggaaaacattcgtggaactcatgcgcagaggcgatcttccggtctggctgtcttataaggtggcttccgaggggtttcaatacagcgaccggcgctggtgcttcgatggcgaaagaaataaccaggttctggaggaaaatatggacgtggagatctggaccaaagagggagaacggaagaaactcagaccccgctggctggatgcccggacatattccgaccctcttgctctgagagagtttaaggagttcgccgctggccgccggtctgtgagcggggacctcattctggagatcggaaaactgccccagcatctcacccagagagcccaaaacgcgcttgataatctggtcatgctgcacaactccgaacagggcgggcgggcctaccgccatgctatggaggagctccctgacacaatcgaaaccctgatgcttctggccctcattgctgttctgacgggaggcgtgacactgtttttcctctctggcagagggcttggaaagaccagcatcggcctgctgtgtgtgatggcctccagcgtcctcctgtggatggcctctgtggagccccactggattgctgcgtccatcattcttgaatttttcctgatggttctcctgatcccggagcctgatcggcagcgcacaccccaagacaatcaactggcctatgtggtcatcgggctcctttttatgattctgaccgtggctgccaacgagatgggactgctcgaaaccacaaagaaagatctgggcatcgggcacgtcgccgtggagaaccatcaccatgctgccatgcttgacgttgatctgcaccctgcgagcgcctggacgctctacgctgtggccaccacaattatcacccccatgatgagacatacaattgaaaataccacggctaacatctctctgaccgccattgcgaatcaggccgctatcctgatgggactcgacaagggctggcctatctccaaaatggatattggcgtcccccttctggccctggggtgctacagccaggtgaacccgctcacactgaccgctgccgttcttatgctggtggctcactatgccatcattggacctggcctccaagcgaaggccacacgggaggctcagaaacgcaccgccgctgggatcatgaagaatcccacggtcgacggaattgtggccatcgatctggaccccgtggtttacgatgccaagttcgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttttggaacaccacaatcgccgtctctatggctaatattttccggggcagctatctggccggggccggactggctttctccctcatgaaaagccttggcgggggacgcagaggcaccggggcccagggagaaacactgggcgagaagtggaaacggcagctgaaccagctctccaagtctgaatttaatacctacaagagaagcggcatcatggaggtggaccgctccgaagcgaaagaggggctgaagcggggagagacgacaaaacacgccgtgtctagaggcaccgctaaacttcgctggttcgtcgaacggaacctggttaaacccgaggggaaggtgatcgacctcggatgtggcagagggggatggagctattactgcgccggcctgaagaaagtgaccgaagtcaagggctatacaaaagggggacctggccatgaggaacccattcctatggctacctacgggtggaatctggtgaagctccactccggaaaagatgtctttttcattccccctgagaagtgtgacacacttctgtgcgatattggcgagtctagcccgaaccccacgatcgaagaggggcgcaccctgcgggtgctcaaaatggtcgaaccttggctgagaggaaatcaattttgtattaagatccttaacccctacatgccttccgtggttgagacactggagcagatgcagcgcaagcatggcggcatgctcgtgcggaatcccctgagcagaaactctacccacgaaatgtattgggtctcctgcgggacaggaaatattgtgagcgccgtgaacatgacctctcgcatgctgctcaaccggttcacgatggcgcacagaaaaccgacctacgagcgcgacgtcgatctgggcgccgggacaagacatgttgctgtggaacctgaggtggccaatcttgacatcatcggacagcggattgaaaacatcaagcacgagcataaatccacctggcactatgatgaggacaatccctacaagacatgggcttatcatggcagctacgaagtcaaaccctctgggtccgccagctccatggtgaacggagttgtgaagctgctcaccaagccttgggatgtcattcccatggtgacacaaatcgctatgaccgacacgacaccttttggccagcagcgcgttttcaaagagaaggtggataccagaaccccgaaagccaagcggggcacaacgcaaattatggaagtcaccgcgagatggctgtgggggtttcttagccggaataaaaagccccgcatctgtacaagagaggagttcacccggaaggtgcgctctaacgccgctatcggagccgtttttgtggacgagaatcagtggaacagcgctaaagaggccgtcgaagacgagagattctgggatctggtgcaccgggaacgcgagctccacaagcagggcaaatgcgccacatgcgtctataatatgatggggaagagagagaaaaagctgggagagtttggcaaggcgaaagggtcccgggctatttggtacatgtggctgggcgcccgcttcctcgagttcgaagccctgggatttatgaacgaggaccattggttctctagaggcaatagcctttccggggtggaaggagagggcctgcacaagctcgggtacatcctgcgggatatttctaaaatccctggaggcaacatgtatgctgacgataccgccgggtgggacacacgcattaccgaggatgaccttcagaatgaagctaagatcacggatatcatggagcccgaacatgccctgctcgcgaaagccatttttaagctgacctaccaaaacaaagttgtgagagtccagcggcctgctaagaatggcacagtgatggacgtgatcagccgcagagatcagcggggatccggccaggttgggacctatggactgaacacattcaccaacatggaggcccaactcattagacagatggaatctgagggcatctttagcccctccgagctggaaacgccgaatcttgctgagcgcgtgctggactggctcgaaaagtacggggtcgagcggctgaaaagaatggccattagcggagatgactgtgtggttaagcctatcgacgatcgcttcgcgacagcccttaccgctctgaacgacatgggcaaagtgcggaaggatatcccccagtgggaaccttctaaagggtggaatgactggcagcaagtccccttttgctcccaccacttccatcagctcattatgaaggatggcagagagatcgtggtcccttgtcgcaaccaggacgagctggtgggacgggccagagttagccagggcgctgggtggtctctgcgcgaaacagcctgcctcggaaagtcctatgctcaaatgtggcagctgatgtactttcaccggagagatcttcgcctggccgcgaatgccatttgtagcgctgtgcccgtcgactgggtgccgacctcccggacgacctggtctatccatgcccaccatcagtggatgacaaccgaggatatgctcagcgtttggaacagagtgtggattgaagagaatccttggatggaagacaaaacacacatctccagctgggaggatgtcccctatctgggcaagcgggaggaccaatggtgcgggtctcttattggactgaccgccagagctacatgggccaccaacatccaggtggcgatcaatcaggtgcgccggctcattggcaacgaaaattacctggactacatgacgtccatgaaaagattcaagaacgagagcgatcccgaaggggctctgtggtga

SEQ ID NO: 19437 - RNA, 9879 nt, synthetic construct
  misc_feature 1..9879: note = derived and/or modified CDS sequence (opt5) from DENV-1__KC762627__SS-prME
  source 1..9879: mol_type = other RNA
agcgtgaccatgctgctcatgctgatgcccaccgcccttgctttccacctgacgacccggggaggggaacctcatatgattgtgtccaagcaggaacggggaaaatctctcctgtttaagaccagcgccggcgttaacatgtgcacccttattgcgatggacctgggggaactctgtgaagatacactgacctacaaatgcccccgcatcacagaggctgaacccgacgatgtggactgttggtgcaatgccaccgatacgtgggtgacctatggaacatgttcccaaaccggcgagcaccggcgggacaagcgctctgtggccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaattcagacatccggaaccacaaccatctttgctggccatctgaaatgcagacttaagatggataaactgacgctcaaggggatgagctatgtgatgtgtacaggctctttcaaactggagaaggaagtcgccgagacccagcacggaaccgtgctggttcagattaagtacgagggcacagacgcgccgtgcaaaatccctttctccacccaagatgaaaagggggtgacacagaacggacggcttatcacggctaatcccattgtcaccgacaaagagaagcctgtgaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtttttacaagcgtcggcaaactcattcatcagatcttcgggaccgcttacggagtgctgttttccggcgtgagctggacgatgaagattgggatcggcgtccttctgacctggctcggactcaattctagatccacaagcctgtctatgacctgtattgccgtgggccttgttacactctacctgggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctctctgcggccatcggcaaggcttgggaggagggggtctgcggcatcagaagcgccacgcgcctggaaaacattatgtggaaacagatctccaacgagcttaatcatattctgctcgaaaacgacatgaagttcacagtggttgtgggagatgtcgctggcatcctggcccaggggaaaaagatgattcggccgcaacccatggagcacaaatactcttggaaaagctggggaaaggccaagatcatcggcgctgacgtgcagaataccacctttattatcgatgggcctaacacacccgaatgtcctgacgatcagagagcgtggaatatttgggaggtggaggactatggattcggcatctttaccacgaacatttggctgaaacttcgcgattcctacacacaggtctgcgaccaccggctcatgagcgccgctatcaaagattctaaggccgttcatgccgacatgggctattggatcgaatccgagaaaaatgaaacctggaagctggctagagccagcttcattgaggtgaagacatgtatctggcccaaatctcacaccctgtggtccaacggggtgctcgaaagcgagatgattatcccgaagatttacggaggccctatctctcaacataattatcgccccgggtacttcacacagaccgcgggaccttggcacctgggcaaacttgagctggattttgacctctgcgaagggacgaccgtcgtggttgatgagcactgcggaaaccggggccccagcctgagaacaaccacagtgaccggcaagatcattcatgaatggtgttgccggtcctgtacgctgcctccccttcgcttcagaggggaggacggatgctggtacggcatggagatccggccggtcaaagaaaaggaggaaaatctcgtcaagagcatggtttctgctgggtccggagaggtggacagcttttccctgggcctgctctgtatttctatgatgatcgaagaggtcatgagaagccgctggtcccggaaaatgctgatgacagggacccttgccgtgttctttctgctcattatgggacagctgacatggaacgatctgatcagactttgcattatggttggcgccaatgcttctgaccgcatgggcatggggaccacctatctggccctcatggcgacattcaagatgagacctatgtttgctgtgggactgctgttccggcgcctgacgagcagagaggtccttctgctcaccatcggcctgtccctggtggcctctgtggaacttcccaacagcctggaggaactcggggatggactggccatgggcatcatgattctcaaactgcttacagactttcaatcccaccagctgtgggctaccctcctgagcctgacattcatcaagaccacgttttctcttcattacgcctggaaaacaatggctatggtcctgtccattgttagcctcttccccctgtgtctctctaccacctcccagaagacaacctggctgcctgtgcttctggggagcctgggatgcaagccgctcacaatgtttctgatcgccgagaataaaatttggggccggaagtcttggccccttaacgaaggcatcatggcggtggggatcgtctccattctgctcagctccctgctcaaaaacgatgtgcctctggccggaccccttatcgctggcgggatgctgattgcctgttatgttatcagcggatctagcgctgacctgtccctcgagaaggccgccgaggtgtcttgggaagaggaagctgagcacagcggcgcgtcccataatattctggtcgaagtgcaggatgacgggacgatgaaaatcaaggatgaggagcgcgacgatacccttacaatcctgctcaaagccaccctgctcgctgtttctggagtgtaccctctgagcattcccgccacacttttcgtctggtatttctggcaaaagaagaaacagagatccggcgtgctgtgggacaccccttctcccccggaagtcgagcgggccgtgctggatgacggcatctaccgcattatgcagagagggctcctgggacggagccaggttggcgtgggggtctttcaagaaaacgtgttccacacgatgtggcacgttacccgcggagctgtgcttatgtatcagggcaagagactggagccttcctgggccagcgtcaaaaaggacctcatctcttacgggggaggctggcggctgcagggctcctggaatacaggggaggaagtccaggtgattgcggttgagcccggcaagaatcctaagaatgtccaaaccgctcccggcacatttaagaccccggaaggggaggtgggagccatcgccctcgatttcaaacctggcacaagcgggtctcccattgtgaacagagaaggaaagatcgtcggcctgtacggcaatggggtggttacgacctccggaacatatgtgagcgctatcgcccaggcgaaggcttcccaggagggccctcttcccgagattgaagacgaggtctttcgcaagcggaacctgaccatcatggatctgcatcccgggtctggaaaaaccagacgctacctccctgccattgtgcgggaagccatcaagagaaagctgcgcacacttattctggctccgacgcgggttgtggccagcgagatggctgaagccctcaaaggcatgcccatcagatatcaaaccacagcggtcaagtccgagcacaccgggaaagagatcgtggacctgatgtgccatgccacattcaccatgcgcctgctcagccctgttcgggtgcccaattacaacatgattatcatggatgaagctcactttacggacccttcttccattgccgctagaggctatatcagcacacgggtcggaatgggcgaggccgccgctattttcatgaccgcgacaccccctgggtctgtggaagcctttccgcagagcaatgctgtgatccaggatgaggaacgcgacatccccgagagatcctggaactctggatacgagtggattacagatttccctggcaagaccgtctggtttgttcccagcatcaaatccgggaatgacattgccaactgtcttcggaagaatggaaagcgcgtgatccagctgtctagaaaaacattcgataccgaatatcaaaagacgaaaaacaacgactgggactacgtggtcacaaccgatattagcgagatgggcgccaatttccgggctgacagagtgatcgatcctcgccggtgcctgaagcccgttattctcaaagacgggccggaaagagtgatcctggccggccctatgcccgtcacagtggcgtccgctgcccagcgccggggaagagttggccgcaaccataataaggagggggatcagtacatctatatgggacagccccttaacaatgacgaggatcacgcccactggaccgaagctaagatgctgctcgacaacattaatacgcctgagggcatcattcccgccctgtttgaacctgagcgggaaaagagcgcggccatcgatggggagtacagactgcgcggagaggctagaaagaccttcgtggagctcatgcggcgcggcgaccttccggtctggctgtcttataaagtggcctccgaggggtttcaatacagcgatagacggtggtgcttcgacggcgaacgcaacaatcaggtcctggaggaaaacatggatgtggagatttggacaaaggagggagaacgcaaaaagctccggcccagatggctggacgctcgcacctattccgaccctcttgccctgcgggagtttaaagagttcgctgccggcagacgctctgttagcggggatctcatcctggagatcggaaagctgccccagcatctcacacagcgggcgcaaaatgcccttgacaacctggtgatgctgcacaattccgaacagggcgggagagcttaccggcatgccatggaggagctccctgataccattgaaacactgatgcttctggctctcatcgccgtgctgaccggaggcgtcacgctgtttttcctctctggccgcgggcttggaaagacaagcattggcctgctgtgtgttatggcctccagcgtgctcctgtggatggcttctgtggagccccactggatcgcggcctccattatccttgaatttttcctgatggtcctcctgatcccggagcctgacagacagcggacaccccaggataaccaactggcttatgtggttattgggctcctttttatgatcctgaccgtggccgccaatgagatgggactgctcgaaacaaccaaaaaggacctgggcattgggcacgtcgctgtggagaaccatcaccatgccgcgatgcttgatgtcgacctgcaccctgccagcgcttggacactctacgccgtggctacgaccatcattacacccatgatgcgccataccatcgaaaacacaaccgccaatatttctctgacggcgatcgccaaccaggctgccatcctgatgggactcgataaaggctggcctatttccaagatggacatcggcgttccccttctggctctggggtgctacagccaggtgaatccgctcaccctgacagccgctgtccttatgctggtggcccactatgcgattatcggacctggcctccaagccaaagctaccagagaggcccagaagcggacagctgccgggattatgaagaaccccaccgttgatggaatcgtggccatcgacctggatcccgtcgtgtacgacgcgaaattcgaaaagcagctgggccagattatgctccttatcctgtgtacgtctcaaattctgctcatgcgcacaacctgggctctgtgcgagagcatcacacttgccaccgggcctctgaccacactctgggagggatccccgggcaaattttggaatacgaccattgctgtgtctatggccaacatcttcagaggcagctatctggccggggctggactggccttctccctcatgaaaagccttggcgggggacggcgcggcacaggggcgcagggagaaaccctgggcgagaaatggaagagacagctgaatcagctctccaagtctgaatttaacacatacaaacggagcggcatcatggaggttgacagatccgaagccaaggaggggctgaaacgcggagagaccacgaagcacgctgtctctcggggcacagccaaacttagatggttcgtggaacgcaatctggtgaagcccgaggggaaggtcattgatctcggatgtggcagagggggatggagctattactgcgctggcctgaaaaaggttaccgaagtgaaaggctataccaaagggggacctggccatgaggaacccatccctatggccacatacgggtggaacctggtgaaactccactccggaaaggacgtctttttcattccccctgagaaatgtgatacccttctgtgcgacatcggcgagtctagcccgaatcccacaattgaagaggggagaacgctgcgcgtgctcaagatggttgaaccttggctgcggggaaaccaattttgtatcaagattcttaatccctacatgccttccgtggtcgagaccctggagcagatgcagagaaaacatggcggcatgctcgtgcgcaaccccctgagcagaaattctacacacgaaatgtattgggtttcctgcgggaccggaaacatcgtgagcgcggtcaatatgacatctagaatgctgctcaaccgcttcaccatggcccaccggaagccgacgtacgagagagatgtggacctgggcgctgggacccgccatgtggccgtcgaacctgaggttgctaaccttgatatcattggacagagaatcgaaaatattaaacacgagcataagtccacatggcactatgacgaggataacccctacaaaacctgggcctatcatggcagctacgaagtgaagccctctgggtccgctagctccatggtgaatggagtcgtgaagctgctcacaaaaccttgggacgttatccccatggtgacccaaattgccatgacagataccacgccttttggccagcagcgggtcttcaaggagaaagtggacacacgcaccccgaaggcgaaaagaggcaccacacaaatcatggaagttacggcccggtggctgtggagctttctttctagaaacaagaagccccggatctgtacccgcgaggagttcacaagaaaagtgcggagcaatgctgccattggggctgtctttgtggacgagaaccagtggaactccgccaaggaggccgttgaagatgagcgcttctgggacctggtgcacagagaacgggagctccacaaacagggaaagtgcgcgacctgcgtctataacatgatgggcaaacgcgaaaagaagctgggggagtttggaaaagctaagggctctagagccatctggtacatgtggctgggggcccggttcctcgagttcgaagctctgggctttatgaatgaggatcattggttcagccgcgaaaactccctttctggagtggagggcgaggggctgcacaaactcggatacattctgagagacatcagcaagattcctggcgggaatatgtatgccgatgacacagctggatgggatacccggatcacagaagacgatcttcagaacgaggccaaaatcaccgacattatggaacccgagcatgcgctgctcgccaaggctatctttaaactgacgtaccaaaataaggtcgtgcgcgttcagagacctgccaagaacggcaccgtgatggatgtcatttcccggcgcgaccagagagggtctggccaggtgggaacatatggcctgaataccttcacaaacatggaagctcaactcatccggcagatggagagcgaggggatcttttcccccagcgaactggagacctctaaccttgccgaaagagtgctggattggctcgagaaatacggagttgaacgcctgaagcggatggcgatctccggcgacgactgtgtggtcaaaccgatcgatgacagattcgccacggctcttacagccctgaatgatatggggaaggtgcgcaaagacattcctcagtgggagcccagcaagggatggaacgattggcagcaagttcctttttgctctcaccacttccatcagctcatcatgaaggacggccgggagattgtggtcccctgtagaaatcaggatgaactggtggggcgcgctcgggtctcccagggcgccggatggagcctgagagagaccgcttgcctcggcaaatcctatgcccaaatgtggcagctgatgtactttcaccgccgggaccttagactggcggccaacgctatctgttctgccgtgcctgttgattgggtgcccacaagccgcaccacgtggtccattcatgcccaccatcagtggatgaccacagaagacatgctcagcgtctggaatcgggtgtggatcgaggaaaacccgtggatggaggataagacccacatttcttcctgggaggacgttccttatctggggaaaagagaagaccaatggtgcggaagccttatcggcctgacagctcgggccacctgggcgacaaatatccaggtggctattaaccaggtcagacgcctcatcgggaatgagaactacctggattacatgacctctatgaagcggttcaaaaatgaaagcgaccccgagggagccctgtggtga

SEQ ID NO: 19438 - RNA, 9879 nt, synthetic construct
  misc_feature 1..9879: note = derived and/or modified CDS sequence (opt5) from DENV-1__KC762647__SS-prME
  source 1..9879: mol_type = other RNA
agcgtgaccatgctgctcatgctgacacccacggctcttgctttccacctgaccacacggggcggggagcctcatatgatcgtgtccaagcaggaacggggaaagtctctcctgtttaagaccagcgccggcgttaacatgtgcacacttattgcgatggacctgggggagctctgtgaagataccctgacatacaaatgcccccgcatcaccgaggctgaacccgacgatgtggactgttggtgcaatgccacggatacctgggtgacatatggaacctgttcccaaacaggcgagcaccggcgggacaagcgctctgtcgccctggctcctcatgtggggctcggactggagacccggacggaaacatggatgagctccgagggcgcctggaaacagattcagcgggttgaaacctgggcccttcgccaccccggcttcacagtgatcgccctgtttctcgcgcatgccattgggacctctatcacccagaagggaatcattttcatcctgcttatgctggtcacacctagcatggctatgagatgcgtgggcattgggtcccgggattttgttgagggactcagcggcgccacgtgggtggacgtcgtgctggagcacgggtcttgtgtgaccacaatggctaaggataaacccaccctggacatcgaactcctgaagacagaggtcaccaaccctgccgttcttcgcaaactgtgcattgaagcgaagatctccaatacgacaaccgatagcagatgtccgacccaaggagaggccacactcgtggaagaacaagacgctaacttcgtgtgccggcgcacctttgtcgatagaggctggggcaatgggtgtggactgttcggcaaagggtctcttattacatgcgccaagtttaagtgcgtgacgaaactggagggaaagatcgttcagtacgaaaacctcaaatattccgtgatcgtcaccgtgcacacaggcgaccagcatcaagttgggaatgagagcaccgaacacggaacaaccgctacgattacaccccaagcccctacaaccgagatccagctgacagactacggcgccctgaccctcgattgttctccccggacgggcctggacttcaacgaaatggtgcttctgacaatgaaggagaaatcctggctcgtccataagcagtggtttctggatcttcctctgccctggaccagcggggcttccacatctcaagagacctggaatcgccaggacctcctggtgaccttcaaaacagcgcacgccaagaagcaggaagtcgtggttctgggaagccaagagggcgctatgcacacggccctcaccggggccacagaaattcagacctccggaacaaccacgatctttgctggccatctgaaatgcagacttaagatggataaactgacactcaaggggatgagctatgtgatgtgtaccggctctttcaaactggagaaggaagtcgccgagacccagcacggaacagtgctggttcagattaagtacgagggcaccgacgcgccgtgcaaaatccctttctccacacaagatgaaaagggggtgacgcagaacggacggcttatcaccgctaatcccattgtcacagacaaagagaagcctgtgaacatcgaagccgagccgccctttggcgagagctatattgtgatcggggccggagaaaaagctctcaagctgtcttggttcaagaaaggcagctccattgggaagatgtttgaggccaccgctagaggcgcccgccggatggcgatcctgggagatacagcctgggacttcggctctatcgggggagtttttaccagcgtcggcaaactcgtgcatcagattttcgggacggcttacggagtgctgttttccggcgtcagctggaccatgaagatcgggattggcgtgcttctgacatggctcggactcaattctagatccaccagcctgtctatgacatgtatcgccgttggccttgtgaccctctacctgggggtcatggtgcaggctgattccggatgcgttattaactggaaaggccgcgaactgaagtgtgggagcggaatcttcgtgacaaatgaggtccacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgttgtggtcggagatgtggctggcattctggcccaggggaaaaagatgatccggccgcaacccatggagcacaaatactcttggaaaagctggggaaaggccaagattatcggcgctgacgtgcagaataccacatttatcattgatgggcctaacacccccgaatgtcctgacgatcagagagcgtggaatatctgggaggtcgaggactatggattcggcatttttacgacaaacatctggctgaaacttcgcgattcctacacccaggtttgcgaccaccggctcatgagcgccgctattaaagattctagagccgtgcatgccgacatgggctattggatcgaatccgagaagaatgaaacatggaaactggctcgcgccagcttcatcgaggtgaagacctgtgtctggcccaagtctcacacactgtggtccaacggggtgctcgaaagcgagatgattatcccgaaaatttacggaggccctatctctcaacataattatcggcccgggtacttcacccagacggcgggaccttggcacctgggcaaacttgagctggattttgacctctgcgaagggaccacagttgtggtcgatgagcactgcggaaacagaggccccagcctgcggaccacaaccgtgacgggcaaaattatccatgaatggtgttgccgctcctgtacactgcctccccttagattcagaggggaagacggatgctggtacggcatggagatcagaccggttaaggaaaaagaggaaaatctcgtcaagagcatggtctctgctgggtccggagaggtggacagcttttccctgggcctgctctgtatttctatcatgattgaagaggttatgcgcagccggtggtccagaaagatgctgatgaccgggacacttgccgtgttctttctgctcatcatgggacagctgacctggaacgatctgattcgcctttgcatcatggtcggcgccaatgcttctgacagaatgggcatggggaccacatatctggccctcatggcgacgttcaaaatgcggcctatgtttgctgtgggactgctgttccgcagactgaccagccgggaggtgcttctgctcacaattggcctgtccctggtcgcctctgttgaacttcccaacagcctggaggaactcggggatggactggccatgggcatcatgatcctcaagctgcttaccgactttcaatcccaccagctgtgggctacactcctgagcctgaccttcattaaaacgacattttctcttcattacgcctggaagaccatggctatggtgctgtccatcgtgagcctcttccccctgtgtctctctaccacatcccagaaaaccacatggctgcctgtccttctggggagcctgggatgcaagccgctcacgatgtttctgattgccgagaataagatctggggccgcaaatcttggccccttaacgaaggcattatggcggtggggatcgtttccatcctgctcagctccctgctcaagaacgatgtgcctctggccggaccccttattgctggcgggatgctgatcgcctgttatgtcattagcggatctagcgctgacctgtccctcgagaaagccgccgaggtgtcttgggaagaggaagctgagcacagcggcgcgtcccataatatcctggttgaagtgcaggatgacgggaccatgaagattaaagatgaggagagagacgatacacttaccatcctgctcaaggccacactgctcgctgtctctggagtgtaccctctgagcatccccgccacccttttcgtctggtatttctggcagaagaagaagcagcggtccggcgtgctgtgggacacgccttctcccccggaagttgagcgcgccgtgctggatgacggcatttacagaatcatgcagcgggggctcctgggacgcagccaggtcggcgtgggggtttttcaagaaaacgtgttccacaccatgtggcacgtcacaagaggagctgtgcttatgtatcagggcaaacggctggagccttcctgggccagcgtgaagaaagacctcatttcttacgggggaggctggagactgcagggctcctggaataccggggaggaagttcaggtcatcgcggtggagcccggaaagaaccctaaaaatgtgcaaacagctcccggcacctttaagacaccggaaggggaggtcggagccattgccctcgatttcaagcctggcacgagcgggtctcccatcgtgaaccgcgaaggaaaaattgttggcctgtacggcaatggggtggtcaccacatccggaacctatgtgagcgctatcgcccaggcgaaggcttcccaggagggccctcttcccgagatcgaagacgaggtttttcggaaaagaaacctgaccattatggatctgcatcccgggtctggaaagacacgccggtacctccctgccatcgtgagagaagccattaaacgcaagctgcggacgcttatcctggctccgaccagagtcgtggccagcgagatggctgaagccctcaagggcatgcccattcgctatcaaacaaccgcggttaaatccgagcacacagggaaggagatcgtggacctgatgtgccatgccaccttcacgatgcggctgctcagccctgtcagagtgcccaattacaacatgatcattatggatgaagctcactttacagacccttcttccatcgccgctcggggctatattagcacccgcgtgggaatgggcgaggccgccgctatcttcatgaccgcgacaccccctgggtctgtcgaagcctttccgcagagcaatgctgttattcaggatgaggaaagagacatccccgagcggtcctggaactctggatacgagtggatcaccgatttccctggcaaaacagtgtggtttgtgcccagcattaagtccgggaatgacatcgccaactgtcttcgcaaaaatggaaagagagtcattcagctgtctcggaagaccttcgatacggaatatcagaagaccaagaacaacgactgggactacgtggttaccacagatatcagcgagatgggcgccaatttcagagctgaccgcgtgattgatcctcggagatgcctgaaacccgtcatcctcaaggacgggccggaacgcgtgattctggccggccctatgcccgttaccgtggcgtccgctgcccagcggagaggacgcgtcggccggaaccataataaagagggggatcagtacatctatatgggacagccccttaacaatgacgaggatcacgcccactggacggaagctaagatgctgctcgacaacatcaatacccctgagggcattatccccgccctgtttgaacctgagagagaaaagagcgcggccattgatggggagtaccgcctgagaggagaggctcggaaaacattcgtggaactcatgcgcagaggcgaccttccggtctggctgtcttataaggtggcctccgaggggtttcaatacagcgatcggcgctggtgcttcgacggcgaaagaaacaatcaggttctggaggaaaacatggatgtggagatctggaccaaagagggagaacggaagaaactcagaccccgctggctggacgctcggacatattccgaccctcttgccctgagagagtttaaggagttcgctgccggccgccggtctgtgagcggggatctcattctggagatcggaaaactgccccagcatctcacccagaaggcgcaaaatgcccttgacaacctggtcatgctgcacaattccgaacagggcgggagagcttaccggcatgccatggaggagctccctgatacaatcgaaaccctgatgcttctggctctcattgccgttctgacgggaggcgtgacactgtttttcctctctggccgcgggcttggaaagaccagcatcggcctgctgtgtgtgatggcctccagcgtcctcctgtggatggcttctgtggagccccactggattgcggcctccatcattcttgaatttttcctgatggttctcctgatcccggagcctgacagacagcggacaccccaggataaccaactggcttatgtggtcatcgggctcctttttatgattctgacagtggccgccaatgagatgggactgctcgaaaccaccaagaaggacctgggcatcgggcacgtcgctgtggagaaccatcaccatgccgcgatgcttgatgttgacctgcaccctgccagcgcttggacgctctacgccgtggctaccacaattatcacccccatgatgcgccatacaattgaaaacaccacggccaatatctctctgaccgcgattgccaaccaggctgccatcctgatgggactcgataaaggctggcctatctccaagatggacattggcgtcccccttctggctctggggtgctacagccaggtgaatccgctcacactgaccgccgctgttcttatgctggtggcccactatgcgatcattggacctggcctccaagccaaagctacaagagaggcccagaagcggaccgctgccgggatcatgaagaaccccacggtcgatggaattgtggccatcgacctggatcccgtggtttacgacgcgaaattcgaaaagcagctgggccagatcatgctccttattctgtgtacatctcaaatcctgctcatgcgcaccacatgggctctgtgcgagagcattacccttgccaccgggcctctgacaacgctctgggagggatccccgggcaaattttggaataccacaatcgctgtctctatggccaacattttcagaggcagctatctggccggggctggactggccttctccctcatgaaaagccttggcgggggacggcgcggcaccggggcgcagggagaaacactgggcgagaaatggaagagacagctgaatcagctctccaagtctgaatttaacacctacaaacggagcggcatcatggaggtggacagatccgaagccaaggaggggctgaaacgcggagagacgacaaagcacgctgtgtctcggggcaccgccaaacttagatggttcgtcgaacgcaatctggttaagcccgaggggaaggtgatcgatctcggatgtggcagagggggatggagctattactgcgctggcctgaaaaaggtgaccgaagtcaaaggctatacaaaagggggacctggccatgaggaacccattcctatggccacctacgggtggaacctggtgaaactccactccggaaaggacgtgtttttcattccccctgagaaatgtgatacacttctgtgcgacatcggcgagtctagcccgaatcccacgatcgaagaggggagaaccctgcgcgttctcaagatggtcgaaccttggctgcggggaaaccaattttgtattaaggtgcttaatccctacatgccttccgttgtggagacactggagcagatgcagagaaaacatggcggcatgctcgtccgcaaccccctgagcagaaattctacccacgaaatgtattgggtgtcctgcgggacaggaaacatcgtgagcgcggtcaatatgacctctagaatgctgctcaaccgcttcacgatggcccaccggaagccgacctacgagagagatgttgacctgggcgctgggacacgccatgtggccgtggaacctgaggtcgctaaccttgatattatcggacagagaatcgaaaatattaaacacgagcataagtccacctggcactatgacgaggataacccctacaaaacatgggcctatcatggcagctacgaagtgaagccctctgggtccgctagctccatggttaatggagtggtcaagctgctcaccaaaccttgggacgtgatccccatggttacacaaattgccatgaccgatacgacaccttttggccagcagcgggtgttcaaggagaaagtcgacacccgcaccccgaaggcgaaaagaggcacaacgcaaatcatggaagtgaccgcccggtggctgtgggggtttcttagcagaaacaagaagccccggatttgtacacgcgaggagttcaccagaaaagttcggtctaatgctgccatcggagctgtgtttgtcgacgagaaccagtggaatagcgccaaggaggccgtggaagatgagcgcttctgggacctggtccacagagaacgggagctccacaaacagggcaagtgcgcgacatgcgtgtataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgttgagggggagggactgcacaaactcggctacattctgagagacatctctaagattcctgggggaaatatgtatgccgatgacaccgctggctgggatacacggatcaccgaagacgatcttcagaacgaggccaaaattacggacatcatggaacccgagcatgcgctgctcgccaaggctatctttaaactgacctaccaaaataaggtggtccgcgtgcagagacctgccaagaacgggacagtgatggatgttattagccggcgcgaccagagaggctccggacaggtgggcacctatgggctgaatacattcaccaacatggaagctcaactcatccggcagatggagtctgagggaatttttagcccctccgaactggagacgccgaaccttgccgaaagagtcctggattggctcgagaaatacggcgtggaacgcctgaagcggatggcgatcagcggggacgactgtgttgtgaaacctattgatgacagattcgccacagctcttaccgccctgaatgatatgggaaaggtccgcaaagacatcccccagtgggagccttctaagggctggaacgattggcagcaagtgcccttttgctcccaccacttccatcagctcatcatgaaggacgggcgggagattgtcgtgccttgtagaaatcaggatgaactggttggccgcgctcgggtgagccagggagccggctggtctctgagagagcccgcttgcctcgggaaatcctatgcccaaatgtggcagctgatgtactttcaccgccgggaccttagactggcggccaacgctatctgtagcgccgtcccggtggattgggttcctacatcccgcaccacgtggtctattcatgcccaccatcagtggatgaccacagaagacatgctcagcgtgtggaatcgggtctggatcgaggaaaacccctggatggaggataagacccacatttccagctgggaggacgtgccctatctgggaaaaagagaagaccaatggtgcggctctcttatcgggctgacagctcgggccacctgggcgacaaatattcaggtggctatcaaccaggttagacgcctcatcggaaatgagaactacctggattacatgacctccatgaagcggttcaaaaatgaaagcgaccctgagggcgccctgtggtga

SEQ ID NO: 19439 - RNA, 9879 nt, synthetic construct
  misc_feature 1..9879: note = derived and/or modified CDS sequence (opt5) from DENV-1__KC762639__SS-prME
  source 1..9879: mol_type = other RNA
agcgtgaccatgctgctcatgctgacacccacggctcttgctttccacctgaccacacggggcggggagcctcatatgatcgtgtccaagcaggaacggggaaagtctctcctgtttaagaccagcgccggcgttaacatgtgcacacttattgcgatggacctgggggagctctgtgaagataccctgacatacaaatgcccccgcatcaccgaggctgaacccgacgatgtggactgttggtgcaatgccacggatacctgggtgacatatggaacctgttcccaaacaggcgagcaccggcgggacaagcgctctgtcgccctggctcctcatgtggggctcggactggagacccggacggaaacatggatgagctccgagggcgcctggaaacagattcagcgggttgaaacctgggcccttcgccaccccggcttcacagtgatcgccctgtttctcgcgcatgccattgggacctctatcacccagaagggaatcattttcatcctgcttatgctggtcacacctagcatggctatgagatgcgtgggcattgggtcccgggattttgttgagggactcagcggcgccacgtgggtggacgtcgtgctggagcacgggtcttgtgtgaccacaatggctaaggataaacccaccctggacatcgaactcctgaagacagaggtcaccaaccctgccgttcttcgcaaactgtgcattgaagcgaagatctccaatacgacaaccgatagcagatgtccgacccaaggagaggccacactcgtggaagaacaagacgctaacttcgtgtgccggcgcacctttgtcgatagaggctggggcaatgggtgtggactgttcggcaaagggtctcttattacatgcgccaagtttaagtgcgtgacgaaactggagggaaagatcgttcagtacgaaaacctcaaatattccgtgatcgtcaccgtgcacacaggcgaccagcatcaagttgggaatgagagcaccgaacacggaacaaccgctacgattacaccccaagcccctacaaccgagatccagctgacagactacggcgccctgaccctcgattgttctccccggacgggcctggacttcaacgaaatggtgcttctgacaatgaaggagaaatcctggctcgtccataagcagtggtttctggatcttcctctgccctggaccagcggggcttccacatctcaagagacctggaatcgccaggacctcctggtgaccttcaaaacagcgcacgccaagaagcaggaagtcgtggttctgggaagccaagagggcgctatgcacacggccctcaccggggccacagaaattcagacctccggaacaaccacgatctttgctggccatctgaaatgcagacttaagatggataaactgacactcaaggggatgagctatgtgatgtgtaccggctctttcaaactggagaaggaagtcgccgagacccagcacggaacagtgctggttcagattaagtacgagggcaccgacgcgccgtgcaaaatccctttctccacacaagatgaaaagggggtgacgcagaacggacggcttatcaccgctaatcccattgtcacagacaaagagaagcctgtgaacatcgaagccgagccgccctttggcgagagctatattgtgatcggggccggagaaaaagctctcaagctgtcttggttcaagaaaggcagctccattgggaagatgtttgaggccaccgctagaggcgcccgccggatggcgatcctgggagatacagcctgggacttcggctctatcgggggagtttttaccagcgtcggcaaactcgtgcatcagattttcgggacggcttacggagtgctgttttccggcgtcagctggaccatgaagatcgggattggcgtgcttctgacatggctcggactcaattctagatccaccagcctgtctatgacatgtatcgccgttggccttgtgaccctctacctgggggtcatggtgcaggctgattccggatgcgttattaactggaaaggccgcgaactgaagtgtgggagcggaatcttcgtgacaaatgaggtccacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgttgtggtcggagatgtggctggcattctggcccaggggaaaaagatgatccggccgcaacccatggagcacaaatactcttggaaaagctggggaaaggccaagattatcggcgctgacgtgcagaataccacatttatcattgatgggcctaacacccccgaatgtcctgacgatcagagagcgtggaatatctgggaggtcgaggactatggattcggcatttttacgacaaacatctggctgaaacttcgcgattcctacacccaggtttgcgaccaccggctcatgagcgccgctattaaagattctagagccgtgcatgccgacatgggctattggatcgaatccgagaagaatgaaacatggaaactggctcgcgccagcttcatcgaggtgaagacctgtgtctggcccaagtctcacacactgtggtccaacggggtgctcgaaagcgagatgattatcccgaaaatttacggaggccctatctctcaacataattatcggcccgggtacttcacccagacggcgggaccttggcacctgggcaaacttgagctggattttgacctctgcgaagggaccacagttgtggtcgatgagcactgcggaaacagaggccccagcctgcggaccacaaccgtgacgggcaaaattatccatgaatggtgttgccgctcctgtacactgcctccccttagattcagaggggaagacggatgctggtacggcatggagatcagaccggttaaggaaaaagaggaaaatctcgtcaagagcatggtctctgctgggtccggagaggtggacagcttttccctgggcctgctctgtatttctatcatgattgaagaggttatgcgcagccggtggtccagaaagatgctgatgaccgggacacttgccgtgttctttctgctcatcatgggacagctgacctggaacgatctgattcgcctttgcatcatggtcggcgccaatgcttctgacagaatgggcatggggaccacatatctggccctcatggcgacgttcaaaatgcggcctatgtttgctgtgggactgctgttccgcagactgaccagccgggaggtgcttctgctcacaattggcctgtccctggtcgcctctgttgaacttcccaacagcctggaggaactcggggatggactggccatgggcatcatgatcctcaagctgcttaccgactttcaatcccaccagctgtgggctacactcctgagcctgaccttcattaaaacgacattttctcttcattacgcctggaagaccatggctatggtgctgtccatcgtgagcctcttccccctgtgtctctctaccacatcccagaaaaccacatggctgcctgtccttctggggagcctgggatgcaagccgctcacgatgtttctgattgccgagaataagatctggggccgcaaatcttggccccttaacgaaggcattatggcggtggggatcgtttccatcctgctcagctccctgctcaagaacgatgtgcctctggccggaccccttattgctggcgggatgctgatcgcctgttatgtcattagcggatctagcgctgacctgtccctcgagaaagccgccgaggtgtcttgggaagaggaagctgagcacagcggcgcgtcccataatatcctggttgaagtgcaggatgacgggaccatgaagattaaagatgaggagagagacgatacacttaccatcctgctcaaggccacactgctcgctgtctctggagtgtaccctctgagcatccccgccacccttttcgtctggtatttctggcagaagaagaagcagcggtccggcgtgctgtgggacacgccttctcccccggaagttgagcgcgccgtgctggatgacggcatttacagaatcatgcagcgggggctcctgggacgcagccaggtcggcgtgggggtttttcaagaaaacgtgttccacaccatgtggcacgtcacaagaggagctgtgcttatgtatcagggcaaacggctggagccttcctgggccagcgtgaagaaagacctcatttcttacgggggaggctggagactgcagggctcctggaataccggggaggaagttcaggtcatcgcggtggagcccggaaagaaccctaaaaatgtgcaaacagctcccggcacctttaagacaccggaaggggaggtcggagccattgccctcgatttcaagcctggcacgagcgggtctcccatcgtgaaccgcgaaggaaaaattgttggcctgtacggcaatggggtggtcaccacatccggaacctatgtgagcgctatcgcccaggcgaaggcttcccaggagggccctcttcccgagatcgaagacgaggtttttcggaaaagaaacctgaccattatggatctgcatcccgggtctggaaagacacgccggtacctccctgccatcgtgagagaagccattaaacgcaagctgcggacgcttatcctggctccgaccagagtcgtggccagcgagatggctgaagccctcaagggcatgcccattcgctatcaaacaaccgcggttaaatccgagcacacagggaaggagatcgtggacctgatgtgccatgccaccttcacgatgcggctgctcagccctgtcagagtgcccaattacaacatgatcattatggatgaagctcactttacagacccttcttccatcgccgctcggggctatattagcacccgcgtgggaatgggcgaggccgccgctatcttcatgaccgcgacaccccctgggtctgtcgaagcctttccgcagagcaatgctgttattcaggatgaggaaagagacatccccgagcggtcctggaactctggatacgagtggatcaccgatttccctggcaaaacagtgtggtttgtgcccagcattaagtccgggaatgacatcgccaactgtcttcgcaaaaatggaaagagagtcattcagctgtctcggaagaccttcgatacggaatatcagaagaccaagaacaacgactgggactacgtggttaccacagatatcagcgagatgggcgccaatttcagagctgaccgcgtgattgatcctcggagatgcctgaaacccgtcatcctcaaggacgggccggaacgcgtgattctggccggccctatgcccgttaccgtggcgtccgctgcccagcggagaggacgcgtcggccggaaccataataaagagggggatcagtacatctatatgggacagccccttaacaatgacgaggatcacgcccactggacggaagctaagatgctgctcgacaacatcaatacccctgagggcattatccccgccctgtttgaacctgagagagaaaagagcgcggccattgatggggagtaccgcctgagaggagaggctcggaaaacattcgtggaactcatgcgcagaggcgaccttccggtctggctgtcttataaggtggcctccgaggggtttcaatacagcgatcggcgctggtgcttcgacggcgaaagaaacaatcaggttctggaggaaaacatggatgtggagatctggaccaaagagggagaacggaagaaactcagaccccgctggctggacgctcggacatattccgaccctcttgccctgagagagtttaaggagttcgctgccggccgccggtctgtgagcggggatctcattctggagatcggaaaactgccccagcatctcacccagaaggcgcaaaatgcccttgacaacctggtcatgctgcacaattccgaacagggcgggagagcttaccggcatgccatggaggagctccctgatacaatcgaaaccctgatgcttctggctctcattgccgttctgacgggaggcgtgacactgtttttcctctctggccgcgggcttggaaagaccagcatcggcctgctgtgtgtgatggcctccagcgtcctcctgtggatggcttctgtggagccccactggattgcggcctccatcattcttgaatttttcctgatggttctcctgatcccggagcctgacagacagcggacaccccaggataaccaactggcttatgtggtcatcgggctcctttttatgattctgacagtggccgccaatgagatgggactgctcgaaaccaccaagaaggacctgggcatcgggcacgtcgctgtggagaaccatcaccatgccgcgatgcttgatgttgacctgcaccctgccagcgcttggacgctctacgccgtggctaccacaattatcacccccatgatgcgccatacaattgaaaacaccacggccaatatctctctgaccgcgattgccaaccaggctgccatcctgatgggactcgataaaggctggcctatctccaagatggacattggcgtcccccttctggctctggggtgctacagccaggtgaatccgctcacactgaccgccgctgttcttatgctggtggcccactatgcgatcattggacctggcctccaagccaaagctacaagagaggcccagaagcggaccgctgccgggatcatgaagaaccccacggtcgatggaattgtggccatcgacctggatcccgtggtttacgacgcgaaattcgaaaagcagctgggccagatcatgctccttattctgtgtacatctcaaatcctgctcatgcgcaccacatgggctctgtgcgagagcattacccttgccaccgggcctctgacaacgctctgggagggatccccgggcaaattttggaataccacaatcgctgtctctatggccaacattttcagaggcagctatctggccggggctggactggccttctccctcatgaaaagccttggcgggggacggcgcggcaccggggcgcagggagaaacactgggcgagaaatggaagagacagctgaatcagctctccaagtctgaatttaacacctacaaacggagcggcatcatggaggtggacagatccgaagccaaggaggggctgaaacgcggagagacgacaaagcacgctgtgtctcggggcaccgccaaacttagatggttcgtcgaacgcaatctggttaagcccgaggggaaggtgatcgatctcggatgtggcagagggggatggagctattactgcgctggcctgaaaaaggtgaccgaagtcaaaggctatacaaaagggggacctggccatgaggaacccattcctatggccacctacgggtggaacctggtgaaactccactccggaaaggacgtgtttttcattccccctgagaaatgtgatacacttctgtgcgacatcggcgagtctagcccgaatcccacgatcgaagaggggagaaccctgcgcgttctcaagatggtcgaaccttggctgcggggaaaccaattttgtattaaggtgcttaatccctacatgccttccgttgtggagacactggagcagatgcagagaaaacatggcggcatgctcgtccgcaaccccctgagcagaaattctacccacgaaatgtattgggtgtcctgcgggacaggaaacatcgtgagcgcggtcaatatgacctctagaatgctgctcaaccgcttcacgatggcccaccggaagccgacctacgagagagatgttgacctgggcgctgggacacgccatgtggccgtggaacctgaggtcgctaaccttgatattatcggacagagaatcgaaaatattaaacacgagcataagtccacctggcactatgacgaggataacccctacaaaacatgggcctatcatggcagctacgaagtgaagccctctgggtccgctagctccatggttaatggagtggtcaagctgctcaccaaaccttgggacgtgatccccatggttacacaaattgccatgaccgatacgacaccttttggccagcagcgggtgttcaaggagaaagtcgacacccgcaccccgaaggcgaaaagaggcacaacgcaaatcatggaagtgaccgcccggtggctgtgggggtttcttagcagaaacaagaagccccggatttgtacacgcgaggagttcaccagaaaagttcggtctaatgctgccatcggagctgtgtttgtcgacgagaaccagtggaatagcgccaaggaggccgtggaagatgagcgcttctgggacctggtccacagagaacgggagctccacaaacagggcaagtgcgcgacatgcgtgtataacatgatggggaaacgcgaaaagaagctgggagagtttggcaaagctaaggggtccagagccatctggtacatgtggctgggcgcccggttcctcgagttcgaagctctgggatttatgaatgaggatcattggttctctcgcgaaaacagcctttccggcgttgagggggagggactgcacaaactcggctacattctgagagacatctctaagattcctgggggaaatatgtatgccgatgacaccgctggctgggatacacggatcaccgaagacgatcttcagaacgaggccaaaattacggacatcatggaacccgagcatgcgctgctcgccaaggctatctttaaactgacctaccaaaataaggtggtccgcgtgcagagacctgccaagaacgggacagtgatggatgttattagccggcgcgaccagagaggctccggacaggtgggcacctatgggctgaatacattcaccaacatggaagctcaactcatccggcagatggagtctgagggaatttttagcccctccgaactggagacgccgaaccttgccgaaagagtcctggattggctcgagaaatacggcgtggaacgcctgaagcggatggcgatcagcggggacgactgtgttgtgaaacctattgatgacagattcgccacagctcttaccgccctgaatgatatgggaaaggtccgcaaagacatcccccagtgggagccttctaagggctggaacgattggcagcaagtgcccttttgctcccaccacttccatcagctcatcatgaaggacgggcgggagattgtcgtgccttgtagaaatcaggatgaactggttggccgcgctcgggtgagccagggagccggctggtctctgagagagacagcttgcctcgggaaatcctatgcccaaatgtggcagctgatgtactttcaccgccgggaccttagactggcggccaacgctatctgtagcgccgtccccgtggattgggttccgacctcccgcacgacctggtctattcatgcccaccatcagtggatgacaaccgaagacatgctcagcgtgtggaatcgggtctggatcgaggaaaacccttggatggaggataagacacacatttccagctgggaggacgtgccctatctgggaaaaagagaagaccaatggtgcggctctcttatcgggctgaccgctcgggccacatgggcgaccaatattcaggtggctatcaaccaggttagacgcctcatcggaaatgagaactacctggattacatgacgtccatgaagcggttcaaaaatgaaagcgaccccgagggcgccctgtggtga

SEQ ID NO: 19440 - RNA, 9879 nt, synthetic construct
  misc_feature 1..9879: note = derived and/or modified CDS sequence (opt5) from DENV-1__KC762642__SS-prME
  source 1..9879: mol_type = other RNA
agcgtgaccatgctgctcatgctgatgcccacagctcttgctttccacctgacgaccagaggaggggaacctcatatgattgtctccaagcaggaacggggaaaatctctcctgtttaagaccagcgccggcgttaacatgtgcacccttattgcgatggacctgggggaactctgtgaagatacactgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaagacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccaccacacaagagacctggaatcgccaggacctcctggtgaccttcaaaacagcgcacgccaagaagcaggaagtcgtggttctgggatctcaagagggcgctatgcacacggccctcaccggggccacagaaattcagaccagcggaacaaccacgatctttgctggccatctgaaatgcagacttaagatggataaactgacactcaaggggatgtcctatgtgatgtgtaccggcagcttcaaactggagaaggaagtcgccgagacccagcacggaacagtgctggttcagattaagtacgagggcaccgacgcgccgtgcaaaatccctttctctacacaagatgaaaagggggtgacgcagaacggacggcttatcaccgctaatcccattgtcacagacaaagagaagcctgtgaacatcgaagccgagccgccctttggcgagtcctatattgtgatcggggccggagaaaaagctctcaagctgagctggttcaagaaaggctctagcattgggaagatgtttgaggccaccgctagaggcgcccgccggatggcgatcctgggagatacagcctgggacttcggctccatcgggggagtttttacctctgtcggcaaactcgtgcatcagattttcgggacggcttacggagtgctgtttagcggcgtctcctggaccatgaagatcgggattggcgtgcttctgacatggctcggactgaatagcagatctacctccctgagcatgacatgtatcgccgttggccttgtgaccctctacctgggggtcatggtgcaggctgattctggatgcgttattaactggaaaggccgcgaactgaagtgtgggtccggaatcttcgtgacaaatgaggtccacacctggacggaacaatataagtttcaggccgacagccctaaacggctctccgcggccattggcaaggcttgggaggagggggtgtgcggcatcagatctgccacacgcctggaaaacatcatgtggaaacagattagcaacgagcttaatcatatcctgctcgaaaacgacatgaagttcaccgttgtggtcggagatgtggctggcattctggcccaggggaaaaagatgatccggccgcaacccatggagcacaaatactcctggaagtcttggggaaaggccaaaattatcggcgctgacgtgcagaataccacatttatcattgatgggcctaacacccccgaatgtcctgacgatcagagagcgtggaatatctgggaggtcgaggactatggattcggcatttttacgacaaacatctggctgaaacttcgcgatagctacacccaggtttgcgaccaccggctcatgtccgccgctattaaagatagcaaggccgtgcatgccgacatgggctattggatcgaatctgagaaaaatgaaacatggaagctggctagagcctccttcatcgaggtgaagacctgtatttggcccaaaagccacacactgtggtctaacggggtcctcgaatccgagatgatcattccgaagatctacggaggccctattagccaacataattatcgccccgggtacttcacccagacggcgggaccttggcacctgggcaaacttgagctggattttgacctctgcgaagggaccacagtggttgtggatgagcactgcggaaaccggggcccctctctgagaaccacaaccgtcacgggcaagatcatccatgaatggtgttgccggagctgtacactgcctccccttcgcttcagaggggaggacggatgctggtacggcatggagattcggccggtgaaagaaaaggaggaaaatctcgttaagtccatggtgagcgctgggtctggagaggtcgactcctttagcctgggcctgctctgtatctccattatgatcgaagaggtgatgagatctcgctggagccggaaaatgctgattaccgggacacttgccgttttctttctgctcatcatgggacaggtgacctggaacgatctgaccagactgtgcattatggtcggcgccaatgcttccgaccgcatgggcatggggacaacgtatcttgccctgatggcgaccttcaagatgagacctatgtttgctgtgggactcctgttccggcgcctcacatctagagaggtgctgcttctgaccatcggcctcagcctggtcgcctccgttgaactgcccaactctcttgaggaactgggggatggactcgccatgggcatcatgattctgaaactcctgacagactttcaaagccaccagctttgggctaccctgctctccctgacgttcatcaagacaacctttagcctgcattacgcctggaaaaccatggctatggtgctttctattgtgtccctgttccccctctgtctgagcacaacctctcagaagacaacgtggctccctgtcctgcttgggtccctgggatgcaagccgctgaccatgtttctcatcgccgagaataaaatttggggccggaagtcctggcccctgaacgaaggcatcatggcggtggggatcgtttctattcttctgtccagcctcctgaaaaacgatgtgcctctcgccggacccctgatcgctggcgggatgcttattgcctgttatgtcatctccggaagctctgctgacctgagcctggagaaggccgccgaggtgtcctgggaagaggaagctgagcactctggcgcgagccataatattctcgttgaagtgcaggatgacgggacaatgaaaatcaaggatgaggagcgcgacgataccctgacaatccttctgaaagccaccctcctggctgtctccggagtgtaccctctctctattcccgccacgctgttcgtctggtatttctggcaaaagaagaaacagagaagcggcgtgctttgggacacccctagccctcccgaagttgagcgggccgtgctggatgacggcatctaccgcattatgcagagagggctgctcggacggtctcaggtcggcgtgggggtttttcaagaaaacgtgttccacacaatgtggcacgtcacccgcggagctgtgctgatgtatcagggcaagagacttgagcccagctgggcctccgtgaaaaaggacctgatcagctacgggggaggctggcggctccagggctcttggaatacaggggaggaagttcaggtcattgcggtggagcccggcaagaatcctaagaatgtgcaaaccgctcccggcacatttaagacgccggaaggggaggtcggagccatcgccctggatttcaaacctggcacctccgggagccccattgtgaacagagaaggaaagatcgttggcctctacggcaatggggtggtcacaacctctggaacctatgtgtccgctatcgcccaggcgaaagctagccaggagggccctctgcccgagattgaagacgaggtttttcgcaagcggaaccttacaatcatggatctgcatcccgggtccggaaaaacgagacgctacctgcctgccattgtgcgggaagccatcaagagaaagctccgcaccctgattcttgctccgacacgggtcgtggcctctgagatggctgaagccctgaaaggcatgcccatcagatatcaaaccacagcggttaagagcgagcacaccgggcgcgagatcgtggacctcatgtgccatgccacgttcacaatgcggctgctgtcccctgtcagagtgcccaattacaacatgattatcatggatgaagctcactttaccgaccctagctctattgccgctcggggctatatctccacccgcgtgggaatgggcgaggccgccgctattttcatgacagcgacaccccctgggagcgtcgaagcctttccgcagtctaatgctgttatccaggatgaggaaagagacatccccgagcggagctggaactccggatacgagtggattacagatttccctggcaaaaccgtgtggtttgtgccctctatcaagagcgggaatgacattgccaactgtctccgcaaaaatggaaagagagtcatccagctttcccggaagacgttcgatacagaatatcagaagaccaagaacaacgactgggactacgtggttacaaccgatatttctgagatgggcgccaatttcagagctgaccgcgtgatcgatcctcggagatgcctgaaacccgtcattctgaaggacgggccggaacgcgtgatcctcgccggccctatgcccgttacggtggcgagcgctgcccagcggagaggacgcatcggccggaaccataataaagagggggatcagtacatttatatgggacagcccctgaacaatgacgaggatcacgcccactggaccgaagctaagatgcttctggacaacatcaatacacctgagggcattatccccgccctctttgaacctgagagagaaaagtccgcggccattgatggggagtaccgcctgagaggagaggctcggaaaaccttcgtcgaactgatgcgcagaggcgacctcccggtgtggcttagctataaggtcgcctctgaggggtttcaatactccgatcggcgctggtgcttcgacggcgaaagaaacaatcaggtgctggaggaaaacatggatgttgagatctggacaaaagagggagaacggaagaaactgagaccccgctggctcgacgctcggacctatagcgaccctctggcccttagagagtttaaggagttcgctgccggccgccggtccgtgtctggggatctgatcctcgagattggaaaactgccccagcatctgacacagagagcgcaaaatgccctcgacaaccttgtgatgctgcacaatagcgaacagggcgggcgggcttaccgccatgccatggaggagctgcctgataccatcgaaacgctcatgctgcttgctctgattgccgtcctcacaggaggcgttaccctgtttttcctgtccggcagagggctcggaaagacctctatcggccttctgtgtgtgatggccagctccgtgctgctctggatggctagcgtcgagccccactggattgcggcctctatcatcctggaatttttccttatggtgctgctcattccggagcctgaccggcagcgcacaccccaggataaccaactggcttatgttgtgatcgggctgctctttatgattcttaccgtcgccgccaatgagatgggactgctggaaacaacgaagaaagacctcggcatcgggcacgtggctgtcgagaaccatcaccatgccgcgatgctggatgtggaccttcaccctgcctccgcttggaccctgtacgccgttgctacaaccattatcacacccatgatgagacataccattgaaaacacgaccgccaatatcagcctcacagcgatcgccaaccaggctgccattctgatgggactggataagggctggcctatctctaaaatggacattggcgtgcccctccttgctctggggtgctactcccaggtcaatccgctgaccctcacagccgctgtgctgatgcttgttgcccactatgcgatcattggacctggcctgcaagccaaggctacccgggaggcccagaaacgcacggctgccgggatcatgaagaaccccacagtggatggaatcgtcgccattgacctcgatcccgtggtgtacgacgcgaagttcgaaaaacagctgggccagatcatgctgctcattctttgtaccagccaaatcctgctgatgagaacaacctgggctctctgcgagtctattaccctggccacagggcctcttacgaccctgtgggagggaagcccgggcaagttttggaatacaaccatcgctgtttccatggccaacatcttccggggctcttatctcgccggggctggactggccttcagcctgatgaaatccctcggcgggggacgcagaggcacaggggcgcagggagaaacccttggcgagaagtggaaacggcagctgaatcagctgagcaagtccgaatttaacacgtacaagagatctggcattatggaggtcgaccgcagcgaagccaaagaggggctcaagcggggagagacaaccaaacacgctgtgtccagaggcaccgccaagctgcgctggttcgtggaacggaatcttgtcaaacccgaggggaaggttatcgatctgggatgtggcagagggggatggtcttattactgcgctggcctcaagaaagtgacagaagtgaagggctataccaaagggggacctggccatgaggaacccattcctatggccacatacgggtggaacctggtcaagctgcacagcggaaaagacgtgtttttcattccccctgagaagtgtgatacgctcctttgcgacatcggcgagtcctctccgaatcccaccatcgaagaggggcgcacactgcgggttctgaaaatggtggaaccttggctcagaggaaaccaattttgtattaagatcctgaatccctacatgcctagcgtcgtggagacccttgagcagatgcagcgcaagcatggcggcatgctggttcggaaccccctctccagaaatagcacacacgaaatgtattgggtgtcttgcgggaccggaaacatcgtctccgcggtgaatatgacgagccgcatgctgctgaaccggttcaccatggcccacagaaaaccgacatacgagcgcgatgtggacctcggcgctgggaccagacatgtcgccgttgaacctgaggtggctaacctggatattatcggacagcggattgaaaatatcaagtatgagcacaaatctacatggcattacgacgaggataacccctataagacctgggcctaccacggctcctatgaagtgaaacccagcgggtctgcttccagcatggtcaatggagtggttaaacttctgacaaagccttgggacgtgattcccatggtcacccaaatcgccatgacggatacaaccccttttggccagcagcgcgtgttcaaagagaaggttgacaccagaacaccgaaagcgaagcggggcacggcccaaatcatggaagtgaccgctagatggctctgggggtttctgtcccggaacaaaaagccccgcatttgtacaagagaggagttcacccggaaggtccgcagcaatgccgctatcggagccgtgtttgttgacgagaaccagtggaactctgccaaagaggcggtggaagatgagagattctgggaccttgtccatcgggaacgcgagctgcacaagcagggcaaatgcgctacatgcgtgtacaacatgatggggaagagagagaaaaagctcggagagtttggcaaggccaaagggagccgggccatttggtacatgtggctgggcgctcgcttcctggagttcgaagccctcggatttatgaatgaggatcactggttctccagagaaaactctctgagcggcgtcgagggggagggacttcataagctgggctatatcctccgggacatttccaaaatccctgggggaaatatgtacgctgatgacaccgccggctgggatacacgcatcaccgaagacgatctgcagaacgaggcgaagattacggacatcatggaacccgagcacgcccttctggctaaagccgtgtttaagctcacctatcaaaataaagttgtgagagtccagcggcctgctaagaacgggacagtgatggatgtgatttctcgcagagaccagcggggcagcggacaggttggcacctacgggctgaatacattcaccaacatggaagcccaactgatcagacagatggagtccgagggaatcttttctcccagcgaactcgagacgccgaacctggcggaacgcgtgctttattggctggagaagtacggcgtcgaacggctcaaaagaatggccatctccggggatgactgtgtggttaagcctatcgacgatcgcttcgctacagccctgaccgctcttaatgacatgggaaaagtgcggaaggatattccccagtgggagcctagcaaaggctggaacgactggcagcaagtccccttttgctctcatcacttccaccagctgatcatgaaggatgggagagagattgtggtcccttgtcgcaatcaggacgaactcgtgggccgggccagagtttcccagggagctggctggagcctgcgcgagacagcctgcctggggaagtcttatgcgcaaatgtggcagctcatgtactttcatcggagagatctgcgccttgccgctaacgccatctgttccgccgtgcccgtcgactgggtgccgaccagccggacgacctggtccattcacgctcatcaccagtggatgacaaccgaagatatgctgtctgtttggaatagagtgtggatcgaggaaaacccttggatggaggacaaaacacatattagctcctgggaggatgtcccctacctcggaaagcgggaagaccaatggtgcggcagcctgatcgggcttaccgccagagcgacatgggctaccaatatccaggtggccattaaccaggtgcgccggctgatcggaaatgagaactatctcgactacatgacgtctatgaaaagattcaagaatgaatccgatcccgagggcgccctgtggtga

SEQ ID NO: 19441 - RNA, 9879 nt, synthetic construct
  misc_feature 1..9879: note = derived and/or modified CDS sequence (opt5) from DENV-1__JQ915077__SS-prME
  source 1..9879: mol_type = other RNA
agcgtgaccatgctgctcatgctgcttcccacagtcctgacgttccacctcaccacaagaggcggggagcctcatatgattgtttccaagcaggaacggggaaaatctctgctttttaagaccagcgccggcgtgaatatgtgcacactgattgctatggacctcggggagctgtgtgatgacaccatgacatacaaatgcccgcgcatcaccgaaacggagcccgatgacgtggattgttggtgcaatgccaccgaaacatgggtcacctatggaacatgttcccagaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagaacaagacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcacaccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacatccggggccagcacctcccaagagacctggaaccgccaggacctcctggtcacattcaaaacggctcacgccaagaagcaggaagtggttgtgctgggatctcaagagggcgccatgcacaccgctctcacaggggcgaccgaaatccagacaagcggaaccacgacaatttttgccggccatctgaaatgcagacttaagatggataaactgaccctcaaggggatctcctatgtcatgtgtaccggcagcttcaaactggagaaggaagtggctgagacacagcacggaaccgttctggtgcaggtcaagtacgagggcacagacgccccgtgcaaaatccctttctcttcccaagatgaaaagggggtgacgcagaatggacggcttgtgaccgccaaccccattgttacagacaaagagaagcctgtcaatatcgaagctgagccgccctttggcgagagctatattgtggtgggggccggagaaaaagcgctcaagctgtcttggttcaagaaaggcagctccatcgggaagatgtttgaggctaccgccagaggcgcccgccggatggctattctgggagatacagcctgggacttcggctctatcgggggagtctttaccagcgtgggcaaactcgttcatcagatcttcgggacggcttacggagtgctgttttccggcgtcagctggaccatgaagattgggatcggcattcttctgacatggctcggactgaactctagatccaccagcctgtctatgacatgtatcgccgtgggcatggttaccctttacctcggggtgatggtccaggcggattccggatgcgtgattaattggaaaggccgcgaactgaagtgtgggagcggaatcttcgttacaaacgaggtgcacacctggacggaacaatataagtttcaggccgactcccctaaacggctgtctgctgccattggcaaggcttgggaggagggggtctgcggcatcagaagcgccacacgcctcgaaaacatcatgtggaaacagatttccaatgagctgaaccatatccttctggaaaatgacatgaagttcaccgtggtggtcggagatgtttctggcattctcgcgcaggggaaaaagaccatccggccgcaacccatggagcacaaatacagctggaagtcctggggaaaggccaaaattatcggcgctgacgtgcagaacacaacctttatcattgatgggcctaatacgcccgaatgtcctgacgatcagagagcctggaacatctgggaggtggaggactatggattcggcatttttacaaccaatatctggctgaagctgcgcgatagctacacacaggtctgcgaccaccggcttatgtctgctgccattaaagattccaaggccgtgcatgctgacatgggctattggatcgaaagcgagaaaaacgaaacctggaagctcgcgagagcctctttcatcgaggttaagacatgtgtgtggcccaaatcccacaccctgtggagcaatggggtcctggaatctgagatgattatcccgaagatttacggaggccctatcagccaacataactatcgccccgggtacttcacgcagaccgctggaccttggcacctcggcaaactggagcttgattttgacctgtgcgaagggacaaccgtggttgtggatgagcactgcggaaatcggggcccctccctcagaacaaccacggtcacaggcaagattatccatgaatggtgttgccggagctgtaccctgcctcccctgcgcttcaaaggggaggacggatgctggtacggcatggagatcagaccggtgaaggaaaaggaggaaaaccttgttaaatctatggtgtccgccgggagcggagaggtcgactccttttctctcggcctgctgtgtattagcatcatgattgaagaggtgatgcggtccagatggtctcgcaagatgctcatgacagggaccctggtggtcttccttctgctcaccctgggacagctgacatggaatgatcttatccggctgtgcattatggttggcgccaacgctagcgacaatatgggcatggggacgacctatctcgccctgatggcgacatttagaatgcgccctatgttcgctgtgggactcctgtttagacggcttacctcccgcgaggtgctgctcctgacagtcggcctgtctcttgtggccagcgttgaactgcccaactccctcgatgagctgggggacggactcgccatgggcatcatgattctgaaacttctgaccgatttccaaagccaccagctctgggctatcctgctgtctcttacgtttgtgaagacaaccctgtccctccattacgcctggaaaaccatggcgatgatcctgagcattgtctctctcctgcccctttgtctgtccacaaccagccagaagacaacgtggctgcctgtgctcctggggtctcttggatgcaagccgctgaccatgttcctcatcacagaaaacaaaatttggggcagaaagtcctggcccctgaatgagggcatcatggctgttgggattgtgagcatcctcctgtccagccttctgaaaaacgacgtccctctggccggacccctcatcgccggcgggatgctgattgcttgttatgtgatctctggaagctccgccgatctttctctggaaaaggctgccaaagtcagctgggaggaggaagcggagcactccggcgcctctcataatattctcgtggaaatccaggacgatgggaccatgaagattaaagacgaggaacgggatgacacaatcaccatcctgctcaaggctacgctgcttgccattagcggagtttaccctatgtccatccccgctaccctgtttgtgtggcacttctggcaaaagaaaaagcagcgctctggcgtcctgtgggatacacctagccctcccgaggtggagaaagccgttctcgacgacggcatttatagaatcctgcagcgggggcttctgggacgctcccaggtgggcgtcggggtgtttcaagaaggagtgttccacaccatgtggcatgttacaagaggcgccgtcctcatgtaccaggggaagcggctggagcccagctgggcttctgtgaaaaaggatctcatttcctatggaggcggctggcgcttccaggggagctggaacaccggagaagaggtgcaggtcatcgcggtggagcccggcaagaatcctaaaaacgttcaaacagcccccgggacgtttaagacctctgaaggagaggtgggcgctattgccctggacttcaaaccggggacatccggaagccctatcgtcaatagagaaggcaagatcgtgggcctttacgggaacggagttgtgaccacctccggcacatacgtctctgccattgctcaggccaaagcgagccaggaggggcccctgcctgaaatcgaggatgaggtgtttcggaagagaaatctgacgattatggacctccaccccggatccggcaagacccgccggtatctgcccgctatcgttagagaagccattaaacgcaaacttcggacactggtgctcgcccctaccagagtcgtggctagcgagatggccgaagcgctgaaagggatgccgatccgctaccaaacaaccgctgtgaagtctgagcatacgggcaaagaaatcgtcgatctgatgtgccacgccacattcaccatgcggctcctttcccccgttagagtgcctaactataatatgattatcatggacgaggcccattttaccgatcccgctagcattgccgctcgcggatacatctctacacgggtgggcatgggggaggccgcggccattttcatgaccgctacacctcccggaagcgtcgaagcctttcctcagtccaacgctgtgatccaggacgaggaaaaggatatcccggagagatcttggaatagcggctatgactggattaccgatttccccgggaagacggtttggtttgtgccttccatcaaatctggaaacgacattgccaattgtctgcggaagaacggcaaacgcgtcatccagctgagcagaaagacattcgacaccgaataccagaagacaaagaacaatgattgggactatgtggttaccacggatatttccgagatgggggccaactttcgggctgaccgcgtgatcgatcccagacggtgcctcaagcctgtcattctgaaagacggccccgagagagtgatccttgcgggaccgatgcctgtcaccgtggccagcgctgcccagcgccggggcagaatcgggcgcaatcagaacaaggaaggagatcagtacatttacatgggccaacccctgaataacgacgaggatcacgcccactggacagaagctaaaatgctcctggacaatatcaacacccccgaggggattatccctgccctgttcgagcccgaacgggagaagtctgcggctattgatggagaatatagactccgcggcgaggcccggaaaacattcgttgaacttatgagacgcggggacctgcctgtgtggctgtcctacaaggtggccagcgagggctttcagtattccgatagacggtggtgcttcgacggagagcgcaataaccaggtcctcgaagagaatatggacgttgaaatctggaccaaagagggcgaaagaaagaagctgcggccgcgctggcttgatgctagaacatactctgaccccctggccctccgggagtttaaagagttcgcggccgggagacgcagcgtgtccggagatctgatcctggaaattggcaagctccctcagcatcttacccaacgggctcagaacgccctggacaatctggtgatgctccacaactctgagcaagggggaaaggcttatagacatgccatggaggaactgcccgatacgatcgaaacaattatgcttctggctctcatcgccgtcctgaccggcggcgtgaccctgtttttcctcagcgggcgcggacttggcaagacatccattgggctgctgtgtgttacctcctctagcgtgctcctgtggatggcgagcgtcgagcctcactggatcgccgcttctatcattcttgagtttttcctgatggtgctcctgatccccgaaccggaccggcagagaacacctcaagataatcagctggcctacgtcgtgattggactcctttttatgatcctgacggttgctgccaacgagatgggcctgctcgaaaccaccaagaaagacctggggattggacacgccgctgcggagaaccatcaccatgccgctatgcttgatgtggacctgcaccccgcctccgcctggaccctctatgctgtcgccacaaccatcattacgcctatgatgcggcataccatcgagaatacaaccgcgaacatcagcctgacagccattgctaatcaggccgctatcctgatgggcctcgataagggctggcccatttctaaaatggacatcggggtgcctcttctggccctgggatgctacagccaagttaaccccctcaccctgacggcggccgtgcttatgctggtcgctcactacgccattatcggcccggggctccaggctaaggccacacgcgaagctcagaaaagaaccgccgcgggaatcatgaagaatcctacagtggatggcattgtggccatcgacctggaccccgttgtctatgatgctaaattcgagaagcagctggggcaaattatgctccttatcctgtgtacctcccagattctgctcatgcggaccacatgggccctgtgcgaatctatcacgcttgctaccggacccctgacaaccctctgggagggcagccctggcaagttttggaacacaaccatcgccgtgtccatggccaatattttccgcgggagctacctggcgggagctggcctggccttttccctcatgaaatctcttgggggaggcagacgggggacgggagctcagggcgaaacactgggcgagaagtggaaacgccagctgaaccaactcagcaagtccgagttcaatacctataaaagatctgggatcattgaagtggaccggagcgaggccaaggaaggactgaagcgcggcgagaccacaaaacacgccgtctccagagggaccgctaaacttcggtggttcgttgaaagaaacctggtgaaaccggagggaaaggtgatcgatctcggctgtgggcgcggaggctggtcttactattgcgccggcctgaaaaaggtcacagaggtgaaagggtacacgaagggaggccccgggcatgaggagcctattcccatggcgacctatggatggaatctggttaagctccacagcggcaaagacgtgtttttcatccctcccgaaaagtgtgatacacttctgtgcgacattggggagtccagccctaacccgaccatcgaagagggacggacactgagagtcctcaaaatggtggagccctggctgcgcggcaatcagttttgtatcaagattcttaacccttacatgccctctgttgtggaaaccctggagcagatgcagcggaaacatggcgggatgctcgtcagaaatcctctgtcccgcaacagcacgcacgaaatgtactgggtgtcttgcggaaccggcaatatcgtgtccgccgtcaacatgacaagccggatgctgctcaacagattcaccatggctcaccgcaagcccacatatgagcgggatgttgacctgggggccggaaccagacatgtggctgtggagccggaagtcgccaatcttgatattatcggccaacgcattgagaacatcaagaatgaacacaaatctacatggcattacgacgaggataacccttataagacctgggcgtaccacgggtcctatgaagtgaaacccagcggatccgccagctctatggttaatggcgtggtccggctgctcacgaagccctgggacgtgatccctatggttacacagattgctatgaccgacaccacaccctttggccagcaaagagtgttcaaagagaaggtcgatacgcgcacccctaaggccaaaagagggacagctcagatcatggaggtgaccgccaagtggctgtggggatttcttagccggaacaaaaagccgcgcatttgtacaagagaagagttcacccggaaagttagatccaatgctgccatcggcgcggtgtttgtcgacgaaaaccagtggaactctgccaaggaggctgtggaagatgagcggttctgggacctggtccgcagagagcgggaactccataagcaggggaaatgcgccacatgcgtgtacaacatgatgggaaagcgcgagaaaaagctgggcgaatttgggaaagctaagggcagcagagccatttggtatatgtggctgggagcccggttcctcgagtttgaagcgctgggcttcatgaatgaggatcactggttctcccgcgagaactctcttagcggggttgaaggagagggcctgcacaaactcgggtacatcctgagagacatctccaagattcccggaggcaatatgtacgctgatgacaccgccgggtgggatacgcggatcaccgaagacgatcttcaaaacgaggccaagattacagacatcatggagcctgaacatgctctgctcgccacctctatttttaaactgacatatcagaataaggtggtccgcgtgcagagacccgctaaaaacggcaccgtgatggatgttatcagccggcgcgaccagagaggatccggccaagtggggacgtacggactgaacacattcaccaatatggaggcccagctcatccggcagatggaaagcgagggcatcttttctccttccgaactggagacacccaaccttgcggggcgcgtcctggactggctcgagaagcacggaaccgaaagactgcggagaatggccatcagcggcgatgactgtgtggttaaaccgattgatgaccgcttcgctacggcccttaccgctctgaatgatatggggaaggtgcggaaggacatccctcagtgggagccctctaaaggctggaacgattggcaacaggtccctttttgctcccatcacttccaccagctcattatgaaggacggaagagaaatcgtggtcccctgtcgcaatcaggatgagctggtgggccgggccagagttagccaaggggcgggatggtccctgcgcgaaacagcctgcctcggcaaatcttatgctcagatgtggcagctgatgtactttcatcggagagaccttcgcctggccgctaacgccatttgtagcgctgtgcctgtcgattgggtgcccacctcccggacaacctggagcatccacgcccatcaccaatggatgacaaccgaggacatgctctctgtttggaatagagtgtggatcgaggaaaacccgtggatggaggacaagacgcatgtctccagctgggaagatgtgccttatctggggaaacgcgaggaccagtggtgcggatctcttattggcctgacagcgcgggccacctgggctaccaatatccaggtggccattaaccaggttagacggctcatcgggaatgaaaactacctggattatatgacaagcatgaagagattcaagaatgagtccgaccccgagggcgccctgtggtga

SEQ ID NO: 19442 - RNA, 9879 nt, synthetic construct
  misc_feature 1..9879: note = derived and/or modified CDS sequence (opt5) from DENV-1__JQ915079__SS-prME
  source 1..9879: mol_type = other RNA
agcgtgaccatgctgctcatgctgcttcccacagtcctgacgttccacctcaccacaagaggcggggagcctcatatgatcgtttccaagcaggaacggggaaaatctctgctttttaagaccagcgccggcgtgaacatgtgcacactgattgctatggacctcggggagctgtgtgatgacaccatgacatacaaatgcccgcgcatcaccgaaacggagcccgatgacgtggattgttggtgcaatgccaccgaaacatgggtcacctatggaacatgttcccaaaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagagcaggacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcaccccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacaaccggggcctccaccagccaagagacatggaaccgccaggacctcctggtcacgttcaaaaccgctcacgccaagaagcaggaagtggttgtgctgggatcccaagagggcgccatgcacacagctctcaccggggcgacagaaatccagacctctggaacgacaaccatttttgccggccatctgaaatgcagacttaagatggataaactgaccctcaaggggatcagctatgtcatgtgtacaggctccttcaaactggagaaggaagtggctgagacccagcacggaacagttctggtgcaggtcaagtacgagggcacggacgccccgtgcaaaatccctttcagctctcaagatgaaaagggggtgacccagaatggacggcttgtgacagccaaccccattgttaccgacaaagagagacctgtcaatatcgaagctgagcccccctttggcgagtcctatattgtggtgggggccggagaaaaggcgctcaaactgagctggttcaagaagggctctagcatcgggaaaatgtttgaggctacagcccgcggcgcccggagaatggctattctgggagataccgcctgggacttcggctccatcgggggagtctttacgtctgtgggcaagctcgttcatcagatcttcgggaccgcttacggagtgctgtttagcggcgtctcctggacaatgaaaattgggatcggcattcttctgacctggctcggactgaacagccgctctacatccctgagcatgacctgtatcgccgtgggcatggttacactttacctcggggtgatggtccaggcggattctggatgcgtgattaattggaagggccgggaactgaaatgtgggtccggaatcttcgttaccaacgaggtgcacacgtggacagaacaatataagtttcaggccgacagccctaagagactgtccgctgccattggcaaagcttgggaggagggggtctgcggcatccgctctgccacccggctcgaaaacatcatgtggaagcagattagcaatgagctgaaccatatccttctggaaaatgacatgaaattcaccgtggtggtcggagatgtttccggcattctcgcgcaggggaagaaaacaatcagaccgcaacccatggagcacaagtactcttggaaaagctggggaaaggccaagattatcggcgctgacgtgcagaacaccacgtttatcattgatgggcctaatacacccgaatgtcctgacgatcagcgcgcctggaacatctgggaggtggaggactatggattcggcatttttaccacaaatatctggctgaaactgcgggattcctacacccaggtctgcgaccacagacttatgagcgctgccattaaggattctaaagccgtgcatgctgacatgggctattggatcgaatccgagaagaacgaaacatggaaactcgcgcgcgccagcttcatcgaggttaagacctgtgtgtggcccaagtctcacacgctgtggtccaatggggtcctggaaagcgagatggtgattccgaaaatctacggaggccctatttctcaacataactatcggcccgggtacttcacccagacagctggaccttggcacctcggcaagctggagcttgattttgacctgtgcgaagggaccacagttgtggtcgatgagcactgcggaaatagaggccccagcctccggaccacgacagtgaccggcaaaatcattcatgaatggtgttgccgctcctgtacactgcctcccctgagattcaagggggaggacggatgctggtacggcatggagatccggccggttaaagaaaaggaggaaaaccttgtgaagagcatggtctctgccgggtccggagaggtggacagcttttccctcggcctgctgtgtatctctattatgatcgaagaggtgatgagaagccgctggtcccggaaaatgctcatgaccgggaccctggtcgttttccttctgctcacactgggacagctgacgtggaatgatcttattagactgtgcatcatggtgggcgccaacgcttctgacaatatgggcatggggaccacatatctcgccctgatggcgacctttcgcatgagacctatgttcgctgtgggactcctgtttcggcgccttacaagcagagaggtcctgctcctgaccgtgggcctgtcccttgttgcctctgtggaactgcccaacagcctcgatgagctgggggacggactcgccatgggcattatgatcctgaagcttctgacggatttccaatcccaccagctctgggctacactgctgagccttacctttgtcaaaaccacactgtctctccattacgcctggaagaccatggcgatgattctgtccatcgtgagcctcctgcccctttgtctgtctacaacgtcccagaaaaccacatggctgcctgttctcctggggagccttggatgcaagccgctgaccatgttcctcatcacagaaaacaagatttggggccggaaatcttggcccctgaatgagggcatcatggctgtggggattgtctccatcctcctgagctcccttctgaagaacgacgtgcctctggccggacccctcattgccggcgggatgctgatcgcttgttatgtcatcagcggatctagcgccgatctttccctggaaaaagctgccaaggtgtcttgggaggaggaagcggagcacagcggcgcctcccataatattctcgttgaaatccaggacgatgggaccatgaaaattaaggacgaggaacgcgatgacacgatcaccattctgctcaaagctacactgcttgccatctctggagtgtaccctatgagcatccccgctaccctgtttgtctggcacttctggcaaaagaagaaacagagatccggcgtgctgtgggatacaccttctcccccggaggttgagaaggccgtgctcgacgacggcatttatcggatcctgcagcgcgggcttctgggaagaagccaggtcggcgtgggggtgtttcaagaaggagttttccacaccatgtggcatgtcacacggggcgccgtgctcatgtaccaggggaaacgcctggagccttcctgggctagcgtgaagaaagatctcatttcttatggaggcggctggagattccaggggtcctggaacatgggagaagaggtccaggtgatcgcggttgagcccggcaagaatcctaagaacgtgcaaacggcccccgggacctttaaaacaagcgaaggagaggtcggcgctattgccctggacttcaagccggggacctctggatcccctatcgtgaatcgggaaggcaaaattgttggcctttacgggaacggagtggtcaccacaagcggcacgtacgtgtccgccatcgctcaggccaaggcgtctcaggaggggcccctgcctgaaatcgaggatgaggtttttagaaaacgcaatctgaccattatggacctccaccccggaagcggcaagacacggagatatctgcccgctatcgtgcgcgaagccattaagcggaaacttagaaccctggtcctcgcccctacacgcgtggtggcttccgagatggccgaagcgctgaaggggatgccgatccggtaccaaaccacggctgtcaaaagcgagcatacaggcaaggaaattgttgatctgatgtgccacgccaccttcaccatgagactcctttctcccgtgcgcgtgcctaactataatatgatcatcatggacgaggcccattttacagatcccgcttccattgccgctcggggatacatcagcaccagagtcggcatgggggaggccgcggccattttcatgacagctacccctcccggatctgtggaagcctttcctcagagcaacgctgttatccaggacgaggaaaaagatattccggagcggtcctggaattctggctatgactggatcacggatttccccgggaagacagtgtggtttgtccctagcatcaagtccggaaacgacattgccaattgtctgcgcaaaaacggcaagagagtgatccagctgtctcggaaaaccttcgacacagaataccaaaagaccaaaaacaatgattgggactatgttgtgacgaccgatattagcgagatgggggccaactttcgcgctgacagagtcatcgatccccggagatgcctcaagcctgtgattctgaaggacggccccgagcgcgtcatccttgcgggaccgatgcctgtgacagttgcctccgctgcccagcggagaggccgcattgggcggaatcagaacaaagaaggagatcagtacatctacatgggccaacccctgaataacgacgaggatcacgcccactggaccgaagctaagatgctcctggacaatatcaacacacccgaggggattatccctgccctgttcgagcccgaaagagagaaaagcgcggctattgatggagaatatcgcctccggggcgaggccagaaagaccttcgtggaacttatgcgcagaggggacctgcctgtgtggctgtcttacaaagtcgcctccgagggctttcagtatagcgatcggcgctggtgcttcgacggagagagaaataaccaggttctcgaagagaatatggacgtggaaatctggacaaaggagggcgaacggaaaaagctgcgcccgagatggcttgatgctcggacctactccgaccccctggccctcagagagtttaaggagttcgcggccgggcgccggtctgtgagcggagatctgattctggaaatcggcaaactccctcagcatcttacgcaaagagctcagaacgccctggacaatctggtcatgctccacaactccgagcaggggggaaaggcttatcgccatgccatggaagagctgcccgatacaatcgaaaccattatgcttctggctctcatcgccgtgctgaccggcggcgttacactgtttttcctctctgggcggggacttggcaaaaccagcattgggctgctgtgtgtgacatccagctctgcgctcctgtggatggcctccgtcgagcctcactggatcgctgccagcattatccttgagtttttcctgatggtgctcctgatccccgaaccggacagacagcggacgcctcaagataatcagctggcttacgtcgtgattggactcctttttatgatcctgaccgttgccgccaacgagatgggcctgctcgaaacaaccaagaaagacctggggattggacacacagctgcggagaaccatcaccatgccgctatgcttgatgtggacctgcaccccgcctctgcctggaccctctatgctgtcgccacgaccatcattacacctatgatgcgccataccatcgagaatacaaccgcgaacatttccctgacggccatcgctaatcaggccgctatcctgatgggcctcgataagggctggcccattagcaagatggacatcggggtgcctcttctggccctgggatgctactctcaagttaaccccctcacactgaccgcggccgtgcttatgctggtcgctcactacgccattatcggcccggggctccaggctaaagccacaagagaagctcagaagcggaccgccgcgggaattatgaaaaatcctaccgtggatggcatcgtggccatcgacctggaccccgttgtctatgatgctaagttcgagaaacagctggggcaaattatgctccttatcctgtgtacaagccagattctgctcatgcgcacgacctgggccctgtgcgaatccatcacacttgctaccggacccctgacaaccctctgggagggctctcctggcaagttttggaacacgacaattgccgtgagcatggccaatatcttcagagggtcctacctggcgggagctggcctggcctttagcctcatgaagtcccttgggggaggccggcgcgggaccggagctcagggcgaaaccctgggcgagaaatggaagagacagctgaaccaactctctaaaagccagttcaatacatataagcggtccgggatcattgaggtggaccgctctgaagccaaagagggactgaagagaggcgaaaccacaaagcacgccgtcagccgggggacggctaaacttagatggttcgttgagcgcaacctggtgaagccggaaggaaaagtgatcgatctcggctgtgggcggggaggctggtcctactattgcgccggcctgaagaaagtcaccgaggtgaaggggtacacaaaaggaggccccgggcatgaggaacctattcccatggcgacctatggatggaatctggttaagctccactctggcaaggacgtgtttttcatccctcccgagaaatgtgatacacttctgtgcgacattggggaaagctcccctaacccgaccatcgaggaaggaagaacgctgcgcgtcctcaagatggtggagccctggctgcggggcaatcagttttgtattaaaatccttaacccttacatgcccagcgttgtggagaccctggaacagatgcaaagaaagcatggcgggatgctcgtccgcaatcctctgtctcggaactccacacacgagatgtactgggtgagctgcggaaccggcaatatcgtgtctgccgtcaacatgacatccagaatgctgctcaaccgcttcaccatggctcaccggaaacccacatatgaaagagatgttgacctgggggccggaacccgccatgtggctgtggagccggaggtcgccaatcttgatattatcggccagcggattgaaaacatcaagaatgagcacaagagcacgtggcattacgacgaagataacccttataaaacatgggcgtaccacgggtcttatgaggtgaagccctccggaagcgcctccagcatggttaatggcgtggtcagactgctcaccaaaccctgggacgtgattcctatggttacccagatcgctatgacagacacgaccccctttggccaacagcgcgtgttcaaggaaaaagtcgatacaagaacccctaaggccaagcgggggacagctcagatcatggaggtgaccgccaaatggctgtggggatttctttctcgcaacaagaaaccgagaatttgtacacgggaggaattcaccagaaaggttcggagcaatgctgccatcggcgcggtgtttgtcgacgagaaccagtggaattccgccaaagaagctgtggaggatgaacgcttctgggacctggtcagacgggagcgcgagctccataagcaagggaagtgcgccacgtgcgtgtacaacatgatgggaaaaagagaaaagaaactgggcgagtttgggaaggctaaaggctctcgggccatttggtatatgtggctgggagcccgcttcctcgaatttgaggcgctgggcttcatgaatgaagatcactggttcagcagagagaactccctttctggggttgagggagaaggcctgcacaagctcgggtacatcctgcgggacattagcaaaatccccggaggcaatatgtacgctgatgacaccgccgggtgggatacacgcatcaccgaggaagaccttcagaacgaggccaagattacagatatcatggagcctgaacatgctctgctcgccacctccatttttaagctgacgtatcagaataaagtggtcagagtgcagcggcccgctaagaacggcacagtgatggacgttatctctcgcagagatcaacggggaagcggccaggtggggacctacggactgaacacattcaccaatatggaggcccagctcattcgccagatggaatccgagggcatctttagcccttctgaactggagacgcccaaccttgcggggagagtcctggactggctcgagaaacacggaatcgaacggctgagacgcatggccatttccggcgacgattgtgtggttaagccgatcgacgatcggttcgctaccgcccttacagctctgaatgacatggggaaagtgagaaaggatattcctcaatgggagcccagcaagggctggaacgactggcagcaggtccctttttgctctcatcacttccaccagctcatcatgaaagatggacgcgaaattgtggtcccctgtcggaatcaagacgagctggtgggcagagcccgcgtttcccagggggcgggatggagcctgcgggaaaccgcctgcctcggcaagtcctatgctcagatgtggcaactgatgtactttcatagacgcgatcttcggctggccgctaacgccatctgttctgctgtgcctgtcgactgggtgcccacaagcagaaccacatggtccattcacgcccatcaccagtggatgaccacggaggatatgctcagcgtttggaatcgcgtgtggatcgaggaaaacccgtggatggaggacaaaacacatgtctcttcctgggaagacgtgccttatctggggaagcgggaggatcagtggtgcggaagccttatcggcctgaccgcgagagccacctgggctacaaatattcaggtggccatcaaccaagttcggagactcattgggaatgaaaactacctggactatatgacctctatgaaacgcttcaagaatgagagcgatcccgagggcgccctgtggtga

SEQ ID NO: 19443 - RNA, 9879 nt, synthetic construct
  misc_feature 1..9879: note = derived and/or modified CDS sequence (opt5) from DENV-1__JQ915080__SS-prME
  source 1..9879: mol_type = other RNA
agcgtgaccatgctgctcatgctgcttcccacagtcctgacgttccacctcaccacaagaggcggggagcctcatatgatcgtttccaagcaggaacggggaaaatctctgctttttaagaccagcgccggcgtgaacatgtgcacactgattgctatggacctcggggagctgtgtgatgacaccatgacatacaaatgcccgcgcatcaccgaaacggagcccgatgacgtggattgttggtgcaatgccaccgaaacatgggtcacctatggaacatgttcccaaaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagagcaggacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcaccccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacaaccggggcctccaccagccaagagacatggaaccgccaggacctcctggtcacgttcaaaaccgctcacgccaagaagcaggaagtggttgtgctgggatcccaagagggcgccatgcacacagctctcaccggggcgacagaaatccagacctctggaacgacaaccatttttgccggccatctgaaatgcagacttaagatggataaactgaccctcaaggggatcagctatgtcatgtgtacaggctccttcaaactggagaaggaagtggctgagacccagcacggaacagttctggtgcaggtcaagtacgagggcacggacgccccgtgcaaaatccctttcagctctcaagatgaaaagggggtgacccagaatggacggcttgtgacagccaaccccattgttaccgacaaagagagacctgtcaatatcgaagctgagcccccctttggcgagtcctatattgtggtgggggccggagaaaaggcgctcaaactgagctggttcaagaagggctctagcatcgggaaaatgtttgaggctacagcccgcggcgcccggagaatggctattctgggagataccgcctgggacttcggctccatcgggggagtctttacgtctgtgggcaagctcgttcatcagatcttcgggaccgcttacggagtgctgtttagcggcgtctcctggacaatgaaaattgggatcggcattcttctgacctggctcggactgaacagccgctctacatccctgagcatgacctgtatcgccgtgggcatggttacactttacctcggggtgatggtccaggcggattctggatgcgtgattaattggaagggccgggaactgaaatgtgggtccggaatcttcgttaccaacgaggtgcacacgtggacagaacaatataagtttcaggccgacagccctaagagactgtccgctgccattggcaaagcttgggaggagggggtctgcggcatccgctctgccacccggctcgaaaacatcatgtggaagcagattagcaatgagctgaaccatatccttctggaaaatgacatgaaattcaccgtggtggtcggagatgtttccggcattctcgcgcaggggaagaaaacaatcagaccgcaacccatggagcacaagtactcttggaaaagctggggaaaggccaagattatcggcgctgacgtgcagaacaccacgtttatcattgatgggcctaatacacccgaatgtcctgacgatcagcgcgcctggaacatctgggaggtggaggactatggattcggcatttttaccacaaatatctggctgaaactgcgggattcctacacccaggtctgcgaccacagacttatgagcgctgccattaaggattctaaagccgtgcatgctgacatgggctattggatcgaatccgagaagaacgaaacatggaaactcgcgcgcgccagcttcatcgaggttaagacctgtgtgtggcccaagtctcacacgctgtggtccaatggggtcctggaaagcgagatggtgattccgaaaatctacggaggccctatttctcaacataactatcggcccgggtacttcacccagacagctggaccttggcacctcggcaagctggagcttgattttgacctgtgcgaagggaccacagttgtggtcgatgagcactgcggaaatagaggccccagcctccggaccacgacagtgaccggcaaaatcattcatgaatggtgttgccgctcctgtacactgcctcccctgagattcaagggggaggacggatgctggtacggcatggagatccggccggttaaagaaaaggaggaaaaccttgtgaagagcatggtctctgccgggtccggagaggtggacagcttttccctcggcctgctgtgtatctctattatgatcgaagaggtgatgagaagccgctggtcccggaaaatgctcatgaccgggaccctggtcgttttccttctgctcacactgggacagctgacgtggaatgatcttattagactgtgcatcatggtgggcgccaacgcttctgacaatatgggcatggggaccacatatctcgccctgatggcgacctttcgcatgagacctatgttcgctgtgggactcctgtttcggcgccttacaagcagagaggtcctgctcctgaccgtgggcctgtcccttgttgcctctgtggaactgcccaacagcctcgatgagctgggggacggactcgccatgggcattatgatcctgaagcttctgacggatttccaatcccaccagctctgggctacactgctgagccttacctttgtcaaaaccacactgtctctccattacgcctggaagaccatggcgatgattctgtccatcgtgagcctcctgcccctttgtctgtctacaacgtcccagaaaaccacatggctgcctgttctcctggggagccttggatgcaagccgctgaccatgttcctcatcacagaaaacaagatttggggccggaaatcttggcccctgaatgagggcatcatggctgtggggattgtctccatcctcctgagctcccttctgaagaacgacgtgcctctggccggacccctcattgccggcgggatgctgatcgcttgttatgtcatcagcggatctagcgccgatctttccctggaaaaagctgccaaggtgtcttgggaggaggaagcggagcacagcggcgcctcccataatattctcgttgaaatccaggacgatgggaccatgaaaattaaggacgaggaacgcgatgacacgatcaccattctgctcaaagctacactgcttgccatctctggagtgtaccctatgagcatccccgctaccctgtttgtctggcacttctggcaaaagaagaaacagagatccggcgtgctgtgggatacaccttctcccccggaggttgagaaggccgtgctcgacgacggcatttatcggatcctgcagcgcgggcttctgggaagaagccaggtcggcgtgggggtgtttcaagaaggagttttccacaccatgtggcatgtcacacggggcgccgtgctcatgtaccaggggaaacgcctggagccttcctgggctagcgtgaagaaagatctcatttcttatggaggcggctggagattccaggggtcctggaacatgggagaagaggtccaggtgatcgcggttgagcccggcaagaatcctaagaacgtgcaaacggcccccgggacctttaaaacaagcgaaggagaggtcggcgctattgccctggacttcaagccggggacctctggatcccctatcgtgaatcgggaaggcaaaattgttggcctttacgggaacggagtggtcaccacaagcggcacgtacgtgtccgccatcgctcaggccaaggcgtctcaggaggggcccctgcctgaaatcgaggatgaggtttttagaaaacgcaatctgaccattatggacctccaccccggaagcggcaagacacggagatatctgcccgctatcgtgcgcgaagccattaagcggaaacttagaaccctggtcctcgcccctacacgcgtggtggcttccgagatggccgaagcgctgaaggggatgccgatccggtaccaaaccacggctgtcaaaagcgagcatacaggcaaggaaattgttgatctgatgtgccacgccaccttcaccatgagactcctttctcccgtgcgcgtgcctaactataatatgatcatcatggacgaggcccattttacagatcccgcttccattgccgctcggggatacatcagcaccagagtcggcatgggggaggccgcggccattttcatgacagctacccctcccggatctgtggaagcctttcctcagagcaacgctgttatccaggacgaggaaaaagatattccggagcggtcctggaattctggctatgactggatcacggatttccccgggaagacagtgtggtttgtccctagcatcaagtccggaaacgacattgccaattgtctgcgcaaaaacggcaagagagtgatccagctgtctcggaaaaccttcgacacagaataccaaaagaccaaaaacaatgattgggactatgttgtgacgaccgatattagcgagatgggggccaactttcgcgctgacagagtcatcgatccccggagatgcctcaagcctgtgattctgaaggacggccccgagcgcgtcatccttgcgggaccgatgcctgtgacagttgcctccgctgcccagcggagaggccgcattgggcggaatcagaacaaagaaggagatcagtacatctacatgggccaacccctgaataacgacgaggatcacgcccactggaccgaagctaagatgctcctggacaatatcaacacacccgaggggattatccctgccctgttcgagcccgaaagagagaaaagcgcggctattgatggagaatatcgcctccggggcgaggccagaaagaccttcgtggaacttatgcgcagaggggacctgcctgtgtggctgtcttacaaagtcgcctccgagggctttcagtatagcgatcggcgctggtgcttcgacggagagagaaataaccaggttctcgaagagaatatggacgtggaaatctggacaaaggagggcgaacggaaaaagctgcgcccgagatggcttgatgctcggacctactccgaccccctggccctcagagagtttaaggagttcgcggccgggcgccggtctgtgagcggagatctgattctggaaatcggcaaactccctcagcatcttacgcaaagagctcagaacgccctggacaatctggtcatgctccacaactccgagcaggggggaaaggcttatcgccatgccatggaagagctgcccgatacaatcgaaaccattatgcttctggctctcatcgccgtgctgaccggcggcgttacactgtttttcctctctgggcggggacttggcaaaaccagcattgggctgctgtgtgtgacatccagctctgcgctcctgtggatggcctccgtcgagcctcactggatcgctgccagcattatccttgagtttttcctgatggtgctcctgatccccgaaccggacagacagcggacgcctcaagataatcagctggcttacgtcgtgattggactcctttttatcattctgaccgttgccgccaacgagatgggcctgctcgaaacaaccaagaaagacctggggatcggacacacagctgcggagaaccatcaccatgccgctatgcttgatgtggacctgcaccccgcctctgcctggaccctctatgctgtcgccacgaccattatcacacctatgatgcgccataccattgagaatacaaccgcgaacatctccctgacggccatcgctaatcaggccgctattctgatgggcctcgataagggctggcccatcagcaagatggacattggggtgcctcttctggccctgggatgctactctcaagttaaccccctcacactgaccgcggccgtgcttatgctggtcgctcactacgccatcattggcccggggctccaggctaaagccacaagagaagctcagaagcggaccgccgcgggaatcatgaaaaatcctaccgtggatggcatcgtggccattgacctggaccccgttgtctatgatgctaagttcgagaaacagctggggcaaatcatgctccttattctgtgtacaagccagatcctgctcatgcgcacgacctgggccctgtgcgaatccattacacttgctaccggacccctgacaaccctctgggagggctctcctggcaagttttggaacacgacaatcgccgtgagcatggccaatatcttcagagggtcctacctggcgggagctggcctggcctttagcctcatgaagtcccttgggggaggccggcgcgggaccggagctcagggcgaaaccctgggcgagaaatggaagagacagctgaaccaactctctaaaagccagttcaatacatataagcggtccgggattatcgaggtggaccgctctgaagccaaagagggactgaagagaggcgaaaccacaaagcacgccgtcagccgggggacggctaaacttagatggttcgttgagcgcaacctggtgaagccggaaggaaaagtgattgatctcggctgtgggcggggaggctggtcctactattgcgccggcctgaagaaagtcaccgaggtgaaggggtacacaaaaggaggccccgggcatgaggaacctatccccatggcgacctatggatggaatctggttaagctccactctggcaaggacgtgtttttcattcctcccgagaaatgtgatacacttctgtgcgacatcggggaaagctcccctaacccgaccattgaggaaggaagaacgctgcgcgtcctcaagatggtggagccctggctgcggggcaatcagttttgtatcaaaatccttaacccttacatgcccagcgttgtggagaccctggaacagatgcaaagaaagcatggcgggatgctcgtccgcaatcctctgtctcggaactccacacacgagatgtactgggtgagctgcggaaccggcaatattgtgtctgccgtcaacatgacatccagaatgctgctcaaccgcttcaccatggctcaccggaaacccacatatgaaagagatgttgacctgggggccggaacccgccatgtggctgtggagccggaggtcgccaatcttgatatcattggccagcggatcgaaaacattaagaatgagcacaagagcacgtggcattacgacgaagataacccttataaaacatgggcgtaccacgggtcttatgaggtgaagccctccggaagcgcctccagcatggttaatggcgtggtcagactgctcaccaaaccctgggacgtgatccctatggttacccagatcgctatgacagacacgaccccctttggccaacagcgcgtgttcaaggaaaaagtcgatacaagaacccctaaggccaagcgggggacagctcagattatggaggtgaccgccaaatggctgtggggatttctttctcgcaacaagaaaccgagaatctgtacacgggaggaattcaccagaaaggttcggagcaatgctgccattggcgcggtgtttgtcgacgagaaccagtggaattccgccaaagaagctgtggaggatgaacgcttctgggacctggtcagacgggagcgcgagctccataagcaagggaagtgcgccacgtgcgtgtacaacatgatgggaaaaagagaaaagaaactgggcgagtttgggaaggctaaaggctctcgggccatctggtatatgtggctgggagcccgcttcctcgaatttgaggcgctgggcttcatgaatgaagatcactggttcagcagagagaactccctttctggggttgagggagaaggcctgcacaagctcgggtacattctgcgggacatcagcaaaatccccggaggcaatatgtacgctgatgacaccgccgggtgggatacacgcattaccgaggaagaccttcagaacgaggccaagatcacagatattatggagcctgaacatgctctgctcgccacctccatctttaagctgacgtatcagaataaagtggtcagagtgcagcggcccgctaagaacggcacagtgatggacgttatttctcgcagagatcaacggggaagcggccaggtggggacctacggactgaacacattcaccaatatggaggcccagctcatccgccagatggaatccgagggcatctttagcccttctgaactggagacgcccaaccttgcggggagagtcctggactggctcgagaaacacggaattgaacggctgagacgcatggccatctccggcgacgattgtgtggttaagccgattgacgatcggttcgctaccgcccttacagctctgaatgacatggggaaagtgagaaaggatatccctcaatgggagcccagcaagggctggaacgactggcagcaggtccctttttgctctcatcacttccaccagctcattatgaaagatggacgcgaaatcgtggtcccctgtcggaatcaagacgagctggtgggcagagcccgcgtttcccagggggcgggatggagcctgcgggaaaccgcctgcctcggcaagtcctatgctcagatgtggcaactgatgtactttcatagacgcgatcttcggctggccgctaacgccatttgttctgctgtgcctgtcgactgggtgcccacaagcagaaccacatggtccatccacgcccatcaccagtggatgaccacggaggatatgctcagcgtttggaatcgcgtgtggatcgaggaaaacccgtggatggaggacaaaacacatgtctcttcctgggaagacgtgccttatctggggaagcgggaggatcagtggtgcggaagccttattggcctgaccgcgagagccacctgggctacaaatatccaggtggccattaaccaagttcggagactcatcgggaatgaaaactacctggactatatgacctctatgaaacgcttcaagaatgagagcgatcccgagggcgccctgtggtga

SEQ ID NO: 19444 - RNA, 9879 nt, synthetic construct
  misc_feature 1..9879: note = derived and/or modified CDS sequence (opt5) from DENV-1__KJ755855__SS-prME
  source 1..9879: mol_type = other RNA
agcgtgaccatgctgcttatgctgatgcccaccgcccttgctttccacctgacgaccagaggaggggaacctcatatgatcgtgtccaagcaggaacggggaaagtctctcctgtttaagacaagcgccggcgttaacatgtgcacccttattgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagagccgaaacctggatgagctccgagggcgcttggaaacagattcagcgggttgaaacgtgggccctgcgccaccccggcttcacagtgatcgcgctttttctggcccatgctattgggacctctatcacacagaagggaatcattttcatcctcctgatgcttgtcacccctagcatggccatgagatgcgtgggcattgggtcccgggattttgttgagggactgagcggcgctacctgggtggacgtcgagctcgaacacgggtcttgtgtgacaacgatggccaaggataaacccaccctggacatcgagctgctcaagacagaagtgaccaaccctgcggtcctgcgcaaactttgcattgaggccaagatctccaatacaaccacggatagcagatgtccgacacaaggagaagctaccctggttgaggagcaggacgccaacttcgtgtgccggcgcacctttgtggatagaggctggggcaatgggtgtgaactcttcggaaaaggctctctgcttacatgcgctaagtttaagtgcgtcaccaaactggaggggaagattgtgcagtacgaaaacctcaaatattccgttatcgtgacagtccacatcgccgcccagcatcaagtgggaaatgagagcacggaacacggcaccacagctattatcacaccccaggcgcctacaaccgagattcagctgacggactacggggccctgaccctcgactgttctccccggacaggactggatttcaacgagatggttcttctgaccatgaaggaaaaatcctggctcgtgcataagcagtggtttctggaccttcctctgccctggacaagcggcgcttccacctctcaagagacgtggaatcgcctcttcctgctggtcacatttaaaaccgcccacgccaagaagcaggaagtggtcgtgctcggcagccaggagggggctatgcacacagccctgaccggagcgaccgcccttcagacattcggcacgaccacaatcttcgctgggcatctgaacattagactcaaaatggataagctgaccctgaaaggaatgtcctatgttatgtgcacaggcagctttaaacttgaaaaagaggtggccgagacccagcacgggacgatcctcgtccagatcaagtacgaaggcacagacgctccgtgtaagattcctttctctacccaggatgagaaaggagtgacccaaaatggccggctgatcacagccaaccccattgttaccgacaaggaaaaacctgtgaatatcgaggctgagccgccctttggggaatcctatattgtcatcggagccggcgagaaggcgctgaaactcagctggttcaagaaggggtctagcatcggaaaaatgtttgaagccacagctagaggcgcccgccggatggctattctgggggatacggcctgggacttcggctccatcggaggcgtgtttacctctgtggggaaacttgttcatcagattttcggaacagcgtacggcgtcctgtttagcggggtgtcctggaccatgaaaatcggaattggcgtgctcctgacatggctggggcttaacagcagatctacctccctcagcatgacgtgcatcgccgtcggcctggtgaccctgtacctcggagttatggtgcaggctgattctggctgtgtcattaattggaaggggcgcgagctgaaatgcggatccggcatcttcgtgacaaacgaagttcacacctggacagagcagtataagtttcaagccgacagccctaagcggctttccgctgccatcgggaaagcctgggaggaaggagtgtgtggcattagatctgctacccgcctggagaacatcatgtggaagcagattagcaatgaactcaaccatatcctgctggagaatgatcttaaattcacagtcgtggttggggacgtggcgggcattctcgcccagggaaagaaaatgatccggccgcagcccatggaacacaagtactcctggaaaaactggggcaaggctaagatcattggggccgacgtccaaaattctacctttatcattgatggacctaacacgcccgagtgcagcgacgatcagagagcctggaatatctgggaggtggaagactatggcttcgggattttcacaaccaacatctggctgaaactgcgcgattcctacacccaggtgtgtgaccaccggctcatgagcgctgccatcaaggattctaaagcggtccatgctgacatgggatattggattgagtccgaaaagaatgagacatggaaactggccagagccagctttatcgaagttaagacctgcacgtggcctaagtctcacacactttggtccaacggcgtgctggagagcgagatgattatccccaaaatttacggcgggccgatctctcagcataattatagccctggatacttcacccaaacagctggcccctggcacctcgggaagctggaactggattttgacctttgtgagggaaccacagtggtcgtggatgaacactgcggcaaccgcgggccttccctccggaccacgaccgttacaggaaaaatcattcatgagtggtgctgtagaagctgcaccctgccccctctgcggttccgcggcgaggacggctgttggtacgggatggaaatcagacccgtgaaggagaaagaagagaatctcgtcaagtctatggtgtccgccggaagcggcgaagttgtgtccctgtctcttgggctgctctgcattagcatcatgattgaggaggtcatgcggtccagatggtctcgcaagatgctgatgacaggaaccctggcggtgtttttccggaaaatcagaggccagcttacgtggaacgatctgattcgcctctgtatcatggttggggctaatgccagcgacagaatgggaacacggaccacatatctggccctcatggctacctttaagatgcgcccgatgttctccgtgggcctgctttttagacggctgacctctcgcgaagtcctcctgctgacaatcggccttagcctggtggcctccgtggagctccctaacagcctggaagaactcggggtcctgcttgctatgggaattatgatcctgacgctcctgaccgacttccagtctcaccaactgtgggccacacttctgtccatgacctttattaaaacaaccttcagcctccattacacgtggaagacaatggcgatggttctgtctatcgtgtccctctttcccctgtgccttagcaccacctctcagaaaacaacctggctgcccgtgctgctcggctccctggggtgtaagcctcttacaatgttcctgattgccgaaaacaagatctggggaagaaaaagctggccgctcaatgagggcatcatggctgtcgggattgtgtccatcctgctcagctctctgcttaagaacgatgttcccctggccggacctctgattgctggcggcatgctcatcgcctgctatgtgattagcgggtcctctgccgacctgagccttgagaaagctgcggaagtctcctgggaggaagaggccgaacactctggagctagccataatatcctggtggaggttcaggatgacggcacgatgaagatcaaagatgaggaacgggacgataccctcacaattctgctcaaggccaccctgcttgccgtgtccggggtctaccccctgtctatccctgctacactgttcgtgtggtatttttggcagaaaaagaagcaacgcagcggagtcctctgggacaccccctcccctcccaaagtggagaaggccgttctggatgacggcatttacagaatcatgcagcgggggcttctgggacgcagccaggtgggcgtcggcgtgttccaggaaaacgtttttcacacgatgtggcacgtgaccagaggggcggtcctcatgtatcaaggaaaacggctggagccgtcttggggcagagtgaagaaagatctcatttcctacgggggaggctgggggctgaagggaagctggaatacaggcgaggaagtgcaggttatcgctgtcgagcctggcaagaaccccaaaaatgtgcagaccgcccctgggacattcaagacccccgaaggagaggtgggcgccattgctcttgactttaaaccggggacatctggatcccctatcgtcaaccgcgaaggcaagatcgtggggctgtacggaaatggcgttgtgacgaccagcggcacatatgtctccgccattgcgcatgctaaagcctctcaggaggggcccctgcctgagaccgaagtggaggccttccggaagagaaacctcaccatcatggatctgcaccccggaagcggcaagacacgccggtaccttcccgctattgttagagaagccatcaaacgcaagatgcggacgctgattctcgctcctaccagagtggtcgcctccgagatggcggaagccctgaaagggatgccgatccgctatcaaacaaccgctgtcaagagcgagcatacaggaaaagagatcgttgacctgatgtgtcacgccacctttacgatgcggctcctttctcccgtgagagtccctaattacaacatgattatcatggacgaagctcatttcacagatccctccagcctggccgcccggggctatatttctacccgcgtggggatgggcgaggctgcggccatctttatgaccgctacacctcccggaagcgtggaagccttccctcagtccaatgccgtcattcaggacgaggaaagagatatcccggagcggtcttggaacagcggctacgagtggatcaccgactttcccgggaagacagtttggttcgtgccttccattaaggctggaaatgatatcgccaactgcctgcgcaaaaacggcaagagagtgattcaactctctcggaaaaccttcgacacggaatatcagaagaccaagaataacgattgggactacgtcgtgaccacagatatcagcgagatgggggcgaattttcccgctgacagagttattgatcctcgccggtgtctgaaccccgtgatccttaaggacggaccggaaagagtcattctggccggccctatgcccgtgaccgttgcctccgctaatcagcgccgggggagaatcggccgcaaccacaataaggagggagaccagtacatctatatgggccaacccctcaacaatgatgaggaccacgcccattggacggaagcgaaaatgctgctggataacattaatacccctgaggggatcattcccgccctcttcgaacctgagcgggaaaagagcgctgccatcgacggagagtacagacttcgcggcgaggctagaaaaacatttgtggaactgatgcggcgcggggatctgccggtctggctctcttataaggtggcctccgagggattccagtacagcgacagacggtggtgctttgatggcgaacgcaacaatcaggtcctggaggaaaacatggacgtggagatttggaccaaagagggggaaagaaagaaacttcggcccagatggctggatgctcgcacatattccgaccctctcgccctgcgggagaagaaggagttcgcggccggcagacgctctgttagcggagatctgatcctcgagatcggcaaacttccccagcacctgacccaacgggctcagaatgccctggacaacctcgtgatgctgcataactccgaacaagggggcagagcttaccggcacgccatggaggagcttcctgatacaattgaaaccctgatgctcctggccctgatcgctgtgctcacgggcggggtcacactctttttcctgtctggaaagggcctgggcaaagcggggaatggactcctgtgcgttatggccagctccgcccttctgtggatggccaacgtggagccccactggattgccgctagcatcattctcgaatttttcctgatggtgctgctcatcccggagcctgaccgccagagaacaccccaagacaatcagcttgcctatgtcgtgatccggctgctgtttatgattctcaccgttgcggccaacgagatgggcctgcttgaaacaaccaagaaagatctggggatcggacatgctgccgtggagaatcaccatcacgctgccatgctcgacattgatctgcatcctgcgtctgcctggacactgtacgctgtcgccacgaccatcattacacccatgatgcgccacaccatcgaaaacacaaccgctaatatttccctcacggccatcgctaaccaggccgcgatccttatgggcctggacaaggggtggcctattagcaagatggatatcggagtgcccctgctcgccctgggcttcctttctcaggtcaatccgctgaccctcacagctgccgtgctgatgctggttgctcactacgccattatcggccctgggctccaagccaaagcgaccagagaggctcagaagcggacagccgctggaattatgaaaaaccccaccatcgacggcatcgtggccattgatcttgaccccgtcgtgtatgatgccaagtttgaaaaacagctggggcaaatcatgctgctcattctgtgtacgtcccagatccttctgatgcgcacaacctgggctctctgcgagagcattacactggccaccggacctctgtctccgctctgggagggcagccccgggaagtcctggaataccacaatcgcggtttctatggccaacatcttcagaggaagctaccttgctggcgccggcctggctttctccctgatgaaaagcctcgggggaggccggcgcgggacgggagcccagggcgaaaccctgggggagaaatggaagagacagcttaatcaactgtccaaaacagaatttaacacctataagcggtctggaattatggaggtggacagaagcgaagcgaaagagggcctcaagcgcggcgagacaaccaagcatgccgtctcccgggggacggctaaactgagatggttcgtggaacgcaatctggtgaagcctgagggaaaagttatcgatctcggctgtgggcggggaggctggtcttactattgcgccgggcttaagaaagtcagcgaagtgagaggatacacaaagggcggccccgggcacgaggaacctattcccatggctacctatggatgggacctgctgaaacgctgttccggcaaggagtttttctttatccctccggagaagtgcgattctttcctcggggacattggagaaagctcccccaaccctaccatcgaggaaggccggacagtgagagtcctgaaaatggttgagccctggcttcgcgggaatcagttttgtattaagatcctgaacccttacatgcccagcgtggtggagaccctcgaacagatgcagcggaaacatggaggcatgctggtcagaaacccgctgtctcgcaattccacacacgagatgtactgggtgagctgcggcacggggaacatcgtttctgccgtgaatatgacctcccggatgctcctgaacagattcacaatggctcaccgcaagcctacctatgaaagagacgtcgatcttggagccggcacacggcatgtggcggttgagcccgaagtggccaatctggacattatcgggcaacgcattgagaacatcaaacacgagcataagagcacctggcactacgatgaagacaatccctataagacgtgggcttaccatggatcttatgaggtcaaaccttccggcagcgcctccagcatggtgaacggggtggtcaagctcctgaccaaaccctgggatgttattcctatggtgacacagatcgctatgaccgacacaaccccgtttggacagcagagagtgttcaaggaaaaagtcgatacacggacccccaaggccaagagaggcacggcccaaatcatggaggtgacagcgcggtggctttggtcttttctgagccgcaataaaaagcctagaatttgtacccgggaagagttcacccgcaaagttagatccaacgctgccatcggcgccgtgtttgtcgacgagaatcagtggaactctgctaaggaagccgtggaggatgaccggttctgggatctcgttcaccgcgaaagagagctgcacaaacaggggaagtgcgctacatgtgtgtacaatatgatgggaaagcgggagaagaagctgggcgagttcgggaaagccaagggaagccgcgcgatttggtatatgtggctcggcgccagatttctggagttcgaagctcttgggtttatgaacgaggaccattggttctcccgggaaaattctctgagcggcgtcgagggagagggcctccacaaactggggtacatccttcgcgacatttccaagatccccggaggcaacatgtacgccgatgacacggctgggtgggataccagaatcacagaagacgatctgcaaaacgaggccaaaattaccgacatcatggaacctgagcatgcgctcctggccaagtctatttttaagctgacatatcagaataaagtggttcgggtgcagcgccccgctaagaacggaaccgtcatggatgtgatcagcagacgggaccagagaggctccgggcaagtcggcacatacggactcaataccttcacgaacatggaagcccagctgattcgccagatggagagcgaggaaatcttttctccgaatgagcttgaaacccctaacctggctgagcgggtgctcgattggctggaaaaatatggcgttgagagacttaagcgcatggccatctccggggacgattgcgtggtcaaacccattgacgatcggttcgctacagccctgaccgcgctcaatgacatgggaaaggtgagaaaggacatccctcagtgggagcccagcaaaggctggaacgattggcaacaggtgcctttttgctctcaccacttccatcagctggttatgaaggacgggcgcgaaattgtggtcccctgtcggaatcaggatgagctggtgggcagagctcgcgtttcccaaggagctgggtggagcctccgggaaacagcctgcctgggcaaatcctacgcccagatgtggcagcttatgtattttcacagacgcgacctgcggctcgctgccaacgcgatctgttctgctgtgccggtcgattgggtgcctaccagcagaacgacatggtccattcatgcccaccatcagtggatgaccacagaggacatgctgagcgtctggaatcgggtgtggatcgaagagaacccctggatggaggataagaccagagtttcttcctgggaagacgtgccctaccttggaaaacgcgaggatcaatggtgcggcagcctgattgggctcacggcccgggctacctgggccacaaatatccaggtcgctatcaaccaggtgagacgcctgattggaaatgaaaactattctgactacatgaccagcatgaagagattcaagaacgagtccgagcctgaaggcgccctgtggtga

SEQ ID NO: 19445 - RNA, 9879 nt, synthetic construct
  misc_feature 1..9879: note = derived and/or modified CDS sequence (opt5) from DENV-1__KF289073__SS-prME
  source 1..9879: mol_type = other RNA
agcgtgaccatgctgttcatgctcctgcccacagcccttgcttttcacctgacgaccagaggcggggagcctcatatgatcgtctccaagcaggaacggggaaagtctctcctgttcaagaccagcgccggcgttaacatgtgcacccttattgcgatggacctgggggagctctgtgaagataccatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagaaggttgaaacatgggctctgcggcaccccggctttaccgtgatcgcccttttcctggcgcatgccattgggacatctatcacccagaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaaaaataagcccacactggatatcgaactgctcaaaaccgaggtcacaaaccctgccgttctgcggaaactttgcattgaagcgaaaatctctaagaccacgacagactcccgctgtccgacccaaggagaggccaccctggtggaggaacaggatgctaattttgtgtgcagacggacattcgtcgaccgcggctggggcaacgggtgtggactctttggcaaggggagcctgcttacctgcgccaaattcaagtgcgtgacaaaactggagggaaagattgttcagtacgaaaatctcaaatattctgtgatcgtcacggtgcacaccggcgatcagcatcaagttgggaacgagacaaccgaacacggaacaatcgctaccattacgccccaggcccctacctccgagatccagctgacagactacggcgccctgaccctcgactgtagccccagaacaggcctggattttaatgaaatggtgcttctgaccatgaaggagaaatcttggctcgtccataagcagtggttcctggaccttcctctgccctggacgtccggggctagcacatcccaagagacctggaaccggcaggatctcctggtgacatttaagaccgcgcacgccaaaaagcaggaagtcgtggttctgggatctcaagagggcgctatgcacaccgccctcacaggggccacggaaattcagaccagcggaacaaccacaatcttcgctggccatctgaaatgccgccttaagatggacaaactgaccctcaaggggatgtcctatgtgatgtgtacgggcagcttcaagctggagaaagaagtcgccgagacacagcacggaaccgtgctggttcaggtgaagtacgagggcaccgatgcgccgtgcaaaattcctatctctacacaagacgaaaagggggtcacccagaatggaagacttatcacagctaaccccattgtgacggataaagagaagcctgtgaatatcgaaaccgagccgccctttggcgagtcctatattgttatcggggccggagaaaaggccctcaaactgagctggttcaagaaaggctctagcattgggaagatgtttgaggctacagcccggggcgctagacgcatggccatcctgggagacaccgcgtgggatttcggctccatcgggggagtctttacatctgtgggcaaactcgtgcatcaggtcttcgggaccgcctacggagtgctgtttagcggcgtttcctggacgatgaagattgggatcggcgtgcttctgacctggctcggactgaacagccggtctacatccctgagcatgacctgtattgctgtcggcatggtgacactttacctcggggttatggtgcaggccgactctggatgcgtcatcaattggaagggcagagaactgaaatgtgggtccggaattttcgtgaccaacgaggttcacacatggaccgaacaatataagtttcaggctgatagccctaaacgcctgtccgccgcgatcggcaaggcctgggaggagggggtgtgcggcattcggtctgctacgagactcgaaaacatcatgtggaaacagatcagcaatgagctgaaccatattcttctggaaaatgacatgaagttcacagtcgtggtgggagacgccaacggcatcctcgctcaggggaaaaagatgattcgcccgcaacccatggagcacaagtactcctggaaatcttggggaaaggccaaaatcattggcgccgatatccagaataccacctttatcattgacgggcctgatacacccgaatgtcctgacgatcaccgggcttggaacatctgggaggtcgaggactatggattcggcatttttaccacgaatatctggctgaagctgagagatagctacacacagatgtgcgaccatcgccttatgtccgcggccattaaagatagcaaggctgttcacgccgacatgggctattggatcgaatctgagaagaacgaaacctggaaactcgcccgggcttccttcatcgaggtgaagacatgtatttggcccaaaagccataccctgtggtctaatggggtgctggaatccgagatgatcattccgaagatctacggaggccctattagccagcacaactatagacccgggtacttcacacaaaccgccggaccttggcacctcggcaaactggagcttgattttgacctgtgcgaagggacgaccgtcgtggttgatgagcattgcggaaatcgcggcccctctctccggacaaccacagtgaccggcaagatcatccacgaatggtgttgcagaagctgtacgctgcctcccctgcggttcaagggggaggacggatgctggtacggcatggagattcgcccggtcaaagaaaaggaggaaaaccttgtgagatccatggttagcgcggggtctggagaggtggactcctttagcctcggcctgctgtgtgtctccatcatgattgaagaggtgatgcggtctagatggagccgcaaaatgctcatgacagggaccctggctgttttccttctgctcatcatgggacagctgacatggaatgatctgattcggctttgcatcatggtgggcgccaacgcctccgacagaatgggcatggggaccacctatctggctctcatggccacatttaagatgcgccctatgttcgcggtcggactgctctttagacggctgacgtctcgcgaggtgcttctgctcaccattggcctgagcctggtggcttccgtcgaacttcccaattctctggaggaactcggggatggactggccatgggcatcatgatgctcaaactgcttacagacttccagagccatcaactgtggaccacactcctgtccctgacctttatcaagacgacacttagcctggattacgcctggaagaccatggctatggttctctctattgtgtccctgttccccctctgtctgagcaccacatctcagaaaaccacatggcttcctgtgctgctggggtcctttggatgcaagccgctcacgatgttcctgatcaccgagaacaaaatttggggcagaaagagctggccccttaacgaaggcatcatggccgtcgggattgtgtctatcctgctctccagcctgctcaaaaatgacgttcctctggctggaccccttatcgccggcgggatgctgattgcgtgttatgtgatctccggaagctctgccgatctgagcctcgagaaggctgccgaggtctcctgggaagaggaagctgagcactctggcgccagccataacattctggtggaagttcaggacgatgggacaatgaaaatcaaggacgaggagcgggatgacacccttacaattctgctcaaggccaccctgctcgctgtgtccggagtctaccctatgtctatccccgcgacgctgtttgtgtggtatttctggcagaaaaagaaacaacgcagcggcgtcctttgggatacccctagccctcccgaagtggagagagccgttctggacgacggcatctaccggattctgcagcgcgggctcctgggaagatctcaggtgggcgtcggggtgttccaggatggagtttttcacacaatgtggcacgtgacccggggcgctgtccttatgtatcaagggaagcgcctggaacccagctgggcctccgtgaaaaaggacctcatcagctacggaggcggctggagattccaggggtcttggaatatgggagaggaggtgcaggttattgccgtcgaacccggcaagaaccctaaaaatgtgcagacaacccccgggacatttaagacgccggagggagaagtgggcgctatcgccctggatttcaaacctgggacctccggaagccccattgtcaaccgggagggcaagatcgtgggcctctacgggaatggagttgtgacaacctctggcacctatgtctccgcgattgctcaagccaaagccagccaggaagggcctctgcccgagatcgaggacgaagtgtttagaaagcgcaaccttacaatcatggatctgcatcccggatccggcaagacgcggagatacctgcctgctattgttcgcgaggccatcaaacggaagctcagaaccctgattcttgcgccgacacgcgtggtcgcttctgaaatggccgaggccctgaaagggatgcccatccggtatcagaccacagctgtgaagtccgaacacaccggcagagagattgttgacctcatgtgccatgccacgttcacaatgcgcctgctgtcccctgtgcgggtccccaattacaacatgatcatcatggatgaggctcactttaccgaccctgccagcattgcggccagaggatatatctctacccgggtgggcatgggggaagctgccgctattttcatgacagccacaccccctggatccgtggaggcctttccgcaaagcaatgctgtcatccaggatgaagaaagagacattcccgaaagatcttggaacagcggctacgattggatcacagacttccctgggaaaaccgtttggtttgtgccctccatcaagtctggaaatgacattgcgaactgtctccggaagaatggcaaacgcgtgatccagcttagcagaaagacgttcgatacagagtatcagaaaaccaagaacaacgactgggattacgtcgtgacaaccgacatttccgagatgggggccaatttccgggctgatagagttatcgaccctcgccggtgcctgaaacccgtgattctgaaggatggcccggaaagagtcatcctcgccggacctatgcccgtgacggttgcctctgctgcccaacgccggggcagaattgggcgcaaccagaataaggagggagaccagtacgtgtatatgggccagcccctgaacaatgatgaagaccatgcgcactggaccgaggctaaaatgcttctggataacatcaatacacctgaggggatcattcccgccctctttgaacctgagcggaagaaaagcgccgctatcgacggagaatacagactgcgcggcgaggccagaaagaccttcgtcgaactgatgcggcgcggggatctcccggtgtggctttcctataaagtcgcgagcgagggctttcaatactctgacagacggtggtgcttcgacggagagcgcaacaatcaggtgctggaagagaacatggatgttgaaatttggacaaaggagggcgaacgcaagaagctgcggcccagatggctcgacgcccgcacctattccgatcctctggcccttcgggagtttaaggagttcgccgctgggagacgcagcgtgtccggagacctgatcctcgaaattggcaaactgccccagcacctgacactccgggcccagaaggctcttgataatctggtgatgctgcataactctgagcaagggggaaaagcctacagacacgcgatggaggaactccctgacaccatcgaaacgctgatgcttctggccctcatcgctgtcctgacaggcggcgttaccctgtttttcctcagcgggaagggacttggcaaaacctccattgggctgctgtgtgtgatggcctctagcgctctcctgtggatggcctccgtggagccccattggatcgccgctagcattatccttgagtttttcctgatggtcctcctgattccggaacctgatcggcagcgcacaccccaggacaatcagctggcgtatgtggttatcggactcctttttatgatcctgaccgtggccgctaacgagatgggcctgctcgaaacaacgaagaaggatctggggattggacacgtcgccgccgagaatcaccatcacgctaccatgcttgacgtggatctgagacctgcctctgcgtggacactctacgccgtcgctaccacaatcattacccccatgatgcggcatacgatcgagaacaccacagccaacatttccctgaccgctatcgccaatcaagcggccattctgatgggcctcgacaaaggctggcctatcagcaagatggatatcggggtgccccttctggctctgggatgctactctcaggttaacccgctcacactgaccgccgctgtgcttatgctggtcgcccactatgctattatcggccctgggctccaggccaaagcgacgcgcgaagcccaaaagagaacagctgccggaattatgaaaaatcccaccgtggacggcatcgttgctattgacctggatcccgtggtctacgacgccaagttcgagaagcagctggggcagatcatgctccttatcctgtgtacatcccagattctgctcatgcggaccacctgggccctgtgcgaaagcatcacacttgcgacgggacctctgaccacactctgggagggctctccgggcaaattttggaacaccacaattgctgtgagcatggccaatatcttccgcgggtcctatctggctggagccggcctggccttctctctcatgaaaagccttgggggaggcagacgggggaccggagctcaaggcgaaacgctgggcgagaaatggaagcgccagctgaaccagctctccaaaagcgagtttaatacatacaagagatccgggattatggaagtggatcggtctgaggccaaggaaggactgaaaagaggcgagaccaccaagcatgcggttagccgcgggacagccaaacttcggtggttcgtcgaaagaaacctggtgaagcccgagggaaaagtgatcgacctcggctgtgggcgcggaggctggtcctattactgcgctggcctgaagaaagtcaccgaggttaaggggtatacaaagggaggccctgggcacgaggagcccatccctatggccacgtacggatggaatctggtgaaactccactctggcaaggatgtgtttttcacaccccctgaaaaatgtgacacacttctgtgcgatattggggagagctccccgaaccccaccatcgaagagggacggacactgagagtcctcaagatggtggagccttggctgcgcggcaatcagttttgtattaaaatccttaacccctacatgccttctgttgtggaaaccctggagcaaatgcagcggaagcatggcgggatgctcgtcagaaatcccctgagccgcaactccacgcacgaaatgtattgggtgagctgcggaaccggcaatattgtttctgctgtgaacatgacatcccggatgctgctcaatagattcaccatgacacatcgcaagccgacctacgagcgggacgtcgatctgggggccggaacaagacacgtggcggtggagcctgaagtcgccaaccttgacatcattggccagcgcatcgagaacatcaaaaatgaacacaagagcacctggcattatgatgaggacaacccctacaaaacgtgggcttatcacgggtcttacgaagttaagccctccggaagcgcctcttccatggtgaatggcgtggtcagactgctcacaaaaccttgggacgtgattcccatggttacccagatcgctatgaccgatacaacgccttttggccaacagcgggtgttcaaggagaaggtcgacacccgcacaccgagagccaaacgggggaccgctcagattatggaggtgacagccaagtggctgtggggatttcttagcagaaacaaaaagccccggatctgtacccgcgaagagttcacaagaaaagttcggtccaatgcggccattggcgctgtgtttgtcgatgaaaaccaatggaatagcgccaaggaggctgtggaagacgagcgcttctgggatctggttcatagagagcgggaactccacaagcaggggaaatgcgctacctgcgtgtataacatgatgggaaagcgcgagaaaaagctgggcgaatttgggaaagccaagggctctagagcgatctggtacatgtggctgggagctcggttcctcgagttcgaagccctgggctttatgaatgaggaccattggttcagccgcgagaactccctttctggggtcgaaggagagggcctgcacaaactcgggtacatcctgagagatattagcaagatccctggaggcaatatgtatgccgacgatacgaccgggtgggacacacggattaccgaagatgaccttcagaacgaggctaagatcacagatattatggagcccgaacacgccctgctcgctacctccatctttaaactgacgtaccagaataaggtggtccgcgtgcaaagacctgccaaatctggcacagttatggacgtgatcagccggcgcgaccagagaggatccggccaggtcgggacctatggactgaacacattcaccaatatggaggtgcagctcattcggcaaatggaatctgagggcatctttctgcccagcgaacttgagacgccgaacctggcggagagagtgctcgattggctggaaaagcatggggttgagcgccttaaacggatggccatttccggagacgattgtgtggtcaagcctaccgacgatagattcgctacagccctgaccgctctcaacgacatgggcaaggtgcgcaaagatatcccccagtgggaacctagcaaggggtggaatgactggcagcaggttcccttttgctctcaccatttccaccaactgattatgaaagatggccgggagatcgtggtcccttgtagaaaccaggacgaactgatgggacgcgcccgggtgtcccagggcgcggggtggagcctcagagagacagcctgcctgggaaagtcttacgctcagatgtggcaacttatgtattttcaccgccgggatctgagactcgccgctaatgccatctgttccgctgtccccgtggactgggttccgaccagccgcacaacctggtccattcatgcccaccatcagtggatgacgacagaggacatgctgtctgtgtggaaccgggtctggatcgaagagaatccttggatggaagataaaacccacgtgagctcctgggaggacgttccctaccttggcaagagagaagatcagtggtgcgggagcctgattggactcaccgcgcgggccacatgggctaccaacatccaagtggccattaatcaggtcagacgcctgatcggcaacgagaattatctggactacatgacatctatgaagcggttcaaaaacgagtccgatcccgaaggggccctctggtga

SEQ ID NO: 19446 - RNA, 9879 nt, synthetic construct
  misc_feature 1..9879: note = derived and/or modified CDS sequence (opt5) from DENV-1__JQ915072__SS-prME
  source 1..9879: mol_type = other RNA
agcgtgaccatgctgctcatgctgcttcccaccgtgctgacgttccacctcaccacaagaggcggggagcctcatatgattgtttccaagcaggaacggggaaagtctctgctttttaagaccagcgccggcgtgaacatgtgcacactgattgctatggacctcggggagctgtgtgatgacaccatgacatacaagtgccccagaatcaccgaaacggagcccgatgacgtggattgttggtgcaatgccaccgaaacatgggttacctatggaacatgttcccagaccggcgagcacagacgggacaagcgctctgtggccctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaggaacaagacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcacaccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacaaccggggcctccaccagccaagagacatggaaccgccaggacctcctggtcacgttcaaaaccgctcacgccaagaagcaggaagtggttgtgctgggatcccaagagggcgccatgcacacagctctcaccggggcgacagaaatccagacctctggaacgacaaccatttttgccggccatctgaaatgcagacttaagatggataaactgaccctcaaggggatcagctatgtcatgtgtacaggctccttcaaactggagaaggaagtggctgagacccagcacggaacagttctggtgcaggtcaagtacgagggcacggacgccccgtgcaaaatccctttcagctctcaagatgaaaagggggtgacccagaatggacggcttgtgacagccaaccccattgttaccgacaaagagaagcctgtcaatatcgaagctgagccgccctttggcgagtcctatattgtggtgggggccggagaaaaagcgctcaagctgagctggttcaagaaaggctctagcatcgggaagatgtttgaggctacagccagaggcgcccgccggatggctattctgggagataccgcctgggacttcggctccatcgggggagtctttacgtctgtgggcaaactcgttcatcagatcttcgggaccgcttacggagtgctgtttagcggcgtctcctggacaatgaagattgggatcggcattcttctgacctggctcggactgaacagcagatctacatccctgagcatgacctgtatcgccgtgggcatggttacactttacctcggggtgatggtccaggcggattctggatgcgtgattaattggaaaggccgcgaactgaagtgtgggtccggaatcttcgttaccaacgaggtgcacacgtggacagaacaatataagtttcaggccgacagccctaaacggctgtccgctgccattggcaaggcttgggaggagggggtctgcggcatcagatctgccacccgcctcgaaaacatcatgtggaaacagattagcaatgagctgaaccatatccttctggaaaatgacatgaagttcaccgtggtggtcggagatgtttccggcattctcgcgcaggggaaaaagacaatccggccgcaacccatggagcacaaatactcttggaaaagctggggaaaggccaagattatcggcgctgacgtgcagaacaccacgtttatcattgatgggcctaatacacccgaatgtcctgacgatcagagagcctggaacatctgggaggtggaggactatggattcggcatttttaccacaaatatctggctgaagctgcgcgattcctacacccaggtctgcgaccaccggcttatgagcgctgccattaaagattctaaggccgtgcatgctgacatgggctattggatcgaatccgagaaaaacgaaacatggaagctcgcgagagccagcttcatcgaggttaagacctgtgtgtggcccaaatctcacacgctgtggtccaatggggtcctggaaagcgagatgattatcccgaagatttacggaggccctatctctcaacataactatcgccccgggtacttcacccagacagctggaccttggcacctcggcaaactggagcttgattttgacctgtgcgaagggaccacagtggttgtggatgagcactgcggacatcggggccccagcctcagaaccacgacagtcaccggcaagattatccacgaatggtgttgccggtcctgtacactgcctcccctgcgcttcaaaggggaggacggatgctggtacggcatggagatcagaccggtgaaggaaaaggaggaaaatcttgttaaaagcatggtgtctgccgggtccggagaggtcgacagcttttccctcggcctgctgtgtatttctatcatgattgaagaggtgatgcggagcagatggtcccgcaagatgctcatgaccgggaccctggtggtcttccttctgctcacactgggacagctgacgtggaacgatcttatccggctgtgcattatggttggcgccaatgcttctgacaacatgggcatggggaccacatatctcgccctgatggcgacctttagaatgcgccctatgttcgctgtgggactcctgtttagacggcttacaagccgcgaggtgctgctcctgaccgtcggcctgtcccttgtggcctctgttgaactgcccaatagcctcgatgagctgggggacggactcgccatgggcatcatgattctgaaacttctgacggatttccaatcccatcagctctgggctacactgctgagccttacctttgtgaagaccacactgtctctccactacgcctggaaaaccatggcgatgatcctgtccatcgtcagcctcctgcccctttgtctgtctacaacgtcccagaagaccacatggctgcctgtgctcctggggagccttggatgcaagccgctgaccatgttcctcattacagaaaacaaaatctggggcagaaagtcttggcccctgaacgagggcattatggctgttgggatcgtgtccattctcctgagctcccttctgaaaaatgacgtccctctggccggacccctcatcgccggcgggatgctgatcgcttgttatgtgattagcggatctagcgccgatctttccctggaaaaggctgccaaagtctcttgggaggaggaagcggagcatagcggcgcctcccacaacatcctcgtggaaattcaggacgatgggaccatgaagatcaaagacgaggaacgggatgacacgattaccatcctgctcaaggctacactgcttgccatctctggagtttaccctatgagcattcccgctaccctgtttgtgtggcacttctggcaaaagaaaaagcagcgctccggcgtcctgtgggatacaccttctcccccggaggtggagaaagccgttctcgacgacggcatctatcgcattctgcagcgggggcttctgggacgcagccaggtgggcgtcggggtgtttcaagaaggagtgttccataccatgtggcacgttacaagaggcgccgtcctcatgtaccaggggaagcggctggagccttcctgggctagcgtgaaaaaggatctcatctcttatggaggcggctggcgcttccaggggtcctggaatatgggagaagaggtgcaggtcattgcggtggagcccggcaagaaccctaaaaatgttcaaacggcccccgggacctttaagacaagcgaaggagaggtgggcgctatcgccctggacttcaaaccggggacctctggatcccctattgtcaacagagaaggcaagatcgtgggcctttacgggaatggagttgtgaccacaagcggcacgtacgtctccgccatcgctcaggccaaagcgtctcaggaggggcccctgcctgaaattgaggatgaggtgtttcggaagagaaacctgaccatcatggacctccatcccggaagcggcaagacacgccggtatctgcccgctattgttagagaagccatcaaacgcaaacttcggaccctggtgctcgcccctacaagagtcgtggcttccgagatggccgaagcgctgaaagggatgccgattcgctaccaaaccacggctgtcaagagcgagcacacaggcaaagaaatcgtcgatctgatgtgccatgccaccttcaccatgcggctcctttctcccgttagagtgcctaattataacatgatcattatggacgaggcccactttacagatcccgcttccatcgccgctcgcggatacattagcacccgggtgggcatgggggaggccgcggccatcttcatgacagctacccctcccggatctgtcgaagcctttcctcagagcaatgctgtgattcaggacgaggaaaaggatatcccggagagatcctggaactctggctatgactggatcacggatttccccgggaagacagtttggtttgtgcctagcattaaatccggaaatgacatcgccaactgtctgcggaagaatggcaaacgcgtcattcagctgtctagaaagaccttcgacacagaataccagaagaccaagaacaacgattgggactatgtggttacgaccgatatcagcgagatgggggccaattttcgggctgaccgcgtgattgatcccagacggtgcctcaagcctgtcatcctgaaagacggccccgagagagtgattcttgcgggaccgatgcctgtcacagtggcctccgctgcccagcgccggggcagaatcgggcgcaaccagaataaggaaggagatcagtacatctacatgggccaacccctgaacaatgacgaggatcacgcccattggaccgaagctaaaatgctcctggacaacattaatacacccgaggggatcattcctgccctgttcgagcccgaacgggaaaagagcgcggctatcgatggagaatatagactccgcggcgaggcccggaaaaccttcgttgaacttatgagacgcggggacctgcctgtgtggctgtcttacaaggtggcctccgagggctttcagtatagcgatagacggtggtgcttcgacggagagcgcaacaatcaggtcctcgaagagaacatggacgttgaaatttggacaaaagagggcgaaagaaagaagctgcggccgcgctggcttgatgctagaacctactccgaccccctggccctccgggagtttaaagagttcgcggccgggagacgctctgtgagcggagatctgatcctggaaatcggcaagctccctcagcaccttacgcaacgggctcagaatgccctggacaacctggtgatgctccataattccgagcaagggggaaaggcttatagacacgccatggaggagctgcccgatacaattgaaaccatcatgcttctggctctcattgccgtcctgaccggcggcgtgacactgtttttcctctctgggcgcggacttggcaagaccagcatcgggctgctgtgtgttacatccagctctgcgctcctgtggatggcctccgtggagcctcactggattgctgccagcatcatccttgagtttttcctgatggtcctcctgattcccgaaccggaccggcagagaacgcctcaagataaccagctggcttacgtggtcatcggactcctttttatgattctgaccgtggccgccaatgagatgggcctgctcgaaacaaccaaaaaggacctggggatcggacatacagctgcggagaaccaccatcacgccgctatgcttgatgttgacctgcatcccgcctctgcctggaccctctatgctgtggccacgaccattatcacacctatgatgcggcacaccattgagaacacaaccgcgaatatctccctgacggccatcgctaaccaggccgctattctgatgggcctcgataagggctggcccatcagcaaaatggacattggggtccctcttctggccctgggatgctactctcaagtgaatcccctcacactgaccgcggccgttcttatgctggtggctcactacgccatcattggcccggggctccaggctaaggccacacgcgaagctcagaaaagaaccgccgcgggaatcatgaagaaccctaccgtcgatggcatcgtggccattgacctggaccccgtggtttatgatgctaaattcgagaagcagctggggcaaatcatgctccttattctgtgtacaagccagatcctgctcatgcggacgacctgggccctgtgcgaatccattacacttgctaccggacccctgacaaccctctgggagggctctcctggcaagttttggaatacgacaatcgccgtcagcatggccaacatcttccgcgggtcctacctggcgggagctggcctggcctttagcctcatgaaatcccttgggggatctagacggggcaccggggctcagggagaaaccctgggcgagaagtggaaacgccagctgaatcaactcagcaagtccgagttcaacatttataaaagatctggcatcattgaagtggaccggagcgaggccaaggaagggctgaagcgcggagagacaaccaaacatgccgtgtccagaggcacagctaaacttcggtggttcgtcgaaagaaatctggttaaaccggaggggaaggtgatcgatctcggatgtggccgcgggggatggtcttactattgcgccggcctgaaaaaggtgacggaggtcaaaggctacaccaaagggggacccggccacgaggagcctattcccatggcgacatatgggtggaacctggtgaagctccatagcggaaaagacgtctttttcatccctcccgaaaagtgtgatacccttctgtgcgacattggcgagtccagccctaatccgacaatcgaagaggggcggaccctgagagtgctcaaaatggtcgagccctggctgcgcggaaaccagttttgtatcaagattcttaatccttacatgccctctgtggttgaaacgctggagcagatgcagcggaaacacggcggcatgctcgtgagaaaccctctgtcccgcaatagcacccacgaaatgtactgggtctcttgcgggacaggaaacatcgtgtccgccgtgaatatgaccagccggatgctgctcaacagattcacaatggctcatcgcaagcccacctatgagcgggatgtcgacctgggcgccgggacaagacacgttgctgtggagccggaagtggccaaccttgatattatcggacaacgcattgagaatatcaagaacgaacataaatctacctggcactacgacgaggataatccttataagacgtgggcgtaccatggctcctatgaagtcaaacccagcgggtccgccagctctatggtgaacggagttgtgcggctgctcacaaagccctgggacgtcatccctatggtgacccagattgctatgaccgacacaacgccctttggccagcaaagagttttcaaagagaaggtggatacccgcacacctaaggccaaaagaggcaccgctcagatcatggaggtcacagccaagtggctgtgggggtttcttagccggaataaaaagccgcgcatttgtaccagagaagagttcacacggaaagtgagatccaacgctgccatcggagcggtttttgtggacgaaaatcagtggaactctgccaaggaggctgtcgaagatgagcggttctgggacctggtgcgcagagagcgggaactccacaagcagggcaaatgcgcgacctgcgtctacaatatgatggggaagcgcgagaaaaagctgggagaatttggcaaagctaaggggagcagagccatttggtatatgtggctgggcgcccggttcctcgagtttgaagcgctgggattcatgaacgaggatcactggttctcccgcgaaaattctcttagcggcgtggaaggggagggactgcataaactcggctacatcctgagagacatctccaagattcccgggggaaacatgtacgctgatgacacggccggctgggatacccggatcacagaagaggaccttcaaaatgaggccaagattaccgatatcatggaacctgagcacgctctgctcgccacatctatttttaaactgacctatcagaacaaggttgtgcgcgtccagagacccgctaaaaatgggacggtgatggacgtgatcagccggcgcgatcagagaggctccggacaagttggcacatacgggctgaacaccttcacaaacatggaagcccagctcatccggcagatggagagcgaaggaatcttttctccttccgagctggagacccccaatcttgcgggccgcgtgctggactggctcgaaaagcatgggatcgagagactgcggagaatggccattagcggagacgattgtgtcgtgaaaccgatcgacgatcgcttcgctacggcccttaccgctctgaacgacatgggcaaggttcggaaggatattcctcagtgggaaccctctaaagggtggaatgactggcaacaggtgcctttttgctcccaccacttccatcagctcatcatgaaggatggcagagagattgtcgtgccctgtcgcaaccaggacgaactggtcggacgggccagagtgagccaaggcgcggggtggtccctgcgcgagacagcctgcctcggaaaatcttatgctcagatgtggcagctgatgtactttcaccggagagatcttcgcctggccgctaatgccatctgtagcgctgttcctgtggactgggtccccacctcccggacaacctggagcatccatgcccaccatcaatggatgacaaccgaggatatgctctctgtgtggaacagagtttggattgaagagaatccgtggatggaagacaagacgcacgtgtccagctgggaggacgtcccttatctgggcaaacgcgaagatcagtggtgcgggtctcttatcggactgacagcgcgggccacctgggctaccaacattcaggtggccatcaaacaggtgagacggctcattggcaatgagaactacctggactatatgacaagcatgaagagattcaaaaatgagtccgatcccgaaggggccctgtggtga

SEQ ID NO: 19447 - RNA, 9879 nt, synthetic construct
  misc_feature 1..9879: note = derived and/or modified CDS sequence (opt5) from DENV-1__JQ915071__SS-prME
  source 1..9879: mol_type = other RNA
agcgtgaccatgctgctcatgctgcttcccacagtcctgacgttccacctcaccacaagaggcggggagcctcatatgatcgtttccaagcaggaacggggaaaatctctgctttttaagaccagcgccggcgtgaacatgtgcacactgattgctatggacctcggggagctgtgtgatgacaccatgacatacaaatgcccgcgcatcaccgaaacggagcccgatgacgtggattgttggtgcaatgccaccgaaacatgggtcacctatggaacatgttcccaaaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagagcaggacacaaatttcgtctgccggcgcacgtttgtggatagaggctggggcaacgggtgtggactgttcggcaaagggagccttattacctgcgccaagtttaagtgcgcgacaaaactggagggaaagatcgttcagtacgaaaatctcaaatattctgtgatcgtcaccgtgcacacaggcgaccagcatcaagttgggaacgagaccacggaacacggaaccattgccacaatcaccccccaggctcctacatccgagattcagctgaccgactacggcgccctgacgctcgattgtagcccccggacaggcctggacttcaatgaaatggtgcttctgaccatgaaggagaaatcttggctcgtccataagcagtggtttctggatcttcctctgccctggacaaccggggcttccaccagccaagagacatggaaccgccaggacctcctggtgacgttcaaaaccgcccacgccaagaagcaggaagtcgtggttctgggatcccaagagggcgctatgcacacagcgctcaccggggccacagaaatccagacctctggaacgacaaccatttttgctggccatctgaaatgcagacttaagatggataaactgaccctcaaggggatcagctatgtgatgtgtacaggctccttcaaactggagaaggaagtcgccgagacccagcacggaacagtgctggttcaggtgaagtacgagggcacggacgccccgtgcaaaatccctttcagctctcaagatgaaaagggggtcacccagaatggacggcttgtgacagctaaccccattgtgaccgacaaagagagacctgttaatatcgaagccgagcccccctttggcgagtcctatattgtcgtgggggcgggagaaaaggctctcaaactgagctggttcaagaagggctctagcatcgggaaaatgtttgaggccacagcccgcggcgctcggagaatggccattctgggagataccgcttgggacttcggctccatcgggggagtgtttacgtctgtcggcaagctcgtgcatcagatcttcgggaccgcctacggagttctgtttagcggcgtgtcctggacaatgaaaattgggatcggcattcttctgacctggctcggactgaacagccgctctacatccctgagcatgacctgtatcgcggtcggcatggtgacactttacctcggggttatggtgcaggccgattctggatgcgtcattaattggaagggccgggaactgaaatgtgggtccggaatcttcgtgaccaacgaggttcacacgtggacagaacaatataagtttcaggctgacagccctaagagactgtccgccgctattggcaaagcctgggaggagggggtgtgcggcatccgctctgcgacccggctcgaaaacatcatgtggaagcagattagcaatgagctgaaccatatccttctggaaaatgacatgaaattcaccgtcgtggtgggagatgtctccggcattctcgcccaggggaagaaaacaatcagaccgcaacccatggagcacaagtactcttggaaaagctggggaaaggctaagattatcggcgccgacgttcagaacaccacgtttatcattgatgggcctaatacacccgaatgtcctgacgatcagcgcgcttggaacatctgggaggtggaggactatggattcggcatttttaccacaaatatctggctgaaactgcgggattcctacacccaggtgtgcgaccacagacttatgagcgccgccattaaggattctaaagctgtccatgcggacatgggctattggatcgaatccgagaagaacgaaacatggaaactcgcccgcgctagcttcatcgaggtgaagacctgtgtttggcccaagtctcacacgctgtggtccaatggggtgctggaaagcgagatgattatcccgaaaatttacggaggccctatctctcaacataactatcggcccgggtacttcacccagacagccggaccttggcacctcggcaagctggagcttgattttgacctgtgcgaagggaccacagtcgtggttgatgagcactgcggaaatagaggccccagcctccggaccacgacagtgaccggcaaaattatccatgaatggtgttgccgctcctgtacactgcctcccctgagattcaagggggaggacggatgctggtacggcatggagatccggccggtcaaagaaaaggaggaaaaccttgtgaagagcatggtttctgccgggtccggagaggtggacagcttttccctcggcctgctgtgtatttctatcatgattgaagaggtcatgagaagccgctggtcccggaaaatgctcatgaccgggaccctggtggtgttccttctgctcacactgggacagctgacgtggaatgatcttatcagactgtgcattatggtcggcgctaacgcctctgacaatatgggcatggggaccacatatctcgcgctgatggctacctttcgcatgagacctatgttcgccgttggactcctgtttcggcgccttacaagcagagaggtgctgctcctgaccgtgggcctgtcccttgtcgcctctgtggaactgcccaacagcctcgatgagctgggggacggactcgctatgggcatcatgattctgaagcttctgacggatttccaatcccaccagctctgggccacactgctgagccttacctttgttaaaaccacactgtctctccattacgcgtggaagaccatggctatgatcctgtccatcgtgagcctcctgcccctttgtctgtctacaacgtcccagaaaaccacatggctgcctgtcctcctggggagccttggatgcaagccgctgaccatgttcctcattacagaaaacaagatctggggccggaaatcttggcccctgaatgagggcattatggccgtggggatcgtttccattctcctgagctcccttctgaagaacgacgtgcctctggccggacccctcatcgctggcgggatgctgatcgcctgttatgtcattagcggatctagcgctgatctttccctggaaaaagccgcgaaggtgtcttgggaggaggaagccgagcacagcggcgcttcccataatatcctcgtcgaaattcaggacgatgggaccatgaaaatcaaggacgaggaacgcgatgacacgattaccatcctgctcaaagccacactgcttgctatctctggagtgtaccctatgagcattcccgccaccctgtttgtttggcacttctggcaaaagaagaaacagagatccggcgtgctgtgggatacaccttctcccccggaggtcgagaaggccgtgctcgacgacggcatctatcggattctgcagcgcgggcttctgggaagaagccaggttggcgtgggggtctttcaagaaggagtgttccacaccatgtggcatgtgacacggggcgctgttctcatgtaccaggggaaacgcctggagccttcctgggcgagcgtcaagaaagatctcatctcttatggaggcggctggagattccaggggtcctggaacacgggagaagaggtgcaggtgattgccgtcgagcccggcaagaatcctaagaacgtgcaaaccgctcccgggacatttaaaaccagcgaaggagaggttggcgccatcgccctggacttcaagccggggacctctggatcccctattgtgaatcgggaaggcaaaatcgtcggcctttacgggaacggagtggttacaacgagcggcacctacgtgtccgctatcgcccaggcgaaggcttctcaggaggggcccctgcctgaaattgaggatgaggtctttagaaaacgcaatctgacaatcatggacctccaccccggaagcggcaagacccggagatatctgcccgccattgtgcgcgaagccatcaagcggaaacttagaacactggttctcgctcctacccgcgtggtcgcctccgagatggcggaagctctgaaggggatgccgattcggtaccaaacgacagccgtgaaaagcgagcataccggcaaggaaatcgtggatctgatgtgccacgccaccttcacaatgagactcctttctcccgtccgcgttcctaactataatatgatcattatggacgaggctcattttaccgatcccgcctccatcgctgcccggggatacattagcacaagagtgggcatgggggaggcggccgctatcttcatgaccgccacgcctcccggatctgtggaagcttttcctcagagcaacgccgtcattcaggacgaggaaaaagatatcccggagcggtcctggaattctggctatgactggatcacagatttccccgggaagaccgtgtggtttgttcctagcattaagtccggaaacgacatcgccaattgtctgcgcaaaaacggcaagagagtgattcagctgtctcggaaaacattcgacaccgaataccaaaagacgaaaaacaatgattgggactatgtcgtgaccacagatatcagcgagatgggggctaactttcgcgcggacagagttattgatccccggagatgcctcaagcctgtgatcctgaaggacggccccgagcgcgtcattcttgccggaccgatgcctgtgaccgtcgcttccgccgcccagcggagaggccgcatcgggcggaatcagaacaaagaaggagatcagtacatctacatgggccaacccctgaataacgacgaggatcacgctcactggacagaagccaagatgctcctggacaatattaacacccccgaggggatcattcctgcgctgttcgagcccgaaagagagaaaagcgctgccatcgatggagaatatcgcctccggggcgaggccagaaagacattcgtggaacttatgcgcagaggggacctgcctgtttggctgtcttacaaagtggcttccgagggctttcagtatagcgatcggcgctggtgcttcgacggagagagaaataaccaggtgctcgaagagaatatggacgtcgaaatttggaccaaggagggcgaacggaaaaagctgcgcccgagatggcttgatgcccggacgtactccgaccccctggcgctcagagagtttaaggagttcgccgctgggcgccggtctgttagctccgatctgatcctggaaatcggaaaactccctcagcatcttacacaaagagcccagaacgctctggacaatctggtgatgctccacaactctgagcagggcgggaaggcctatcgccatgctatggaagagctgcccgataccattgaaaccatcatgcttctggccctcattgcggtgctgacaggaggcgtcaccctgtttttcctcagcggccgggggcttggaaaaacatccatcggcctgctgtgtgtgacgagctcttccgccctcctgtggatggctaatgttgagcctcactggattgccgctagcatcatccttgagtttttcctgatggtgctcctgattcccgaaccggacagacagcggacccctcaagataaccagctggcctacgtcgtgatcgggctcctttttatgattctgacagtcgccgctaacgagatgggactgctcgaaaccacaaagaaagacctgggcatcgggcacaccgcggccgagaatcatcaccatgctgccatgcttgatgtggacctgcaccccgcctctgcttggacgctctatgccgttgcgaccacaattatcacccctatgatgcgccatacaattgagaacaccacggccaatatctccctgacagctatcgccaaccaggctgccattctgatgggactcgataagggctggcccatcagcaagatggacattggcgtgcctcttctggcgctggggtgctactctcaagtcaatcccctcaccctgacagccgctgtgcttatgctggttgcccactacgctatcattggaccgggcctccaggccaaagctaccagagaagcccagaagcggaccgcggccgggatcatgaaaaaccctacagtggatggaatcgtcgctattgacctggaccccgtggtgtatgatgccaagttcgagaaacagctgggccaaatcatgctccttattctgtgtacgagccagatcctgctcatgcgcaccacatgggctctgtgcgaatccattacccttgccacagggcccctgaccacgctctgggagggatctcctggcaagttttggaatacaaccatcgccgttagcatggcgaacatcttcagaggctcctacctggctggggccggactggcttttagcctcatgaagtcccttggcgggggacggcgcggcaccggggcccagggagaaacactgggcgagaaatggaagagacagctgaatcaactctctaaaagcgagttcaacacctataagcggtccggcattatcgaagtcgaccgctctgaggccagagaagggctgaaacggggagagacaacgaagcacgctgtgagcagaggcaccgccaagcttcgctggttcgtggaacggaatctggtcaaaccggaggggaaggttattgatctcggatgtggcagagggggatggtcctactattgcgcgggcctgaaaaaggtgacagaggtgaaaggctacaccaaggggggacccggccatgaagagcctatccccatggccacatatgggtggaacctggtcaaactccactctggaaaggacgtgtttttcattcctcccgaaaagtgtgatacccttctgtgcgacatcggcgagagctcccctaatccgacgattgaagaggggcgcaccctgcgggttctcaaaatggtggagccctggctgagaggaaaccagttttgtatcaagatccttaatccttacatgcccagcgtcgtggaaacactggagcagatgcagcgcaaacatggcggcatgctcgttcggaaccctctgtctagaaattccacccacgaaatgtactgggtgagctgcgggacaggaaacattgtctctgctgtgaacatgacctcccgcatgctgctcaatcggttcacaatggcccacagaaagcccacctatgagcgcgatgtggacctgggcgctgggacgcggcatgtcgccgttgagccggaagtggcgaaccttgatatcattggacaaagaatcgagaatattaaaaacgaacacaagagcacatggcattacgacgaggataatccttataagacctgggcctaccacggctcttatgaagtgaaaccctccgggagcgcttccagcatggtcaacggagtggttcgcctgctcaccaagccctgggacgtgatccctatggtcacacagatcgccatgacggacaccacaccctttggccagcaaagagtgttcaaagagaaggttgatacccggacacctaaagctaagcgcggcaccgcccagattatggaggtgacagctaagtggctgtgggggtttctttctagaaataaaaagccgcggatctgtaccagagaagagttcacgcggaaagtccgcagcaacgccgcgattggagccgtgtttgttgacgaaaatcagtggaactccgctaaggaggccgtggaagatgagagattctgggacctggtccggcgcgagagagaactccataaacagggcaagtgcgctacctgcgtgtacaatatgatggggaagcgggagaaaaagctgggagaatttggcaaagccaaggggtctcgcgccatctggtatatgtggctgggcgcgagattcctcgagtttgaagctctgggattcatgaacgaggatcactggttcagccgggagaattccctttctggcgtcgaaggggagggactgcacaaactcggctacattctgcgcgacatcagcaagatccccgggggaaacatgtacgccgatgacacagccggctgggataccagaattacagaagaggaccttcaaaatgaggctaaaatcaccgatattatggaacctgagcatgccctgctcgctacgtccatctttaagctgacatatcagaacaaggtggttcgggtgcagcgccccgccaaaaacgggaccgtcatggacgtgatttctagacgggatcagcgcggcagcggacaagtgggcacatacgggctgaataccttcacgaacatggaagcgcagctcatcagacagatggagtccgaaggaatctttagcccttctgagctggagacccccaatcttgccggccgggttctggactggctcgaaaagcacgggattgagagactgcgccggatggctatctccggagacgattgtgtggtcaaaccgattgacgatagattcgccacagctcttaccgccctgaacgacatgggcaaggtgcgcaaagatatccctcagtgggaacccagcaaggggtggaatgactggcaacaggttcctttttgctctcatcacttccaccagctcattatgaaggatggccgggagatcgtggtcccctgtagaaaccaggacgaactggtgggacgcgcgcgggtctcccaaggcgccgggtggagcctgagagagacagcttgcctcggaaaatcctatgcccagatgtggcagctgatgtactttcatcgccgggatcttagactggctgccaatgctatttgttctgccgtgcctgttgactgggtgcccaccagccgcacaacctggtccatccacgcgcatcaccaatggatgacgacagaggatatgctcagcgtctggaaccgggtgtggatcgaagagaatccgtggatggaagacaagacccatgtttcttcctgggaggacgtgccttatctgggcaaaagagaagatcagtggtgcgggagccttattggactgaccgcccgggctacatgggccaccaacatccaggtcgccattaatcaggtgagacgcctcatcggcaacgagaattacctggactatatgacatctatgaagcggttcaaaaacgagagcgatcccgaaggggctctgtggtga

SEQ ID NO: 19448 - RNA, 9879 nt, synthetic construct
  misc_feature 1..9879: note = derived and/or modified CDS sequence (opt5) from DENV-1__JQ915073__SS-prME
  source 1..9879: mol_type = other RNA
tccgtgaccatgctgctcatgctgcttcccaccgtcctgacgttccacctcaccacaagaggcggggagcctcatatgatcgtttccaagcaggaacggggaaaatctctgctttttaagacctccgccggcgtgaacatgtgcacactgattgctatggacctcggggagctgtgtgatgacaccatgacatacaaatgcccgagaatcaccgaaacggagcccgatgacgtggattgttggtgcaatgccaccgaaacatgggtcacctatggaacatgtttccagaccggcgagcacagacgggacaagcgctccgtggcgctggctcctcatgttgggctcggactggagacgagaacagaaacctggatgtctagcgagggcgcctggcggcagattcagaaagtggaaacatgggcccttcgccaccccggctttaccgtcatcgctctgttcctcgcccatgctattgggacctccatcacacagaagggaatcatttttatcctgcttatgctggtgacgccttctatggccatgagatgcgttggcattgggaaccgggatttcgtggagggactcagcggcgcgacctgggtcgacgtggtgctggagcacgggtcctgtgtcacaaccatggccaaggataaacccacactggacatcgaactcctgaagaccgaggttacgaatcctgctgtgcttcgcaaactgtgcattgaagccaagatcagcaacacaaccaccgattctagatgtccgacacaaggagaggctaccctcgtggaagaacaagacacaaattttgtctgccggcgcacgttcgtggatagaggctggggcaacgggtgtggactgtttggcaaagggtcccttattacctgcgccaagttcaagtgcgttacaaaactggagggaaagatcgtgcagtacgaaaatctcaaatatagcgtcatcgtgaccgttcacacaggcgaccagcatcaagtggggaacgagaccacggaacacggaaccattgcgacaatcacaccccaggcccctacatctgagattcagctgaccgactacggcgctctgacgctcgattgtagcccccggacaggcctggactttaatgaaatggtccttctgaccatgaaggagaaaagctggctcgtgcataagcagtggttcctggatcttcctctgccctggacaaccggggcctctacctcccaagagacatggaaccgccaggacctcctggtcacgtttaaaaccgctcacgccaagaagcaggaagtggttgtgctgggaagccaagagggcgccatgcacacagctctcaccggggcgacagaaatccagacctccggaacgacaaccattttcgccggccatctgaaatgcagacttaagatggataaactgaccctcaaggggatctcttatgtcatgtgtacaggcagcttcaaactggagaaggaagtggctgagacccagcacggaacagttctggtgcaggtcaagtacgagggcacggacgccccgtgcaaaatccctttttccagccaagatgaaaagggggtgacccagaatggacggcttgtgacagccaaccccattgttaccgacaaagagaagcctgtcaatatcgaagctgagccgcccttcggcgagtcttatattgtggtgggggccggagaaaaagcgctcaagctgtcctggtttaagaaaggcagctctatcgggaagatgttcgaggctacagccagaggcgcccgccggatggctattctgggagataccgcctgggactttggcagcatcgggggagtcttcacgtccgtgggcaaactcgttcatcagatctttgggaccgcttacggagtgctgttctctggcgtcagctggacaatgaagattgggatcggcattcttctgacctggctcggactgaactccagaagcacatctctgtccatgacctgtatcgccgtgggcatggttacactttacctcggggtgatggtccaggcggatagcggatgcgtgattaattggaaaggccgcgaactgaagtgtgggtctggaatctttgttaccaacgaggtgcacacgtggacagaacaatataagttccaggccgactcccctaaacggctgagcgctgccattggcaaggcttgggaggagggggtctgcggcatcagatccgccacccgcctcgaaaacatcatgtggaaacagatttctaatgagctgaaccatatccttctggaaaatgacatgaagtttaccgtggtggtcggagatgttagcggcattctcgcgcaggggaaaaagacaatccggccgcaacccatggagcacaaatactcctggaagtcttggggaaaggccaaaattatcggcgctgacgtgcagaacaccacgttcatcattgatgggcctaatacacccgaatgtcctgacgatcagagagcctggaacatctgggaggtggaggactatggatttggcattttcaccacaaatatctggctgaagctgcgcgatagctacacccaggtctgcgaccaccggcttatgtccgctgccattaaagatagcaaggccgtgcatgctgacatgggctattggatcgaatctgagaaaaacgaaacatggaagctcgcgagagcctccttcatcgaggttaagacctgtgtgtggcccaaaagccacacgctgtggtctaatggggtcctggaatccgagatgattatcccgaagatttacggaggccctatcagccaacataactatcgccccgggtactttacccagacagctggaccttggcacctcggcaaactggagcttgatttcgacctgtgcgaagggaccacagtggttgtggatgagcactgcggacatcggggcccctctctcagaaccacgacagtcaccggcaagattatccacgaatggtgttgccggagctgtacactgcctcccctgcgctttaaaggggaggacggatgctggtacggcatggagatcagaccggtgaaggaaaaggaggaaaatcttgttaaatccatggtgagcgccgggtctggagaggtcgactccttcagcctcggcctgctgtgtatttccatcatgattgaagaggtgatgcggtctagatggagccgcaagatgctcatgaccgggaccctggtggtctttcttctgctcacactgggacagctgacgtggaacgatcttatccggctgtgcattatggttggcgccaatgcttccgacaacatgggcatggggaccacatatctcgccctgatggcgaccttcagaatgcgccctatgtttgctgtgggactcctgttcagacggcttacatctcgcgaggtgctgctcctgaccgtcggcctgagccttgtggcctccgttgaactgcccaattctctcgatgagctgggggacggactcgccatgggcatcatgattctgaaacttctgacggattttcaaagccatcagctctgggctacactgctgtcccttaccttcgtgaagaccacactgagcctccactacgcctggaaaaccatggcgatgatcctgtctatcgtctccctcctgcccctttgtctgagcacaacgtctcagaagaccacatggctgcctgtgctcctggggtcccttggatgcaagccgctgaccatgtttctcattacagaaaacaaaatctggggcagaaagagctggcccctgaacgagggcattatggctgttgggatcgtgtctattctcctgtccagccttctgaaaaatgacgtccctctggccggacccctcatcgccggcgggatgctgatcgcttgttatgtgatttccggaagctctgccgatcttagcctggaaaaggctgccaaagtctcctgggaggaggaagcggagcattctggcgccagccacaacatcctcgtggaaattcaggacgatgggaccatgaagatcaaagacgaggaacgggatgacacgattaccatcctgctcaaggctacactgcttgccatctccggagtttaccctatgtctattcccgctaccctgttcgtgtggcacttttggcaaaagaaaaagcagcgcagcggcgtcctgtgggatacacctagccctcccgaggtggagaaagccgttctcgacgacggcatctatcgcattctgcagcgggggcttctgggacgctctcaggtgggcgtcggggtgttccaagaaggagtgttccataccatgtggcacgttacaagaggcgccgtcctcatgtaccaggggaagcggctggagcccagctgggcttccgtgaaaaaggatctcatcagctatggaggcggctggcgctttcaggggtcttggaatacgggagaagaggtgcaggtcattgcggtggagcccggcaagaaccctaaaaatgttcaaaccacacccgggaccttcaagacctccgaaggagaggtgggcgccatcgctctggactttaaaccggggacaagcggatctcctattgtcaacagagaaggcaagatcgtgggcctttacgggaatggagttgtgacgacctccggcacatacgtcagcgccatcgcccaggctaaagcctcccaggaggggcccctgcctgaaattgaggatgaggtgttccggaagagaaacctgaccatcatggacctccatcccggatctggcaagacacgccggtatctgcccgcgattgttagagaagctatcaaacgcaaacttcggaccctggtgctcgcccctacgagagtcgtggccagcgagatggctgaagccctgaaagggatgccgattcgctaccaaacaaccgcggtgaagtccgagcacaccggcaaagaaatcgtcgatctgatgtgccatgctacatttaccatgcggctccttagccccgttagagtgcctaattataacatgatcattatggacgaggcccacttcacagatcccgcctctatcgctgcccgcggatacatttccacccgggtgggcatgggggaggctgccgcgatctttatgacggccacacctcccggaagcgctgaagccttccctcagtctaatgctgtcattcaggacgaggaaaaggatatcccggagagaagctggaactccggctatgactggatcaccgattttcccgggaagacagtgtggttcgttccttctattaaaagcggaaatgacatcgccaactgtctgcggaagaatggcaaacgcgtgattcagctgtccagaaagacctttgacacggaataccagaagaccaagaacaacgattgggactatgtcgtgacaaccgatatctctgagatgggggccaatttccgggctgaccgcgttattgatcccagacggtgcctcaagcctgtgatcctgaaagacggccccgagagagtcattcttgcgggaccgatgcctgtgacagtcgccagcgctgcccagcgccggggcagaatcgggcgcaaccagaataaggaaggagatcagtacatctacatgggccaacccctgaacaatgacgaggatcacgcccattggaccgaagctaaaatgctcctggacaacattaatacacccgaggggatcattcctgccctgttcgagcccgaacgggagaagtccgcggctatcgatggagaatatagactccgcggcgaggcccggaaaacctttgtggaacttatgagacgcggggacctgcctgtttggctgagctacaaggtggcctctgagggcttccagtattccgatagacggtggtgctttgacggagagcgcaacaatcaggtgctcgaagagaacatggacgtcgaaatttggacgaaagagggcgaaagaaagaagctgcggccgcgctggcttgatgctagaacatacagcgaccccctggccctccgggagttcaaagagtttgcggccgggagacgctccgtttctggagatctgatcctggaaatcggcaagctccctcagcaccttacccaacgggctcagaatgccctggacaacctggtgatgctccataatagcgagcaagggggaaaggcttatagacacgccatggaggaactgcccgataccattgaaacaatcatgcttctggctctcattgccgtgctgaccggcggcgtcacactgttctttctctccgggcgcggacttggcaagacgtctatcgggctgctgtgtgtgaccagctccagcgcgctcctgtggatggcctctgttgagcctcactggattgctgcctccatcatccttgagttctttctgatggtgctcctgattcccgaaccggaccggcagagaacacctcaagataaccagctggcttacgtcgtgatcggactccttttcatgattctgaccgtcgccgccaatgagatgggcctgctcgaaacaaccaaaaaggacctggggatcggacatacggctgcggagaaccaccatcacgccgctatgcttgatgtggacctgcatcccgccagcgcctggaccctctatgctgttgccacaaccattatcacacctatgatgcggcacaccattgagaacacgacagcgaatatctctctgaccgccatcgctaaccaggccgctattctgatgggcctcgataagggctggcccatctccaaaatggacattggggtgcctcttctggccctgggatgctacagccaagtcaatcccctcacactgaccgcggccgtgcttatgctggttgctcactacgccatcattggcccggggctccaggctaaggccacccgcgaagctcagaaaagaacagccgcgggaatcatgaagaaccctacggtggatggcatcgtcgccattgacctggaccccgtggtgtatgatgctaaatttgagaagcagctggggcaaatcatgctccttattctgtgtacctctcagatcctgctcatgcggacaacctgggccctgtgcgaaagcattacacttgctaccggacccctgacgacactctgggagggctcccctggcaagttctggaataccaccatcgccgtttctatggccaacatctttcgcgggagctacctggcgggagctggcctggccttctccctcatgaaaagccttgggggaggcagacgggggacaggagctcagggcgaaaccctgggcgagaagtggaaacgccagctgaatcaactctccaagtctgagttcaacacatataaaagaagcgggattatcgaagtcgaccggtccgaggccaaggaaggactgaagcgcggcgagacgaccaaacatgccgtgtctagagggacagctaaacttcggtggtttgtggaaagaaatctggtcaaaccggagggaaaggttattgatctcggctgtgggcgcggaggctggagctactattgcgccggcctgaaaaaggtgaccgaggtgaaagggtacacaaagggaggccccgggcacgaggaacctatccccatggcgacctatggatggaacctggtcaagctccattccggcaaagacgtgttctttattcctcccgaaaagtgtgatacgcttctgtgcgacatcggggagtctagccctaatccgaccattgaagagggacggacactgagagttctcaaaatggtggagccctggctgcgcggcaaccagttctgtatcaagatccttaatccttacatgccctccgtcgtggaaaccctggagcagatgcagcggaaacacggcgggatgctcgttagaaaccctctgagccgcaattctacacacgaaatgtactgggtgtcctgcggaaccggcaacattgtcagcgccgtgaatatgacatctcggatgctgctcaacagatttaccatggctcatcgcaagcccacgtatgagcgggatgtggacctgggggccggaacaagacacgtcgctgttgagccggaagtggccaaccttgatatcattggccaacgcatcgagaatattaagaacgaacataaatccacctggcactacgacgaggataatccttataagacctgggcgtaccatgggagctatgaagtgaaaccctctggatccgccagctccatggtcaacggcgtggttcggctgctcacaaagccctgggacgtgatccctatggtcacgcagatcgctatgaccgacacaacccccttcggccagcaaagagtgtttaaagagaaggttgatacacgcacccctaaggccaaaagagggacagctcagattatggaggtgaccgccaagtggctgtggggattccttagccggaataaaaagccgcgcatctgtacgagagaagagtttacccggaaagtcagatctaacgctgccattggcgcggtgttcgttgacgaaaatcagtggaacagcgccaaggaggctgtggaagatgagcggttttgggacctggtccgcagagagcgggaactccacaagcaggggaaatgcgccacatgcgtgtacaatatgatgggaaagcgcgagaaaaagctgggcgagttcgggaaagctaagggctccagagccatctggtatatgtggctgggagcccggtttctcgagttcgaagcgctgggcttcatgaacgaggatcactggttttctcgcgagaatagcctttccggggtcgaaggagagggcctgcataaactcgggtacattctgagagacatctctaagatccccggaggcaacatgtacgctgatgacaccgccgggtgggatacacggattaccgaagaggaccttcaaaatgaggccaagatcacggatattatggaacctgagcacgctctgctcgccacaagcatcttcaaactgacctatcagaacaaggtggttcgcgtgcagagacccgctaaaaatggcacagtcatggacgtgatttcccggcgcgatcagagaggatctggccaagtggggacctacggactgaacacgtttaccaacatggaagcccagctcatccggcagatggagagcgaaggcatcttctcccctagcgagctggagacacccaatcttgcggggcgcgttctggactggctcgaaaagcatggaattgagagactgcggagaatggccatctctggcgacgattgtgtggtcaaaccgattgacgatcgctttgctaccgcccttacagctctgaacgacatggggaaggtgcggaaggatatccctcagtgggaaccctccaaaggctggaatgactggcaacaggttcctttctgcagccaccactttcatcagctcattatgaaggatggaagagagatcgtggtcccctgtcgcaaccaggacgaactggtgggccgggccagagtctctcaaggggcgggatggtccctgcgcgagaccgcctgcctcggcaaaagctatgctcagatgtggcagctgatgtacttccaccggagagatcttcgcctggccgctaatgccatttgttccgctgtgcctgttgactgggtgcccacatctcggaccacgtggagcatccatgcccaccatcaatggatgacaaccgaggatatgctctccgtctggaacagagtgtggatcgaagagaatccgtggatggaagacaagacccacgttagctcttgggaggacgtgccttatctggggaaacgcgaagatcagtggtgcggatcccttattggcctgacagcgcgggccacctgggctacaaacatccaggtcgccattaatcaggtgagacggctcatcgggaacgagaattacctggactatatgacgagcatgaagagatttaagaacgagtctgatcccgaaggcgccctgtggtga

SEQ ID NO: 19449 - RNA, 9879 nt, synthetic construct
  misc_feature 1..9879: note = derived and/or modified CDS sequence (opt5) from DENV-1__JQ915075__SS-prME
  source 1..9879: mol_type = other RNA
agcgtgaccatgctgctcatgctgcttcccacagtcctgacgttccacctcaccacaagaggcggggagcctcatatgatcgtttccaagcaggaacggggaaaatctctgctttttaagaccagcgccggcgtgaacatgtgcacactgattgctatggacctcggggagctgtgtgatgacaccatgacatacaaatgcccgcgcatcaccgaaacggagcccgatgacgtggattgttggtgcaatgccaccgaaacatgggtcacctatggaacatgttcccaaaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagagcaggacacaaatttcgtctgccggcgcacgtttgtggatagaggctggggcaacgggtgtggactgttcggcaaagggagccttattacctgcgccaagtttaagtgcgcgacaaaactggagggaaagatcgttcagtacgaaaatctcaaatattctgtgatcgtcaccgtgcacacaggcgaccagcatcaagttgggaacgagaccacggaacacggaaccattgccacaatcaccccccaggctcctacatccgagattcagctgaccgactacggcgccctgacgctcgattgtagcccccggacaggcctggacttcaatgaaatggtgcttctgaccatgaaggagaaatcttggctcgtccataagcagtggtttctggatcttcctctgccctggacaaccggggcttccaccagccaagagacatggaaccgccaggacctcctggtgacgttcaaaaccgcccacgccaagaagcaggaagtcgtggttctgggatcccaagagggcgctatgcacacagcgctcaccggggccacagaaatccagacctctggaacgacaaccatttttgctggccatctgaaatgcagacttaagatggataaactgaccctcaaggggatcagctatgtgatgtgtacaggctccttcaaactggagaaggaagtcgccgagacccagcacggaacagtgctggttcaggtgaagtacgagggcacggacgccccgtgcaaaatccctttcagctctcaagatgaaaagggggtcacccagaatggacggcttgtgacagctaaccccattgtgaccgacaaagagagacctgttaatatcgaagccgagcccccctttggcgagtcctatattgtcgtgggggcgggagaaaaggctctcaaactgagctggttcaagaagggctctagcatcgggaaaatgtttgaggccacagcccgcggcgctcggagaatggccattctgggagataccgcttgggacttcggctccatcgggggagtgtttacgtctgtcggcaagctcgtgcatcagatcttcgggaccgcctacggagttctgtttagcggcgtgtcctggacaatgaaaattgggatcggcattcttctgacctggctcggactgaacagccgctctacatccctgagcatgacctgtatcgcggtcggcatggtgacactttacctcggggttatggtgcaggccgattctggatgcgtcattaattggaagggccgggaactgaaatgtgggtccggaatcttcgtgaccaacgaggttcacacgtggacagaacaatataagtttcaggctgacagccctaagagactgtccgccgctattggcaaagcctgggaggagggggtgtgcggcatccgctctgcgacccggctcgaaaacatcatgtggaagcagattagcaatgagctgaaccatatccttctggaaaatgacatgaaattcaccgtcgtggtgggagatgtctccggcattctcgcccaggggaagaaaacaatcagaccgcaacccatggagcacaagtactcttggaaaagctggggaaaggctaagattatcggcgccgacgttcagaacaccacgtttatcattgatgggcctaatacacccgaatgtcctgacgatcagcgcgcttggaacatctgggaggtggaggactatggattcggcatttttaccacaaatatctggctgaaactgcgggattcctacacccaggtgtgcgaccacagacttatgagcgccgccattaaggattctaaagctgtccatgcggacatgggctattggatcgaatccgagaagaacgaaacatggaaactcgcccgcgctagcttcatcgaggtgaagacctgtgtttggcccaagtctcacacgctgtggtccaatggggtgctggaaagcgagatgattatcccgaaaatttacggaggccctatctctcaacataactatcggcccgggtacttcacccagacagccggaccttggcacctcggcaagctggagcttgattttgacctgtgcgaagggaccacagtcgtggttgatgagcactgcggaaatagaggccccagcctccggaccacgacagtgaccggcaaaattatccatgaatggtgttgccgctcctgtacactgcctcccctgagattcaagggggaggacggatgctggtacggcatggagatccggccggtcaaagaaaaggaggaaaaccttgtgaagagcatggtttctgccgggtccggagaggtggacagcttttccctcggcctgctgtgtatttctatcatgattgaagaggtcatgagaagccgctggtcccggaaaatgctcatgaccgggaccctggtggtgttccttctgctcacactgggacagctgacgtggaatgatcttatcagactgtgcattatggtcggcgctaacgcctctgacaatatgggcatggggaccacatatctcgcgctgatggctacctttcgcatgagacctatgttcgccgttggactcctgtttcggcgccttacaagcagagaggtgctgctcctgaccgtgggcctgtcccttgtcgcctctgtggaactgcccaacagcctcgatgagctgggggacggactcgctatgggcatcatgattctgaagcttctgacggatttccaatcccaccagctctgggccacactgctgagccttacctttgttaaaaccacactgtctctccattacgcgtggaagaccatggctatgatcctgtccatcgtgagcctcttccccctgtgtctttctacaacgtcccagaaaaccacatggctgcctgtcctgctcgggagcctgggatgcaagccgcttaccatgtttctgattacagaaaacaagatctggggccggaaatcttggcccctcaatgagggcattatggccgtggggatcgtttccattctgctcagctccctgcttaagaacgacgtgcctctggccggacccctgatcgctggcgggatgctcatcgcctgttatgtcattagcggatctagcgctgatctgtcccttgaaaaagccgcgaaggtgtcttgggaggaggaagccgagcacagcggcgcttcccataatatcctggtcgaaattcaggacgatgggaccatgaaaatcaaggacgaggaacgcgatgacacgattaccatcctcctgaaagccacactcctggctatctctggagtgtaccctatgagcattcccgccacccttttcgtttggcacttttggcaaaagaagaaacagagatccggcgtgctgtgggatacaccttctcccccggaggtcgagaaggccgtgctggacgacggcatctatcggattctccagcgcgggctgcttggaagaagccaggttggcgtgggggtcttccaagaaggagtgttccacaccatgtggcatgtgacacggggcgctgttctgatgtaccaggggaaacgcctcgagccttcctgggcgagcgtcaagaaagatctgatctcttatggaggcggctggagatttcaggggtcctggaacacgggagaagaggtgcaggtgattgccgtcgagcccggcaagaatcctaagaacgtgcaaaccgctcccgggatcttcaaaacaagcgaaggagaggttggcgccattgccctcgactttaagccggggacctctggatcccctatcgtgaatcgggaaggcaaaatcgtcggcctgtacgggaacggagtggttaccacaagcggcacgtacgtgtccgctattgcccaggcgaaggcttctcaggaggggccccttcctgaaatcgaggatgaggtcttcagaaaacgcaatctgaccattatggacctgcaccccggaagcggcaagacacggagatatctccccgccatcgtgcgcgaagccattaagcggaaactgagaacccttgttctggctcctacacgcgtggtcgcctccgagatggcggaagctctcaaggggatgccgatccggtaccaaaccacggccgtgaaaagcgagcatacaggcaaggaaatcgtggatctgatgtgccacgccacctttaccatgagactgctctctcccgtccgcgttcctaactataatatgattatcatggacgaggctcatttcacagatcccgcctccattgctgcccggggatacatcagcaccagagtgggcatgggggaggcggccgctatttttatgacagccacccctcccggatctgtggaagctttccctcagagcaacgccgtcatccaggacgaggaaaaagatatcccggagcggtcctggaattctggctatgactggattacggattttcccgggaagacagtgtggttcgttcctagcatcaagtccggaaacgacattgccaattgtcttcgcaaaaacggcaagagagtgatccagctgtctcggaaaacctttgacacagaataccaaaagaccaaaaacaatgattgggactatgtcgtgacgaccgatattagcgagatgggggctaacttccgcgcggacagagttatcgatccccggagatgcctgaagcctgtgattctcaaggacggccccgagcgcgtcatcctggccggaccgatgcctgtgacagtcgcttccgccgcccagcggagaggccgcatcgggcggaatcagaacaaagaaggagatcagtacatttacatgggccaaccccttaataacgacgaggatcacgctcactggaccgaagccaagatgctgctcgacaatatcaacacacccgaggggattatccctgcgctgttcgagcccgaaagagagaaaagcgctgccattgatggagaatatcgcctgcggggcgaggccagaaagacctttgtggaactcatgcgcagaggggaccttcctgtttggctgtcttacaaagtggcttccgagggcttccagtatagcgatcggcgctggtgctttgacggagagagaaataaccaggtgctggaagagaatatggacgtcgaaatctggacaaaggagggcgaacggaaaaagctccgcccgagatggctggatgcccggacctactccgacccccttgcgctgagagagttcaaggagtttgccgctgggcgccggtctgttagctccgatctcatcctggaaattggaaaactgcctcagcatctcacgcaaagagcccagaacgctcttgacaatctggtgatgctgcacaactctgagcagggcgggaaggcctatcgccatgctatggaagagctccccgatacaatcgaaaccattatgctgcttgccctgatcgcggtgctcaccggaggcgtcacactgttctttctgagcggccgggggctcggaaaaacctccattggccttctgtgtgtgacaagctcttccgccctgctctggatggctaatgttgagcctcactggatcgccgctagcatcattctggagttctttcttatggtgctgctcatccccgaaccggacagacagcggacgcctcaagataaccagctggcctacgtcgtgattgggctgctcttcatgatccttaccgtcgccgctaacgagatgggactgctggaaacaaccaagaaagacctcggcattgggcacacagcggccgagaatcatcaccatgctgccatgctggatgtggaccttcaccccgcctctgcttggaccctgtatgccgttgcgacgaccatcattacacctatgatgcgccataccatcgagaacacaaccgccaatatctccctcacggctatggccaaccaggctgccattctgatgggactggataagggctggcccatcagcaagatggacattggcgtgcctctccttgcgctggggtgctactctcaagtcaatcccctgacactcaccgccgctgtgctgatgcttgttgcccactacgctatcattggaccgggcctgcaggccaaagctacaagagaagcccagaagcggaccgcggccgggatcatgaaaaaccctaccgtggatggaatcgtcgctattgacctcgaccccgtggtgtatgatgccaagtttgagaaacagctgggccaaatcatgctgctcattctttgtacaagccagatcctgctgatgcgcacgacctgggctctctgcgaatccattacactggccaccgggccccttacaaccctgtgggagggatctcctggcaagttctggaatacgacaatcgccgttagcatggcgaacatctttagaggctcctacctcgctggggccggactggctttcagcctgatgaagtccctcggcgggggacggcgcggcaccggggcccagggagaaacccttggcgagaaatggaagagacagctgaatcaactgtctaaaagcgagttcaacacatataagcggtccggcattatcgaagtcgaccgctctgaggccagagaagggctcaaacggggagagaccacaaagcacgctgtgagcagaggcacggccaagctgcgctggtttgtggaacggaatcttgtcaaaccggaggggaaggttattgatctgggatgtggcagagggggatggtcctactattgcgcgggcctcaaaaaggtgaccgaggtgaaaggctacacaaaggggggacccggccatgaagagcctatccccatggccacctatgggtggaacctggtcaaactgcactctggaaaggacgtgttctttattcctcccgaaaagtgtgatacactcctttgcgacatcggcgagagctcccctaatccgaccattgaagaggggcgcacgctgcgggttctgaaaatggtggagccctggctcagaggaaaccagttctgtatcaagatcctgaatccttacatgcccagcgtcgtggaaacccttgagcagatgcagcgcaaacatggcggcatgctggttcggaaccctctctctagaaattccacacacgaaatgtactgggtgagctgcgggaccggaaacattgtctctgctgtgaacatgacatcccgcatgctgctgaatcggtttaccatggcccacagaaagcccacatatgagcgcgatgtggacctcggcgctgggacccggcatgtcgccgttgagccggaagtggcgaacctggatatcattggacaaagaatcgagaatattaaaaacgaacacaagagcacgtggcattacgacgaggataatccttataagacatgggcctaccacggctcttatgaagtgaaaccctccgggagcgcttccagcatggtcaacggagtggttcgccttctgaccaagccctgggacgtgatccctatggtcacccagatcgccatgacagacacgacccccttcggccagcaaagagtgtttaaagagaaggttgatacacggacccctaaagctaagcgcggcacagcccagattatggaggtgaccgctaagtggctctgggggttcctgtctagaaataaaaagccgcggatctgtacaagagaagagtttacccggaaagtccgcagcaacgccgcgattggagccgtgttcgttgacgaaaatcagtggaactccgctaaggaggccgtggaagatgagagattttgggaccttgtccggcgcgagagagaactgcataaacagggcaagtgcgctacgtgcgtgtacaatatgatggggaagcgggagaaaaagctcggagaattcggcaaagccaaggggtctcgcgccatctggtatatgtggctgggcgcgagatttctggagttcgaagctctcggattcatgaacgaggatcactggtttagccgggagaattccctgtctggcgtcgaaggggagggacttcacaaactgggctacattctccgcgacatcagcaagatccccgggggaaacatgtacgccgatgacaccgccggctgggatacaagaattaccgaagaggacctgcaaaatgaggctaaaatcacagatattatggaacctgagcatgcccttctggctacctccatcttcaagctcacgtatcagaacaaggtggttcgggtgcagcgccccgccaaaaacgggacagtcatggacgtgatttctagacgggatcagcgcggcagcggacaagtgggcacctacgggctgaatacatttaccaacatggaagcgcagctgatcagacagatggagtccgaaggaatcttcagcccttctgagctcgagacgcccaatctggccggccgggttcttgactggctggaaaagcacgggattgagagactccgccggatggctatctccggagacgattgtgtggtcaaaccgattgacgatagatttgccaccgctctgacagcccttaacgacatgggcaaggtgcgcaaagatatccctcagtgggaacccagcaaggggtggaatgactggcaacaggttcctttctgctctcatcactttcaccagctgattatgaaggatggccgggagatcgtggtcccctgtagaaaccaggacgaactcgtgggacgcgcgcgggtctcccaaggcgccgggtggagcctgagagagaccgcttgcctgggaaaatcctatgcccagatgtggcagctcatgtacttccatcgccgggatctgagacttgctgccaatgctatttgttctgccgtgcctgttgactgggtgcccacaagccgcaccacatggtccatccacgcgcatcaccaatggatgaccacggaggatatgctgagcgtctggaaccgggtgtggatcgaagagaatccgtggatggaagacaagacacatgtttcttcctgggaggacgtgccttatctcggcaaaagagaagatcagtggtgcgggagcctgattggacttaccgcccgggctacctgggccacaaacatccaggtcgccattaatcaggtgagacgcctgatcggcaacgagaattacctcgactatatgacctctatgaagcggtttaaaaacgagagcgatcccgaaggggctctgtggtga

SEQ ID NO: 19450 - RNA, 9879 nt, synthetic construct
  misc_feature 1..9879: note = derived and/or modified CDS sequence (opt5) from DENV-1__JQ915076__SS-prME
  source 1..9879: mol_type = other RNA
agcgtgaccatgctgctcatgctgcttcccaccgtgctgacgttccacctcaccacaagaggcggggagcctcatatgatcgtttccaagcaggaacggggaaagtctctgctttttaagaccagcgccggcgtgaacatgtgcacactgattgctatggacctcggggagctgtgtgatgacaccatgacatacaaatgcccccgcatcaccgaaacggagcccgatgacgtggattgttggtgcaatgccaccgaaacatgggtcacctatggaacatgttcccagaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaggaacaagacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcacaccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacaaccggggcctccaccagccaagagacatggaaccgccaggacctcctggtcacgttcaaaaccgctcacgccaagaagcaggaagtggttgtgctgggatcccaagagggcgccatgcacacagctctcaccggggcgacagaaatccagacctctggaacgacaaccatttttgccggccatctgaaatgcagacttaagatggataaactgaccctcaaggggatgagctatgtcatgtgtacaggctccttcaaactggagaaggaagtggctgagacccagcacggaacagttctggtgcaggtcaagtacgagggcacggacgccccgtgcaaaatccctttcagctctcaagatgaaaagggggtgacccagaatggacggcttgtgacagccaaccccatcgttaccgacaaagagaagcctgtcaatattgaagctgagccgccctttggcgagtcctatatcgtggtgggggccggagaaaaagcgctcaagctgagctggttcaagaaaggctctagcattgggaagatgtttgaggctacagccagaggcgcccgccggatggctatcctgggagataccgcctgggacttcggctccattgggggagtctttacgtctgtgggcaaactcgttcatcagatcttcgggaccgcttacggagtgctgtttagcggcgtctcctggacaatgaagatcgggattggcatccttctgacctggctcggactgaacagcagatctacatccctgagcatgacctgtattgccgtgggcatggttacactttacctcggggtgatggtccaggcggattctggatgcgtgatcaattggaaaggccgcgaactgaagtgtgggtccggaattttcgttaccaacgaggtgcacacgtggacagaacaatataagtttcaggccgacagccctaaacggctgtccgctgccatcggcaaggcttgggaggagggggtctgcggcattagatctgccacccgcctcgaaaacatcatgtggaaacagatcagcaatgagctgaaccatattcttctggaaaatgacatgaagttcaccgtggtggtcggagatgtttccggcatcctcgcgcaggggaaaaagacaattcggccgcaacccatggagcacaaatactcttggaaaagctggggaaaggccaagatcattggcgctgacgtgcagaacaccacgtttatcatcgatgggcctaatacacccgaatgtcctgacgatcagagagcctggaacatttgggaggtggaggactatggattcggcatctttaccacaaatatttggctgaagctgcgcgattcctacacccaggtctgcgaccaccggcttatgagcgctgccatcaaagattctaaggccgtgcatgctgacatgggctattggattgaatccgagaaaaacgaaacatggaagctcgcgagagccagcttcatcgaggttaagacctgtgtgtggcccaaatctcacacgctgtggtccaatggggtcctggaaagcgagatgatcattccgaagatctacggaggccctatttctcaacataactatcgccccgggtacttcacccagacagctggaccttggcacctcggcaaactggagcttgattttgacctgtgcgaagggaccacagtggttgtggatgagcactgcggacatcggggccccagcctcagaaccacgacagtcaccggcaagatcattcacgaatggtgttgccggtcctgtacactgcctcccctgcgcttcaaaggggaggacggatgctggtacggcatggagatcagaccggtgaaggaaaaggaggaaaatcttgttaaaagcatggtgtctgccgggtccggagaggtcgacagcttttccctcggcctgctgtgtatctctattatgatcgaagaggtgatgcggagcagatggtcccgcaagatgctcatgaccgggaccctggtggtcttccttctgctcacactgggacagctgacgtggaacgatcttattcggctgtgcatcatggttggcgccaatgcttctgacaacatgggcatggggaccacatatctcgccctgatggcgacctttagaatgcgccctatgttcgctgtgggactcctgtttagacggcttacaagccgcgaggtgctgctcctgaccgtcggcctgtcccttgtggcctctgttgaactgcccaatagcctcgatgagctgggggacggactcgccatgggcattatgatcctgaaacttctgacggatttccaatcccatcagctctgggctacactgctgagccttacctttgtgaagaccacactgtctctccactacgcctggaaaaccatggcgatgattctgtccatcgtcagcctcctgcccctttgtctgtctacaacgtcccagaagaccacatggctgcctgtgctcctggggagccttggatgcaagccgctgaccatgttcctcatcacagaaaacaaaatttggggcagaaagtcttggcccctgaacgagggcatcatggctgttgggattgtgtccatcctcctgagctcccttctgaaaaatgacgtccctctggccggacccctcattgccggcgggatgctgatcgcttgttatgtgatcagcggatctagcgccgatctttccctggaaaaggctgccaaagtctcttgggaggaggaagcggagcatagcggcgcctcccacaacattctcgtggaaatccaggacgatgggaccatgaagattaaagacgaggaacgggatgacacgatcaccattctgctcaaggctacactgcttgccatctctggagtttaccctatgagcatccccgctaccctgtttgtgtggcacttctggcaaaagaaaaagcagcgctccggcgtcctgtgggatacaccttctcccccggaggtggagaaagccgttctcgacgacggcatttatagaatcctgcagcgggggcttctgggacgcagccaggtgggcgtcggggtgtttcaagaaggagtgttccataccatgtggcacgttacaagaggcgccgtcctcatgtaccaggggaagcggctggagccttcctgggctagcgtgaaaaaggatctcatttcttatggaggcggctggcgcttccaggggtcctggaatacgggagaagaggtgcaggtcatcgcggtggagcccggcaagaaccctaaaaatgttcaaaccgcccccgggacatttaagaccagcgaaggagaggtgggcgctattgccctggacttcaaaccggggacctctggatcccctatcgtcaacagagaaggcaagattgtgggcctttacgggaatggagttgtgacaacgagcggcacctacgtctccgccatcgctcaggccaaaacatctcaggaggggcccctgcctgaaatcgaggatgaggtgtttcggaagagaaacctgaccattatggacctccatcccggaagcggcaagacacgccggtatctgcccgcgatcgttagagaagctattaaacgcaaacttcggaccctggtgctcgcccctacgagagtcgtggcctccgagatggctgaagccctgaaagggatgccgatccgctaccaaacaaccgcggtcaagagcgagcacaccggcaaagaaattgtcgatctgatgtgccatgctacattcaccatgcggctcctttctcccgttagagtgcctaattataacatgatcatcatggacgaggcccactttacagatcccgcctccattgctgcccgcggatacatcagcacccgggtgggcatgggggaggctgccgcgattttcatgacggccacacctcccggatctgtcgaggcttttcctcagagcaatgccgtgatccaggacgaggaaaaggatattccggagagatcctggaactctggctatgactggatcaccgatttccccgggaagacagtttggtttgtgcctagcatcaaatccggaaatgacattgctaactgtctgcggaagaatggcaaacgcgtcatccagctgtctagaaagaccttcgacacggaataccagaagaccaagaacaacgattgggactatgtggttacaaccgatattagcgagatgggggccaattttcgggccgaccgcgtgatcgatcccagacggtgcctcaagcctgtcattctgaaagacggccccgagagagtgatccttgctggaccgatgcctgtcacagtggcgtccgccgctcagcgccggggcagaattgggcgcaaccagaataaggaaggagatcagtacgtttacatgggccaacccctgaacaatgacgaggatcacgcccattggaccgaagccaaaatgctcctggacaacatcaatacacccgaggggatcattcctgctctgttcgagcccgaacgggaaaagagcgccgcgatcgatggagaatatagactccgcggcgaggctcggaaaaccttcgtggaacttatgagacgcggggacctgcctgtgtggctgtcttacaaggtcgcctccgagggctttcagtatagcgatagacggtggtgcttcgacggagagcgcaacaatcaggttctcgaagagaacatggacgtggaaatttggacgaaagagggcgaaagaaagaagctgcggccgcgctggcttgatgccagaacatactccgaccccctggctctccgggagtttaaagagttcgccgcggggagacgctctgtgagcggagatctgatcctggaaattggcaagctccctcagcaccttacccaacgggcccagaatgctctggacaacctggtcatgctccataattccgagcaagggggaaaagcctatagacacgctatggaggaactgcccgataccatcgaaacaatcatgcttctggccctcattgctgtgctgaccggcggcgttacactgtttttcctctctgggcgcggacttggcaagacgagcatcgggctgctgtgtgtgacctccagctctgccctcctgtggatggcgtccgtcgagcctcactggattgccgctagcatcattcttgagtttttcctgatggtgctcctgatccccgaaccggaccggcagagaacacctcaagataaccagctggcctacgtcgtgatcggactcctttttatgattctgaccgttgctgccaatgagatgggcctgctcgaaacaaccaaaaaggacctggggatcggacatacggccgctgagaaccaccatcacgcggccatgcttgatgtggacctgcatcccgcttctgcctggaccctctatgccgtcgctacaaccattatcacacctatgatgcggcacaccattgagaacacgacagccaatatctccctgaccgcgattgccaaccaggctgccatcctgatgggcctcgataagggctggcccatcagcaaaatggacattggggtgcctcttctggctctgggatgctactctcaagttaatcccctcacactgaccgccgcggtgcttatgctggtcgcccactacgctatcattggcccggggctccaggccaaggctacccgcgaagcccagaaaagaacagctgccggaatcatgaagaaccctacggtggatggcattgtggcgatcgacctggaccccgttgtctatgatgccaaattcgagaagcagctggggcaaatcatgctccttattctgtgtaccagccagatcctgctcatgcggacaacctgggctctgtgcgaatccattacacttgccaccggacccctgacgacactctgggagggctctcctggcaagttttggaataccaccatcgctgtgagcatggccaacattttccgcgggtcctacctggccggagcgggcctggcttttagcctcatgaaatcccttgggggaggcagacgggggacaggagcccagggcgaaaccctgggcgagaagtggaaacgccagctgaatcaactctctaagagcgagttcaacatctataaaagatccgggatcattgaagtggaccggtctgaggctaaggaaggactgaagcgcggcgagacaacgaaacatgccgtcagcagagggaccgccaaacttcggtggttcgttgaaagaaatctggtgaaaccggagggaaaggtgatcgatctcggctgtgggcgcggaggctggtcctactattgcgctggcctgaaaaaggtcacagaggtgaaagggtacaccaagggaggccccgggcacgaggagcctattcccatggccacatatggatggaacctggttaagctccattctggcaaagacgtgtttttcatccctcccgaaaagtgtgatacccttctgtgcgacattggggagagctcccctaatccgacgatcgaagagggacggaccctgagagtcctcaaaatggtggagccctggctgcgcggcaaccagttttgtattaagatccttaatccttacatgcccagcgttgtggaaacactggagcagatgcagcggaaacacggcgggatgctcgtcagaaaccctctgtctcgcaattccacccacgaaatgtactgggtgagctgcggaacaggcaacatcgtgtctgcggtcaatatgacctcccggatgctgctcaacagattcacaatggcccatcgcaagcccacctatgagcgggatgttgacctgggggctggaacgagacacgtggccgtggagccggaagtcgctaaccttgatattatcggccaacgcattgagaatatcaagaacgaacataaaagcacatggcactacgacgaggataatccttataagacctgggcctaccatgggtcttatgaagtgaaaccctccggaagcgcgtccagcatggttaacggcgtggtccggctgctcaccaagccctgggacgtgattcctatggttacacagatcgccatgacggacaccacaccctttggccagcaaagagtgttcaaagagaaggtcgatacccgcacacctaaggctaaaagagggaccgcccagatcatggaggtgacagctaagtggctgtggggatttctttctcggaataaaaagccgcgcatttgtaccagagaagagttcacgcggaaagttagaagcaacgccgctatcggcgccgtgtttgtcgacgaaaatcagtggaactccgcgaaggaggccgtggaagatgagcggttctgggacctggtccgcagagagcgggaactccacaagcaggggaaatgcgctacctgcgtgtacaatatgatgggaaagcgcgagaaaaagctgggcgaatttgggaaagccaagggctctagagctatttggtatatgtggctgggagcccggttcctcgagtttgaagccctgggcttcatgaacgaggatcactggttcagccgcgaaaattccctttctggggttgaaggagagggcctgcataaactcgggtacatcctgagagacattagcaagatccccggaggcaacatgtacgcggatgacacagctgggtgggatacccggatcacagaagaggaccttcaaaatgaggccaagattaccgatatcatggaacctgagcacgccctgctcgctacgtccatttttaaactgacatatcagaacaaggtggtccgcgtgcagagacccgccaaaaatggcaccgtgatggacgttatctctcggcgcgatcagagaggaagcggccaagtggggacatacggactgaacaccttcacgaacatggaagctcagctcattcggcagatggagtccgaaggcatctttagcccttctgagctggagacccccaatcttgccgggcgcgtcctggactggctcgaaaagcatggaatcgagagactgcggagaatggcgatttccggcgacgattgtgtggttaaaccgatcgacgatcgcttcgccacagctcttaccgccctgaacgacatggggaaggtgcggaaggatattcctcagtgggaacccagcaaaggctggaatgactggcaacaggtccctttttgctctcaccacttccatcagctcatcatgaaggatggaagagagattgtggtcccctgtcgcaaccaggacgaactggtgggccgggctagagtttcccaaggggccggatggagcctgcgcgagacagcgtgcctcggcaaatcctatgcccagatgtggcagctgatgtactttcaccggagagatcttcgcctggctgccaatgctatctgttctgccgtgcctgtcgactgggtgcccaccagccggacaacctggtccattcatgctcaccatcaatggatgacgacagaggatatgctcagcgtttggaacagagtgtggatcgaagagaatccgtggatggaagacaagacccacgtctcttcctgggaggacgtgccttatctggggaaacgcgaagatcagtggtgcggaagccttatcggcctgaccgcccgggcgacatgggccaccaacattcaggtggctatcaatcaggttagacggctcattgggaacgagaattacctggactatatgacatctatgaagagattcaagaacgagagcgatcccgaaggcgccctgtggtga

SEQ ID NO: 19451 - RNA, 9879 nt, synthetic construct
  misc_feature 1..9879: note = derived and/or modified CDS sequence (opt5) from DENV-1__KF289072__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaagtctctgctttttaagacaagcgccggcgttaacatgtgcaccctgattgcgatggacctcggggagctgtgtgaagatacaatgacctacaagtgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaggaacaagatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttaagggggaggatggatgctggtacggcatggagatccggccggtgaaagaaaaggaggaaaacctcgttagatccatggtgagcgccgggtctggagaggtcgactccttcagcctgggcctgctctgtgtgtccattatgatcgaagaggttatgcgctctcggtggagcagaaagatgctgatgacagggacccttgcggtgtttttcctgctcattatgggacagctgacctggaatgacctgatccgcctttgcattatggtcggcgctaacgtgtccgatagaatgggcatggggacaacgtatctggccctcatggccacctttaaaatgcggcctatgttcgctgtgggactgctctttcgcagactgacatctcgggaggtccttctgctcaccatcggcctgagcctggttgcctccgtggaacttcccaactctctggaggaactcggggacggactggcgatgggcattatgatgctcaagctgcttacagatttccaaagccaccagctgtggaccacgctcctgtccctgacatttatcaaaaccacccttagcctggactacgcttggaagacaatggccatggtgctctctatcgtctccctgttccccctctgtctgagcaccacatctcagaaaacgacctggcttcctgtgctgctggggtcctttggatgcaagccgctcacaatgttcctgattaccgagaataagatctggggccgcaaaagctggccccttaacgaaggcattatggccgttgggatcgtgtctattctgctctccagcctgctcaagaatgatgtccctctggctggaccccttatcgccggcgggatgctgatcgcttgttatgtgatttccggaagctctgccgacctgagcctcgagagagcggccgaggtttcctgggaagaggaagctgagcattctggcgccagccacaacatcctggtggaagtccaggatgacgggacaatgaaaattaaggatgaggagcgggacgatacccttacgatcctgctcaaagctaccctgctcgccgtgtccggagtctaccctatgtctattcccgccacactgtttgtgtggtatttctggcaaaagaaaaagcagcgcagcggcgttctttgggacacccctagccctcccgaagtggagagagctgtcctggatgacggcatctaccggatcctgcagcgcgggctcctgggaagatctcaggtgggcgttggggtgttccaagacggagtctttcatacaatgtggcacgtgacccggggcgcggtgcttatgtatcaggggaagagactggaacccagctgggcctccgttaaaaaggatctcattagctacggaggcggctggcgcttccaggggtcttggaatacaggagaggaggtccaggtgatcgctgtggaacccggcaaaaaccctaagaatgtccaaacgacccccgggacatttaaaaccccggagggagccgtgggcgccattgctctggacttcaagcctgggacctccggaagccccatcgttaaccgggaaggcaagattgtgggcctctacgggaatggagtcgtgacaacgtctggcacctatgtttccgccatcgcgcaggctaaagccagccaggaggggcctctgcccgaaattgaggatgaggtgtttaagaaaagaaaccttacaatcatggacctgcaccccggatccggcaagacccgccggtacctgcctgccatcgtcagagaagctattaaacgcaagctccggacactgatccttgccccgaccagagtggttgcgtctgagatggctgaagccctgaaggggatgcccattcgctatcaaacgacagccgtgaaaagcgagcataccggcaaggaaatcgtcgatctcatgtgccacgctaccttcacaatgcggctgctgtcccctgtgagagtgcccaattacaacatgattatcatggacgaggcccattttaccgatcctgctagcatcgccgcgcggggatatatttctacacgcgtcggcatgggggaggccgctgccatcttcatgaccgctacgccccctggatccgttgaagcctttccgcagagcaatgccgtgattcaggacgaggaaagagatatccccgagcggtcttggaacagcggctacgactggattacagatttccctgggaaaaccgtgtggtttgtcccctccatcaagtctggaaatgacatcgctaactgtctccgcaaaaacggcaagagagtgattcagcttagccggaagacattcgacaccgaatatcagaagacgaagaataacgattgggactacgttgtgaccacagatatctccgagatgggggcgaatttcagagccgaccgcgtcattgatcctcggagatgcctgaaacccgtgatcctgaaggacggcccggagcgcgttattctcgctggacctatgcccgtgaccgccgcctctgctgcccagcggagaggccgcatcgggcggaaccagaataaagaaggagatcagtacatttatatgggccaacccctgaacaatgacgaggatcacgcgcattggacagaagctaagatgcttctggacaacatcaatacccctgaggggatcattcccgccctctttgagcctgaaagagaaaagtccgccgctatcgatggagaataccgcctgagaggcgaggcccggaaaacattcgtcgaactgatgcgcagaggggacctcccggtgtggctttcctataaggtcgcgagcgagggctttcagtactctgatcggcgctggtgcttcgacggagagagaaacaatcaggtgctggaagagaacatggacgttgaaatttggaccaaagagggcgaacggaagaaactgagaccccgctggctcgatgcccggacgtattccgaccctctggctcttagagagtttaaggagttcgccgctgggcgccggagcgtgtccggagatctgatcctcgaaattggcaaactgccccagcacctgacactcagagcccaaaatgctcttgacaacctggtgatgctgcacaattctgagcaagggggaaaggcctaccggcatgcgatggaggagctccctgataccatcgaaaccctgatgcttctggccctcatcgctgtcctgacaggcggcgttaccctgtttttcctcagcgggaagggacttggcaaaacatccattgggctgctgtgtgtgatggcctctagcgtgctcctgtggatggcttccgtcgagccccactggatcgccgccagcattatccttgagtttttcctgatggtgctcctgattccggaacctgaccgccagagaacgccccaggataaccaactggcttatgttgtgatcggactcctttttatgatcctgaccgtcgcggccaacgagatgggcctgctcgaaacaaccaagaaagacctggggattggacatgtggtcgctgagaatcaccaccatgccacaatgcttgatatcgacctgcaccctgcctctgcttggaccctctacgccgtggcgacgaccattatcacacccatgatgcggcataccattgagaacacaaccgccaatatctccctgacggctattgccaaccaggctgccatcctgatgggcctcgataagggctggcctatcagcaaaatggacattggggttccccttctggcgctgggatgctactctcaggtgaatccgctcacactgaccgccgctgtccttatgctggtggcccactatgctatcattggccctgggctccaagccaaggctacacgcgaagcccagaagagaaccgcggccggaatcatgaaaaaccccaccgttgatggcattgtggctatcgacctggaccccgtcgtgtacgatgccaagttcgagaaacagctggggcagatcatgctccttattctgtgtacatcccaaatcctgctcatgcggacgacctgggctctgtgcgaaagcattacacttgccaccggacctctgacaaccctctgggagggctctccgggccgcttttggaatacgacaatcgccgtgagcatggcgaacattttcagagggtcctatctggctggagccggcctggctttctctctcatgaaaagccttgggggaggccggcgcgggaccggagcccagggcgaaaccctgggcgagaaatggaagagacagctgaatcagctctccaagagcgagtttaacacatacaaacggtccgggatcatggaagttgacagatctgaggccaaggaaggactgaaacgcggcgagaccacaaagcatgctgtcagccgggggacggccaaacttagatggttcgtggaacgcaatctggtgaagcccgagggaaaggtcatcgatctcggctgtgggcggggaggctggtcctattactgcgcgggcctgaaaaaggttaccgaggtgaaagggtatacaaagggaggccctgggcacgaggagcccattcctatggccacctacggatggaacatcgtgaaactgcactctggcagagacgtctttttcacaccccctgaaaagtgtgataccctcctttgcgacattggggagagctccccgaatcccacgatcgaagagggacgcaccctgcgggtgctgaaaatggttgagccttggctcagaggcaaccaattttgtattaagatcctgaatccctacatgccttctgtggtcgaaacacttgagcagatgcagcgcaagcatggcgggatgctggtgcggaaccccctcagcagaaattccacccacgaaatgtattgggttagctgcggaacaggcaacattgtgtctgctgtcaacatgacctcccgcatgctgctgaatcggttcacaatgacccatagaaaaccgacgtacgagcgcgatgtggacctcggggccggaacaagacacgtggctgtcgagcctgaaatcgccaacctggatatcattggccagcggatcgagaatattaagaacgaacacaaaagcacctggcattatgacgaggataatccctacaagacctgggcgtatcacgggtcttacgaagttaaaccctccggaagcgcctcttccatggtgaacggcgtggtccgccttctgacaaagccttgggacgtgatccccatggttacgcaaattgctatgaccgacacaaccccttttggccagcagagagtgttcaaggagaaagtcgatacacggaccccgagacccaagcgggggacagcccaaatcatggaggtgaccgctaaatggctctggggatttctgagccgcaataagaaacctagaatctgtacgcgggaagagttcacccgcaaggttagatccaacgccgctattggcgccgtgtttgtcgacgaaaatcagtggaacagcgcgaaggaggccgtggaagatgagcggttctgggaccttgttcatcgcgagagagaactgcacaaacaggggaagtgcgctacatgcgtgtataatatgatgggaaaacgggagaagaaactcggcgaatttgggaaggccaagggctctcgcgctatctggtacatgtggctgggagccagattcctggagttcgaagccctcggctttatgaacgaggatcattggttcagccgggaaaattccctgtctggggtcgaaggagagggccttcacaaactggggtacattctccgcgacatcagcaagattcccggaggcaacatgtatgcggatgacaccgctgggtgggatacaagaatcaccgaagacgatctgcagaatgaggccaaaatcacggacattatggagcctgaacacgcccttctggctacatccatctttaagctcacctaccaaaacaaagtggtccgggtgcagcgccccgccaagtctggcacagttatggatgtgattagcagacgggaccagagaggatccggccaggtcgggacctatggactgaacacgttcaccaatatggaggtgcaactgatccgccagatggaatctgagggcatttttagcccgtccgaactcgagaacagcaatctggctgagcgggtgcttgactggctggaaaaacatggggttgagagactcaagcgcatggccatctctggagatgactgtgtggtcaagcctacagatgaccggttcgcgaccgccctgacagctcttaacgatatgggcaaagtgagaaaggacatcccccagtgggaaccttccaaagggtggaatgattggcagcaagttcccttttgcagccaccatttccaccagctgattatgaaggacggccgcgagatcgtggtcccttgtcggaaccaggatgaactcgtgggcagagctcgcgtctctcagggagctgggtggtccctgcgggagaccgcctgcctgggaaaaagctacgcgcaaatgtggcagctcatgtattttcacagacgcgacctgcggcttgccgctaatgccatttgttccgctgtgcccgttgattgggtgccgacatctagaaccacgtggagcatccatgcccaccatcagtggatgacaaccgaggacatgctgtccgtctggaaccgggtgtggattgaagagaatccttggatggaagacaagacccacgttagctcttgggaggatgtgccctacctcggcaagagagaagaccaatggtgcgggtccctgatcggacttacagctcgcgccacctgggcgacaaacattcaggtcgccatcaatcaggtgcggagactgatcggcaacgagaattatctcgattacatgacgagcatgaaacgcttcaagaacgagtctgacagcgaaggggctctgtggtga

SEQ ID NO: 19452 - RNA, 9879 nt, synthetic construct
  misc_feature 1..9879: note = derived and/or modified CDS sequence (opt5) from DENV-1__JQ692085__SS-prME
  source 1..9879: mol_type = other RNA
agcgtgaccatgctgctcatgctgcttcccacagctctggctttccacctcacgacccggggcggggagcctcatatgatcgtctccaagcaggaacggggaaagtctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaggagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaggatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaagcgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagccgtgggcgccattgctctggacttcaaacctgggacctccggaagccccatcgttaacagagaaggcaagattgtgggcctctacgggaatggagtcgtgacaacgtctggcacctatgtttccgccatcgcgcaggctaaggccagccaggaggggcctctgcccgaaattgaggatgaggtgtttaaaaagcgcaaccttacaatcatggacctgcaccccggatccggcaaaacccggagatacctgcctgccatcgtccgcgaagctattaagcggaaactcagaacactgatccttgccccgacccgcgtggttgcgtctgagatggctgaagccctgaaggggatgcccattcggtatcaaacgacagccgtgaagtccgagcataccggcaaagaaatcgtcgatctcatgtgccacgctaccttcacaatgagactgctgtcccctgtgcgggtgcccaattacaacatgattatcatggacgaggcccattttaccgatcctgctagcatcgccgcgcgcggatatatttctacaagagtcggcatgggggaggccgctgccatcttcatgaccgctacgccccctggatccgttgaagcctttccgcagagcaatgccgtgattcaggacgaggaacgggatatccccgagcgctcttggaacagcggctacgactggattacagatttccctgggaagaccgtgtggtttgtcccctccatcaaatctggaaatgacatcgctaactgtctcagaaagaacggcaaacgggtgattcagcttagcagaaagacattcgacaccgaatatcaaaagacgaaaaataacgattgggactacgttgtgaccacagatatctccgagatgggggcgaatttccgcgccgaccgggtcattgatcctagacgctgcctgaagcccgtgatcctgaaagacggcccggagcgggttattctcgctggacctatgcccgtgaccgccgcctctgctgcccagagacgcggccggatcgggagaaaccagaataaggaaggagatcagtacatttatatgggccaacccctgaacaatgacgaggatcacgcgcattggacagaagctaaaatgcttctggacaacatcaatacccctgaggggatcattcccgccctctttgagcctgaacgcgaaaagagcgccgctatcgatggagaatacagactgcggggcgaggcccgcaagacattcgtcgaactgatgagaagaggggacctcccggtgtggctttcctataaagtcgcgagcgagggctttcagtactctgatcgcagatggtgcttcgacggagagcggaacaatcaggtgctggaagagaacatggacgttgaaatttggaccaaggagggcgaacgcaagaagctgcgcccccggtggctcgatgccagaacgtattccgaccctctggcccttcgcgagtttaaagagttcgccgctgggcggagaagcgtgtccggagatctgatcctcgaaattggcaagctgccccagcacctgacactccgggcccaaaatgctcttgacaacctggtgatgctgcacaattctgagcaagggggaaaagcctaccgccatgcgatggaggagctccctgataccatcgaaaccctgatgcttctggccctcatcgctgtcctgacaggcggcgttaccctgtttttcctcagcgggaagggacttggcaagacatccattgggctgctgtgtgtgatggcctctagcgtgctcctgtggatggcttccgtcgagccccactggatcgccgccagcattatccttgagtttttcctgatggtgctcctgattccggaacctgacagacagcggacgccccaggataaccaactggcttatgttgtgatcggactcctttttatgatcctgaccgtcgcggccaacgagatgggcctgctcgaaacaaccaaaaaggacctggggattggacatgtggtcgctgagaatcaccaccatgccacaatgcttgatatcgacctgcaccctgcctctgcttggaccctctacgccgtggcgacgaccattatcacacccatgatgcgccataccattgagaacacaaccgccaatatctccctgacggctattgccaaccaggctgccatcctgatgggcctcgataaaggctggcctatcagcaagatggacattggggttccccttctggcgctgggatgctactctcaggtgaatccgctcacactgaccgccgctgtccttatgctggtggcccactatgctatcattggccctgggctccaagccaaagctacaagagaagcccagaagcggaccgcggccggaatcatgaagaaccccaccgttgatggcattgtggctatcgacctggaccccgtcgtgtacgatgccaaattcgagaagcagctggggcagatcatgctccttattctgtgtacatcccaaatcctgctcatgcgcacgacctgggctctgtgcgaaagcattacacttgccaccggacctctgacaaccctctgggagggctctccgggcagattttggaatacgacaatcgccgtgagcatggcgaacattttccgggggtcctatctggctggagccggcctggctttctctctcatgaaaagccttgggggaggccgcagagggaccggagcccagggcgaaaccctgggcgagaagtggaaacggcagctgaatcagctctccaagagcgagtttaacacatacaagagatccgggatcatggaagttgaccgctctgaggccaaagaaggactgaagcggggcgagaccacaaaacatgctgtcagcagagggacggccaaacttcgctggttcgtggaacggaatctggtgaaacccgagggaaaggtcatcgatctcggctgtgggagaggaggctggtcctattactgcgcgggcctgaagaaagttaccgaggtgaaggggtatacaaaaggaggccctgggcacgaggagcccattcctatggccacctacggatggaacatcgtgaagctgcactctggccgcgacgtctttttcacaccccctgaaaaatgtgataccctcctttgcgacattggggagagctccccgaatcccacgatcgaagagggacggaccctgagagtgctgaagatggttgagccttggctccgcggcaaccaattttgtattaaaatcctgaatccctacatgccttctgtggtcgaaacacttgagcagatgcagcggaagcatggcgggatgctggtgagaaaccccctcagccgcaattccacccacgaaatgtattgggttagctgcggaacaggcaacattgtgtctgctgtcaacatgacctcccggatgctgctgaatagattcacaatgacccatcgcaagccgacgtacgagagagatgtggacctcggggccggaacacggcacgtggctgtcgagcctgaaatcgccaacctggatatcattggccagcgcatcgagaatattaaaaacgaacacaagagcacctggcattatgacgaggataatccctacaaaacctgggcgtatcacgggtcttacgaagttaagccctccggaagcgcctcttccatggtgaacggcgtggtcagacttctgacaaaaccttgggacgtgatccccatggttacgcaaattgctatgaccgacacaaccccttttggccagcagcgggtgttcaaggagaaggtcgatacaagaaccccgcggcccaaacgcgggacagcccaaatcatggaggtgaccgctaagtggctctggggatttctgagcagaaataaaaagcctcggatctgtacgcgcgaagagttcaccagaaaagttcggtccaacgccgctgtgggcgccgtctttgtggacgaaaatcagtggaacagcgcgaaggaggccgttgaagatgagcgcttctgggaccttgtgcatagagagcgggaactgcacaagcaggggaaatgcgctacatgcgtctataatatgatgggaaagcgcgagaaaaagctcggcgaatttgggaaagccaagggctctagagctatttggtacatgtggctgggagcccggttcctggagttcgaagccctcggctttatgaacgaggatcattggttcagccgcgaaaattccctgtctggggtggaaggagagggccttcacaagctggggtacatcctcagagacattagcaaaatccccggaggcaacatgtatgcggatgacaccgctgggtgggatacacggattaccgaagacgatctgcagaatgaggccaagatcacggacatcatggagcctgaacacgcccttctggctacatccatttttaaactcacctaccaaaacaaggtcgtgcgcgttcagagacccgccaaatctggcacagtgatggatgtcatcagccggagagaccagcgcggatccggccaggtggggacctatggactgaacacgttcaccaatatggaggtgcaactgattcggcagatggaatctgagggcatctttagcccgaacgaactcgaaaattccaacctggctgagagagttcttgactggctggaaaagcatggggtggagcgcctcaaacggatggccattagcggagatgactgtgtcgtgaagcctacagatgacagattcgcgaccgccctgacagctcttaatgatatgggcaaggttcgcaaagacatcccccagtgggaaccttctaaggggtggaacgattggcagcaagtgcccttttgctcccaccatttccaccagctgatcatgaaagacggccgggagattgtcgtgccttgtagaaatcaggatgaactcgtcggacgcgcccgggtgagccagggcgctgggtggtctctgagagagaccgcctgcctgggaaagtcctacgcgcaaatgtggcagctcatgtattttcaccgccgggacctgagacttgccgctaacgccatctgtagcgctgttcccgtggattgggtcccgacatcccggaccacgtggtctattcatgcccaccatcagtggatgacaaccgaggacatgctgagcgtgtggaatagagtttggatcgaagagaacccttggatggaagacaaaacccacgtgtccagctgggaggatgtcccctacctcggcaagcgcgaagaccaatggtgcgggtctctgattggacttacagctcgggccacctgggcgacaaatatccaggtggccattaaccaggtgagacgcctgatcggcaatgagaactatctcgattacatgacgtccatgaagagattcaaaaatgagagcgactctgaaggggctctgtggtga

SEQ ID NO: 19453 - RNA, 9879 nt, synthetic construct
  misc_feature 1..9879: note = derived and/or modified CDS sequence (opt5) from DENV-1__JQ917404__SS-prME
  source 1..9879: mol_type = other RNA
agcgtgaccatgctgctcatgctgcttcccacagctctggctttccacctcacgacccggggcggggagcctcatatgatcgtctccaagcaggaacggggaaagtctctgctttttaagacaagcgccggcgttaacatgtgcaccctgattgcgatggacctcggggagctgtgtgaagatacaatgacctacaagtgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacacggaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaagcgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccagagaaggcgagcgcaagaaactgcggcccagatggctcgatgcgcgcacgtattccgaccctctggcccttcgggagtttaaggagttcgctgccgggagacggagcgtgtccggagatctgatcctcgagattggcaaactgccccagcacctgacactccgcgctcaaaatgcccttgacaacctggtgatgctgcacaattctgaacaagggggaaaggcttacagacatgccatggaggaactccctgataccatcgagaccctgatgcttctggcgctcatcgccgtcctgacaggcggcgttaccctgtttttcctcagcgggaaaggacttggcaagacatccattgggctgctgtgtgtgatggcttctagcgtgctcctgtggatggcctccgtcgagccccactggatcgctgccagcattatccttgaatttttcctgatggtgctcctgattccggagcctgaccggcagcgcacgccccaggataaccaactggcctatgttgtgatcggactcctttttatgatcctgaccgtcgctgcgaacgaaatgggcctgctcgagacaaccaagaaagacctggggattggacatgtggtcgccgagaatcaccaccatgctacaatgcttgatatcgacctgcaccctgcctctgcctggaccctctacgctgtggccacgaccattatcacacccatgatgagacataccattgaaaacacaaccgcgaatatctccctgacggccattgctaaccaggccgctatcctgatgggcctcgataagggctggcctatcagcaaaatggacattggggttccccttctggccctgggatgctactctcaggtgaatccgctcacactgaccgcggccgtccttatgctggtggctcactatgccatcattggccctgggctccaagctaaggccacacgggaggctcagaaacgcaccgccgcgggaatcatgaagaaccccaccgttgatggcattgtggccatcgacctggaccccgtcgtgtacgatgctaagttcgaaaaacagctggggcagatcatgctccttattctgtgtacatcccaaatcctgctcatgagaacgacctgggccctgtgcgagagcattacacttgctaccggacctctgacaaccctctgggaaggctctccgggccggttttggaatacgacaatcgccgtgagcatggccaacattttccgcgggtcctatctggcgggagctggcctggccttctctctcatgaaaagccttgggggaggcagacgggggaccggagctcagggcgagaccctgggcgagaaatggaagagacagctgaatcagctctccaaaagcgaatttaacacatacaagcgctccgggatcatggaggttgaccggtctgaagccaaggagggactgaaaagaggcgaaaccacaaagcatgccgtcagccgcgggacggctaaacttcggtggttcgtggagagaaatctggtgaagcccgagggaaaagtcatcgatctcggctgtgggcgcggaggctggtcctattactgcgccggcctgaagaaggttaccgaagtgaaagggtatacaaagggaggccctgggcacgaggaacccattcctatggcgacctacggatggaacatcgtgaaactgcactctggccgggacgtctttttcacaccccctgagaagtgtgataccctcctttgcgacattggggaaagctccccgaatcccacgatcgaggagggaagaaccctgcgcgtgctgaaaatggttgaaccttggctccggggcaaccaattttgtattaagatcctgaatccctacatgccttctgtggtcgagacacttgaacagatgcagagaaaacatggcgggatgctggtgcgcaaccccctcagcagaaattccacccacgagatgtattgggttagctgcggaacaggcaacattgtgtctgccgtcaacatgacctccagaatgctgctgaatcgcttcacaatggctcatagaaagccgacctacgagcgggatgtggacctcggggccggaacgcgccacgtggctgtcgaacctgagatcgccaacctggatatcattggccagagaatcgaaaatattaagaacgagcacaaaagcacatggcattatgacgaagataatccctacaagacctgggcgtatcacgggtcttacgaggttaaaccctccggaagcgcctcttccatggtgaacggcgtggtccggcttctgaccaagccttgggacgtgatccccatggttacacaaattgctatgacggacaccacaccttttggccagcagagagtgttcaaagagaaggtcgatacccggacaccgcgccccaagagagggaccgcccaaatcatggaagtgacagctaaatggctctggggatttctgagccggaataagaaacctcgcatctgtaccagagaggagttcacgcggaaggttcgctccaacgccgctattggcgccgtgtttgtcgacgagaatcagtggaacagcgcgaaagaagccgtggaggatgagagattctgggaccttgttcatcgggaacgcgagctgcacaagcaggggaagtgcgctacctgcgtgtataatatgatgggaaaaagagaaaagaaactcggcgagtttgggaaggccaaaggctctcgggctatctggtacatgtggctgggagcccgcttcctggagttcgaggccctcggctttatgaacgaggatcattggttcagcagagaaaattccctgtctggggtcgagggagaaggccttcacaagctggggtacattctccgggacatcagcaagattcccggaggcaacatgtatgcggatgacacagctgggtgggatacccgcatcacagaggacgatctgcagaatgaggccaaaatcaccgacattatggaacctgagcacgcccttctggctacgtccatctttaagctcacataccaaaacaaagtggtcagagtgcagcggcccgccaagtctggcaccgttatggatgtgattagcagacgcgaccagcggggatccggccaggtcgggacatatggactgaacaccttcacgaatatggaagtgcaactgatcagacagatggagtctgaaggcatttttagcccgtccgagctcgagaacagcaatctggctgaacgcgtgcttgactggctggagaaacatggggttgaacggctcaagagaatggccatctctggagatgactgtgtggtcaaacctaccgatgaccgcttcgcgacagccctgaccgctcttaacgatatgggcaaggtgcggaaggacatcccccagtgggagccttccaaagggtggaatgattggcagcaagttcccttttgcagccaccatttccaccagctgattatgaaggacggcagagaaatcgtggtcccttgtcgcaaccaggatgagctcgtgggacgggccagagtctctcagggcgctgggtggtccctgcgcgagacagcctgcctgggaaaaagctacgcgcaaatgtggcagctcatgtattttcaccggagagacctgcggcttgccgctaatgccatttgttccgctgtgcccgttaactgggtgccgacctctagaacaacctggagcatccatgcccaccatcagtggatgacgacagaagatatgctgtccgtctggaatcgcgtgtggattgaggaaaacccttggatggaggacaagacccacgttagctcttgggaagacgtgccctacctcggcaaacgggaggatcaatggtgcgggtccctgatcggacttaccgctagagccacatgggcgaccaatattcaggtcgccatcaaccaggtgcgcagactgatcggcaatgagaactatctcgactacatgacaagcatgaagcggttcaagaatgaatctgatcccgagggggctctgtggtga

SEQ ID NO: 19454 - RNA, 9879 nt, synthetic construct
  misc_feature 1..9879: note = derived and/or modified CDS sequence (opt5) from DENV-1__GU370048__SS-prME
  source 1..9879: mol_type = other RNA
agcgtgaccatgctgctcatgctgatgcccacagctcttgctttccacctgacgaccagaggcggggaacctcatatgatcgtctccaagcaagaacgggggaaatctctcctgtttaagacaagcgccggcgttaacatgtgcacccttattgcgatggacctgggggagctctgtgaagatacactgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaagacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctgaacttcaatgaaatggtgcttctgacgatgaaggagaaatcctggctcgtccataagcagtggtttctggaccttcctctgccctggacaagcggggcttccaccacacaagagacctggaaccgccaggatctcctggtgaccttcaaaacagcgcacgccaagaagcaggaagtcgtggttctgggatctcaagagggcgctatgcacacggccctcaccggggccacagaaattcagaccagcggaacaaccacgatctttgctggccatctgaaatgcagacttaagatggacaaactgacactcaaggggatgtcctatgtgatgtgtaccggcagcttcaaactggagaaggaagtcgccgagacccagcacggaacagtgctggttcagattaagtacgagggcaccgatgcgccgtgcaaaatccctttctctacacaagacgaaaagggggtgacgcagaatggacggcttatcaccgctaaccccattgtcacagataaagagaagcctgtgaatatcgaagccgagccgccctttggcgagtcctatattgtgatcggggccggagaaaaagctctcaagctgagctggttcaagaaaggctctagcattgggaagatgtttgaggccaccgctagaggcgcccgccggatggcgatcctgggagacacagcctgggatttcggctccatcgggggagtttttacctctgtcggcaaactcgtgcatcagattttcgggacggcttacggagtgctgtttagcggcgtctcctggaccatgaagatcgggattggcgtgcttctgacatggctcggactgaacagcagatctacctccctgagcatgacatgtatcgccgttggccttgtgaccctctacctgggggtcatggtgcaggctgactctggatgcgttattaattggaaaggccgcgaactgaagtgtgggtccggaatcttcgtgacaaacgaggtccacacctggacggaacaatataagtttcaggccgatagccctcggagactctccgcggccattggcaaggcttgggaggagggggtgtgcggcatccgctctgccacacggctggaaaacatcatgtggaagcagattagcaatgagcttaaccatatcctgctcgaaaatgacatgaaattcaccgttgtggtcggagacgtggctggcattctggcccaggggaagaaaatgatcagaccgcaacccatggagcacaagtactcctggaaatcttggggaaaggccaagattatcggcgctgatgtgcagaacaccacatttatcattgacgggcctaatacccccgaatgtcctgatgaccagcgcgcgtggaacatctgggaggtcgaggattatggattcggcatttttacgacaaatatctggctgaaacttcgggacagctacacccaggtttgcgatcacagactcatgtccgccgctattaaggacagcaaagccgtgcatgccgatatgggctattggatcgaatctgagaagaacgaaacatggaaactggctcgcgcctccttcatcgaggtgaagacctgtatttggcccaagagccacacactgtggtctaatggggtcctcgaatccgagatgatcattccgaaaatctacggaggccctattagccaacataactatcggcccgggtacttcacccagacggcgggaccttggcacctgggcaaacttgagctggactttgatctctgcgaagggaccacagtggttgtggacgagcactgcggaaatagaggcccctctctgcggaccacaaccgtcacgggcaaaatcatccatgaatggtgttgccgcagctgtacactgcctccccttagattcagaggggaagatggatgctggtacggcatggagattcggccggtgaaggaaaaagaggaaaacctcgttaagtccatggtgagcgctgggtctggagaggtcgactcctttagcctgggcctgctctgtatctccattatgatcgaagaggtgatgcgctctcggtggagcagaaagatgctgattaccgggacacttgccgttttctttctgctcatcatgggacaggtgacctggaatgacctgattcgcctgtgcatcatggtcggcgccaacgcttccgatagaatgggcatggggaccacatatcttgccctgatggcgacgttcaaaatgcggcctatgtttgctgtgggactcctgttccgcagactcacctctcgggaggtgctgcttctgacaatcggcctcagcctggtcgcctccgttgaactgcccaattctcttgaggaactgggggacggactcgccatgggcattatgatcctgaagctcctgaccgattttcaaccccaccagctttgggctacactgctcagcctgaccttcattaaaacgacattttccctgcattacgcctggaagaccatggctatggtgcttagcatcgtgtctctgttccctctctgtctgtccaccacaagccagaaaaccacatggctcccggtcctgcttgggtctctgggatgcaagcccctgacgatgtttctcattgccgagaacaagatctggggccgcaaatcctggcctctgaacgaaggcatcatggcggtggggattgttagcatccttctgtcttccctcctgaagaatgacgtgcccctcgccggacctctgattgctggcgggatgcttatcgcctgttatgtcattagcggatccagcgctgatctgtctctggagaaagccgccgaggtgagctgggaagaggaagctgagcactccggcgcgtctcataacatcctcgttgaagtgcaggacgatgggaccatgaagatcaaagacgaggagagagatgacacactgaccattcttctgaaggccacactcctggctgtcagcggagtgtaccccctctccatccctgccaccctgttcgtctggtatttctggcagaagaagaagcagcggtctggcgtgctttgggatacgcccagcccgcctgaagttgagcgcgccgtgctggacgatggcatttacagaatcatgcagcgggggctgctcggacgctcccaggtcggcgtgggggtttttcaagaaaatgtgttccacaccatgtggcacgtcacaagaggagctgtgctgatgtatcagggcaaacggcttgagccctcttgggccagcgtgaagaaagacctgatttcctacgggggaggctggagactccagggcagctggaacaccggggaggaagttcaggtcatcgcggtggagcctggaaagaatcccaaaaacgtgcaaacagctccgggcacctttaagacacctgaaggggaggtcggagccattgccctggacttcaagcccggcacgtctgggtcccctatcgtgaatcgcgaaggaaaaatcgttggcctctacggcaacggggtggtcaccacaagcggaacctatgtgtctgctattgcccaggcgaaggcttcccaggagggccccctgcccgagatcgaagatgaggtttttcggaaaagaaatcttaccattatggacctgcatcctgggagcggaaagacacgccggtacctgccggccatcgtgagagaagccattaaacgcaagctccggacgctgatccttgctcccaccagagtcgtggcctccgagatggctgaagccctgaagggcatgcctatccgctatcaaacaaccgcggttaaatctgagcacacagggaaggagattgtggatctcatgtgccatgccaccttcacgatgcggctgctgagccccgtcagagtgcctaactacaatatgatcattatggacgaagctcactttacagatccctccagcatcgccgctcggggctatatttctacccgcgtgggaatgggcgaggccgccgctatcttcatgaccgcgacacctccggggtccgtcgaagcctttccccagagcaacgctgttatccaggacgaggaaagagatattcctgagcggtcttggaatagcggatacgagtggatcaccgacttccccggcaaaacagtgtggtttgtgccttccattaagtctgggaacgatatcgccaattgtctccgcaaaaacggaaagagagtcattcagcttagccggaagaccttcgacacggaatatcagaaaacaaagaacaatgattgggactacgtggttaccacagacatctccgagatgggcgccaacttcagagctgatcgcgtgattgacccccggagatgcctgaaaccggtcatcctgaaggatgggcctgaacgcgtgatcctcgccggccccatgcccgttaccgtggcgtctgctgcccagcggagaggacgcattggccggaatcataacaaagagggggaccagtacatctatatgggacagcctctgaataacgatgaggaccacgcccactggacggaagctaagatgcttctggataatattaacacccccgagggcatcattcctgccctctttgaaccggagagagaaaagagcgcggccatcgacggggagtaccgcctgagaggagaggctcggaaaacattcgtcgaactgatgcgcagaggcgatctccccgtgtggctttcctataaggtcgccagcgaggggtttcaatactctgaccggcgctggtgcttcgatggcgaaagaaataaccaggtgctggaggaaaatatggacgttgagatctggaccaaagagggagaacggaagaaactgagacctcgctggctcgatgctcggacatattccgaccccctggcccttagagagtttaaggagttcgctgccggccgccggagcgtgtccggggacctgattctcgagatcggaaaactgcctcagcatctgacccagagagcgcaaaacgccctcgataatcttgtgatgctgcacaactctgaacagggcgggcgggcttaccgccatgccatggaggagctgcccgacacaattgaaaccctcatgctgcttgctctgatcgccgtcctcacgggaggcgttacactgtttttcctgagcggcagagggctcggaaagacctccattggccttctgtgtgtgatggcctctagcgtgctgctctggatggcttccgtcgagccgcactggatcgcggccagcatcattctggaatttttccttatggtgctgctcatccctgagcccgatcggcagcgcacccctcaggacaatcaactggcttatgttgtgattgggctgctctttatgatccttacagtcgccgccaacgagatgggactgctggaaaccacaaagaaagatctcggcattgggcacgtggctgtcgagaaccatcaccatgccgcgatgctggacgtggatcttcaccccgcctctgcttggacgctgtacgccgttgctaccacaatcattacccctatgatgagacatacaatcgaaaataccacggccaacatctccctcaccgcgattgccaatcaggctgccatcctgatgggactggacaagggctggcccattagcaaaatggatatcggcgtgccgctccttgctctggggtgctactctcaggtcaaccctctgacactcaccgccgctgtgctgatgcttgttgcccactatgcgattatcggacccggcctgcaagccaaggctacacgggaggcccagaaacgcaccgctgccgggatcatgaagaatcccacggtggacggaattgtcgccatcgatctcgaccctgtggtgtacgatgcgaagttcgaaaaacagctgggccagattatgctgctcatcctttgtacatcccaaattctgctgatgagaaccacatgggctctctgcgagagcatcaccctggccaccgggccgcttacaacgctgtgggagggatctcccggcaagttttggaacaccacaatcgctgttagcatggccaatattttccggggctcctatctcgccggggctggactggccttctctctgatgaaaagcctcggcgggggacgcagaggcaccggggcgcagggagaaacacttggcgagaagtggaaacggcagctgaaccagctgtccaagagcgaatttaatacctacaagagatccggcatcatggaggtcgaccgctctgaagccaaagaggggctcaagcggggagagacgacaaaacacgctgtgagcagaggcaccgccaagctgcgctggttcgtggaacggaaccttgtcaaacctgaggggaaggttattgacctgggatgtggcagagggggatggtcctattactgcgctggcctcaagaaagtgaccgaagtgaagggctatacaaaagggggacccggccatgaggaacctatccccatggccacctacgggtggaatctggtcaagctgcactctggaaaagatgtgtttttcattcctccggagaagtgtgacacactcctttgcgatatcggcgagagctcccccaaccctacgattgaagaggggcgcaccctgcgggttctgaaaatggtggaaccctggctcagaggaaatcaattttgtatcaagatcctgaacccttacatgccctctgtcgtggagacacttgagcagatgcagcgcaagcatggcggcatgctggttcggaatccgctcagcagaaactccacccacgaaatgtattgggtgagctgcgggacaggaaatattgtctctgcggtgaacatgacctcccgcatgctgctgaaccggttcacgatggcccacagaaaacctacctacgagcgcgacgtggatctcggcgctgggacaagacatgtcgccgttgaacccgaggtggctaatctggacatcattggacagcggatcgaaaacattaagcacgagcataaaagcacctggcactatgatgaggacaatccctacaagacatgggcctatcatggctcttacgaagtgaaaccttccgggagcgcttcttccatggtcaacggagtggttaaacttctgaccaagccctgggatgtgatccctatggtcacacaaatcgccatgaccgacacgacaccgtttggccagcagcgcgtgttcaaagagaaggttgataccagaacccccaaagcgaagcggggcacagcccaaattatggaagtgacggctagatggctctgggggtttctgagccggaataaaaagcctcgcatctgtaccagagaggagttcacacggaaggtccgctccaacgccgctattggagccgtgtttgttgacgagaatcagtggaacagcgccaaagaggcggtggaagacgagagattctgggatcttgtccaccgggaacgcgagctgcacaagcagggcaaatgcgctacctgcgtgtataatatgatggggaagagagagaaaaagctcggagagtttggcaaggccaaagggtctcgggccatctggtacatgtggctgggcgctcgcttcctggagttcgaagccctcggatttatgaacgaggaccattggttcagcagagaaaattccctgtctggcgtcgagggggagggacttcacaagctgggctacattctccgggatatcagcaaaatccccgggggaaacatgtatgctgacgatacagccggctgggacacccgcattacagaagatgacctgcagaatgaggcgaagatcaccgatattatggaacctgagcatgcccttctggctaaagccatctttaagctcacgtaccaaaacaaagtggttagagtgcagcggcccgctaagaatgggaccgtcatggacgtgatttcccgcagagatcagcggggctctggacaggtgggcacatatgggctgaacaccttcacaaacatggaagcccaactgatcagacagatggagagcgagggaatcttttccccgtctgaactcgagacccctaatctggcggaacgcgttctttactggctggagaagtatggcgtggaacggctcaaaagaatggccattagcggggacgattgtgtcgtgaagcccatcgacgaccgcttcgctacggccctgacagctcttaacgatatgggaaaagttcggaaggacattcctcagtgggagccctccaaaggctggaatgattggcagcaagtgcctttttgcagccaccacttccatcagctgatcatgaaggacgggagagagattgtcgtgccctgtcgcaaccaggatgaactcgtcggccgggccagagtgtctcagggagctggctggtccctgcgcgagaccgcctgcctgggaaagagctacgcgcaaatgtggcagctcatgtattttcaccggagagacctgcgccttgccgctaatgccatctgttctgccgttccggtggattgggtccctacatcccggaccacgtggagcattcatgctcaccatcagtggatgaccacagaagacatgctgtccgtgtggaacagagtttggatcgaggaaaatccctggatggaggataaaacccacatctctagctgggaggacgtgccctacctcggaaagcgggaagatcaatggtgcggctccctgattgggcttacagccagagcgacctgggctacaaacatccaggtcgccattaatcaggtgcgccggctgatcggaaacgagaattacctcgactatatgaccagcatgaaaagattcaagaacgaatctgaccctgagggcgccctgtggtga

SEQ ID NO: 19455 - RNA, 9879 nt, synthetic construct
  misc_feature 1..9879: note = derived and/or modified CDS sequence (opt5) from DENV-1__KM403627__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatatccagaacaccacattcattatcgacgggcctgatacccccgaatgtcctgacgatcagagagcctggaatatttgggaggtcgaggactatggatttggcgttttcacgacaaacatctggctgaaacttcgcgatagctacacccagatgtgcgaccaccggctcatgtccgctgcgattaaagatagcaaggccgtgcatgctgacatgggctattggatcgaatctgagaaaaatgaaacatggaagctggccagagcctcctttatcgaggtgaagacctgtatttggccccgcagccacacactgtggtctaacggggtcctcgaatccgagatgatcattccgaaaatctacggaggccctattagccaacataattatcggcccgggtacttcacccagacggctggaccttggcacctgggcaaacttgagctggatttcaacctctgcgaagggaccacagtggttgtggacgagcactgcggaaatagaggcccctctctgcggaccacaaccgtcacgggcaaaatcatccatgaatggtgttgccgcagctgtacactgcctccccttagatttagaggggaagatggatgctggtacggcatggagattagaccggtgaaggaaaaagaggaaaacctcgttcgctccatggtgagcgccgggtctggagaggtcgactccttcagcctgggcctgctctgtgtgtccatcatgattgaagaggttatgcggtctagatggagccgcaagatgctgatgaccgggacacttgcggtgtttttcctgctcatcatgggacagctgacctggaatgacctgattagactttgcatcatggtcggcgctaacgtgtccgatcggatgggcatggggaccacatatctggccctcatggccacgtttaagatgcgccctatgttcgctgtgggactgctctttagacggctgacctctcgcgaggtccttctgctcacaattggcctgagcctggttgcctccgtggaacttcccaactctctggaggaactcggggacggactggcgatgggcatcatgatgctcaaactgcttaccgatttccaaagccaccagctgtggacaaccctcctgtccctgacgtttatcaagacaacccttagcctggactacgcttggaaaaccatggccatggtgctctctattgtctccctgttccccctctgtctgagcacaacctctcagaagacaacgtggcttcctgtgctgctggggtcctttggatgcaaaccgctcaccatgttcctgatcacagagaataagatttggggcagaaagagctggccccttaacgaaggcatcatggccgttgggattgtgtctatcctgctctccagcctgctcaaaaatgatgtccctctggctggaccccttatcgccggcgggatgctgattgcttgttatgtgatctccggaagctctgccgacctgagcctcgagcgggcggccgaggtttcctgggaagaggaagctgagcattctggcgccagccacaacattctggtggaagtccaggatgacgggaccatgaagatcaaagatgaggagcgcgacgatacacttaccattctgctcaaggctacgctgctcgccgtgtccggagtctaccctatgtctatccccgccaccctgtttgtgtggtatttctggcagaagaagaaacagagaagcggcgttctttgggacacacctagccctcccgaagtggagcgggctgtcctggatgacggcatctaccgcattctgcagagagggctcctgggacggtctcaggtgggcgttggggtgttccaagacggagtctttcataccatgtggcacgtgacaagaggcgcggtgcttatgtatcaggggaagcgcctggaacccagctgggcctccgttaagaaagatctcatcagctacggaggcggctggcggttccaggggtcttggaataccggagaggaggtccaggtgattgctgtggaacccggcaagaaccctaaaaatgtccaaacaacgcccgggacctttaagacaccggagggagaagtgggcgccatcgccctggacttcaaacctgggacctccggaagccccattgttaacagagagggcaagatcgtgggcctctacgggaatggagtcgtgaccacatctggcacgtatgtttccgctattgcccaggcgaaggctagccaggaagggcctctgcccgagatcgaggatgaagtgtttaaaaagcgcaaccttaccatcatggacctgcaccccggatccggcaaaacacggagatacctgcctgccattgtccgcgaggccatcaagcggaaactcagaaccctgattcttgctccgacacgcgtggttgcctctgaaatggcggaggctctgaaggggatgcccatccggtatcaaaccacggccgtgaagtccgaacatacaggcaaagagattgtcgatctcatgtgccacgccaccttcaccatgagactgctgtcccctgtgcgggtgcccaattacaacatgatcatcatggacgaggctcattttacagatcctgccagcattgctgcccgcggatatatctctaccagagtcggcatgggggaagcggccgctattttcatgacagccacaccccctggatccgttgagagctttccgcagtctaatgctgtgatccaggacgaagaacgggatattcccgaacgcagctggaactccggctacgactggatcacggatttccctgggaagacagtgtggtttgtcccctctatcaaaagcggaaatgacattgccaactgtctcagaaagaacggcaaacgggtgatccagctttccagaaagaccttcgacacagagtatcaaaagaccaaaaataacgattgggactacgttgtgacgaccgatatttctgagatgggggccaatttccgcgctgaccgggtcatcgatcctagacgctgcctgaagcccgtgattctgaaagacggcccggaacgggttatcctcgcgggacctatgcccgtgacagccgctagcgccgcccagagacgcggccggattgggagaaaccagaataaggagggagatcagtacatctatatgggccaacccctgaacaatgacgaagatcacgctcattggaccgaggccaaaatgcttctggacaacatcaatacacctgaggggattatccccgcgctctttgaacctgagcgcgaaaagtccgctgccattgatggagagtacagactgcggggcgaagcccgcaagaccttcgtcgagctgatgagaagaggggacctcccggtgtggcttagctataaagtcgcttctgagggctttcagtactccgatcgcagatggtgcttcgacggagaacggaacaatcaggtgctggaggaaaacatggacgttgagatctggacaaaggaaggcgagcgcaagaagctgcgcccccggtggctcgatgccagaacctatagcgaccctctggcgcttcgcgagtttaaagagttcgccgctgggcggagatccgtgtctggagatctgattctcgagatcggcaagctgccccagcacctgacgctccgggcccaaaatgctcttgacaacctggtgatgctgcacaatagcgaacaagggggaaaagcctaccgccatgctatggaggaactccctgatacaatcgagaccctgatgcttctggccctcattgcggtcctgaccggcggcgttacactgtttttcctctccgggaagggacttggcaagacctctatcgggctgctgtgtgtgatggccagctccgtgctcctgtggatggctagcgtcgagccccactggattgccgcttctatcattcttgaatttttcctgatggtgctcctgatcccggagcctgacagacagcggacaccccaggataaccaactggcctatgttgtgatcggactcctttttatgattctgacggtcgccgctaacgaaatgggcctgctcgagaccaccaaaaaggacctggggatcggacatgtggtcgcggagaatcaccaccatgccaccatgcttgatattgacctgcaccctgcttccgcctggacactctacgccgtggctaccacgatcattacccccatgatgcgccatacaatcgaaaacaccacagccaatattagcctgaccgcgatcgccaaccaggctgccatcctgatgggcctcgataaaggctggcctatttctaagatggacatcggggttccccttctggctctgggatgctactcccaggtgaatccgctcacgctgacagccgcggtccttatgctggtggcccactatgctattatcggccctgggctccaagccaaagctaccagagaggcccagaagcggacagctgccggaattatgaagaaccccaccgttgatggcatcgtggcgatcgacctggaccccgtcgtgtacgatgccaaattcgaaaagcagctggggcagattatgctccttatcctgtgtaccagccaaattctgctcatgcgcacaacgtgggctctgtgcgagtctatcacccttgccacaggacctctgaccacactctgggaaggcagcccgggcaaattttggaataccacgattgctgtgtccatggccaacatcttcagagggtcttatctggccggagcgggcctggctttcagcctcatgaagtcccttgggggaggccggcgcgggacaggagcccagggcgagaccctgggcgagaaatggaagagacagctgaatcagctcagcaagtccgaatttaacacctacaaacggtctgggatcatggaggttgacagaagcgaagctaaggagggactgaaacgcggcgaaacaaccaagcatgccgtctcccgggggacagccaaacttagatggttcgtggagcgcaatctggtgaagcccgagggaaaggtcattgatctcggctgtgggcggggaggctggtcttattactgcgctggcctgaaaaaggttacggaagtgaaagggtataccaagggaggccctgggcacgaggaacccatccctatggccacatacggatggaacattgtgaaactgcacagcggcagagacgtctttttcacaccccctgagaagtgtgataccctcctttgcgacatcggggaatcctctccgaatcccaccattgaggagggacgcacgctgcgggtgctgaaaatggttgaaccttggctcagaggcaaccaattttgtatcaagattctgaatccctacatgcctagcgtggtcgagacccttgaacagatgcagcgcaagcatggcgggatgctggtgcggaaccccctctccagaaatagcacacacgagatgtattgggtttcttgcggaaccggcaacatcgtgtccgcggtcaacatgacaagccgcatgctgctgaatcggttcaccatggcccatagaaaaccgacatacgagcgcgatgtggacctcggggctggaaccagacacgtggccgtcgaacctgagatcgctaacctggatattatcggccagcggattgaaaatatcaagaacgagcacaaatctacgtggcattatgacgaagataatccctacaagacatgggcctatcacgggtcctacgaggttaaacccagcggatctgcgtccagcatggtgaacggcgtggtccgccttctgaccaagccttgggacgtgattcccatggttacccaaatcgccatgacagacacgaccccttttggccagcagagagtgttcaaggagaaagtcgatacacggaccccgagacccaagcgggggacagctcaaatcatggaagtgaccgccaaatggctctggggatttctgtcccgcaataagaaacctagaatttgtacacgggaggagttcacccgcaaggttagaagcaacgctgccatcggcgctgtgtttgtcgacgagaatcagtggaactctgccaaggaagcggtggaggatgagcggttctgggaccttgttcatcgcgaaagagagctgcacaaacaggggaagtgcgccacgtgcgtgtataatatgatgggaaaacgggaaaagaaactcggcgagtttgggaaggctaagggcagccgcgccatttggtacatgtggctgggagctagattcctggagttcgaggccctcggctttatgaacgaggatcattggttctcccgggaaaattctctgagcggggtcgagggagaaggccttcacaaactggggtacatcctccgcgacatttccaagatccccggaggcaacatgtatgccgatgacaccgcggggtgggatacaagaatcaccgaggacgatctgcagaatgaggctaaaattacagacatcatggaacctgagcacgcccttctggccacctctatttttaagctcacgtaccaaaacaaagtggtccgggtgcagcgccccgctaagagcggcacagttatggatgtgatctccagacgggaccagagaggatctggccaggtcgggacctatggactgaacacattcaccaatatggaagtgcaactgattcgccagatggagagcgaaggcatcttttccccgagcgagctcgagaactctaatctggccgaacgggtgcttgactggctggagaaacatggggttgaaagactcaagcgcatggctatctccggagatgactgtgtggtcaagcctacggatgaccggttcgccaccgcgctgacagcccttaacgatatgggcaaagtgagaaaggacattccccagtgggagcctagcaaagggtggaatgattggcagcaagttcccttttgctctcaccatttccaccagctgatcatgaaggacggccgcgaaattgtggtcccttgtcggaaccaggatgagctcgtgggacgggctcgcgtctcccagggcgccgggtggagcctgcgggagaccgcttgcctgggaaaatcctacgcccaaatgtggcagctcatgtattttcacagacgcgacctgcggcttgcggccaatgctatctgttctgccgtgcccgttaactgggtgccgacaagcagaaccacatggtccattcatgctcaccatcagtggatgaccacggaagatatgctgagcgtctggaatcgggtgtggatcgaggaaaacccttggatggaggacaagacacacgtttcttcctgggaagacgtgccctacctcggcaagagagaggatcaatggtgcgggagcctgattggacttaccgcccgcgctacctgggccacaaatatccaggtcgcgatcaaccaggtgcggagactgattggcaatgagaactatctcgactacatgacctctatgaaacgcttcaagaatgaaagcgatcccgagggggccctgtggtga

SEQ ID NO: 19456 - RNA, 9879 nt, synthetic construct
  misc_feature 1..9879: note = derived and/or modified CDS sequence (opt5) from DENV-1__KM403584__SS-prME
  source 1..9879: mol_type = other RNA
tccgtgaccatgctgctcatgctgcttcccacagccctggctttccacctcacgacccggggcggggaacctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgaggtgcagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggttgtgctcggatctcaagagggcgctatgcacaccgccctgacaggggccacggaaatccagaccagcggaacaaccacaatttttgctggccatcttaaatgcagactgaagatggacaaactcaccctgaagggggtctcctatgtgatgtgtacgggcagcttcaaactggagaaggaagttgccgagacacagcacggaaccgtgcttgtccaggtgaagtacgagggcaccgatgcgccgtgcaaaatccctatttctacacaagacgaaaagggggtgacccagaacggacggctcatcacagctaatcccatcgttacggataaagagaagcctgtcaacattgaaaccgagccgcccttcggcgagtcctatatcgtgattggggccggagaaaaagccctgaagctgagctggtttaagaaaggctctagcatcgggaagatgttcgaggctacagccagaggcgctcgccggatggccattctcggagacaccgcgtgggattttggctccatcgggggagtgttcacatctgtcggcaaactggtgcatcaggtttttgggaccgcctacggagtgcttttcagcggcgtctcctggacgatgaagatcgggattggcatcctgctcacctggctgggactgaatagcagatctacatcccttagcatgacctgtattgctgtgggcatggttacactctacctgggggtgatggtccaggccgactctggatgcgtgatcaactggaaaggccgcgaactgaagtgtgggtccggaatttttgttaccaacgaggtgcacacatggaccgaacaatataagttccaggctgatagccctaaacggctctccgccgcgatcggcaaggcctgggaggagggggtctgcggcattagatctgctacgcgcctggaaaatatcatgtggaaacagatcagcaacgagcttaatcatattctgctcgaaaacgacatgaagtttacagtggtggtcggagacgcctacggcatcctgacccaggggaaaaagatgattcggccgcaacccatggagcacaaatattcctggaagtcttggggaaaggctaaaatcattggcgccgatacccagaatacaaccttcatcatcgacgggcctgatacgcccgaatgtcctgacgatcagagagcctggaacatttgggaggttgaggactacggatttggcgtgttcacaaccaatatctggctgaaacttcgcgatagctatacacagatgtgcgaccaccggctcatgtccgctgcgattaaagatagcaaggccgtgcatgctgacatgggctactggatcgaatctgagaaaaacgaaacctggaagctggccagagcctcctttattgaggtcaagacatgtatctggccccgcagccacaccctgtggtctaatggggtgctcgaatccgagatgatcattccgaaaatctatggaggccctattagccaacataactaccggcccgggtacttcacgcagaccgctggaccttggcacctgggcaaacttgagctggatttcaatctctgcgaagggacaaccgttgtggtcgacgagcactgcggaaacagaggcccctctctgcggacaaccacggtgacaggcaaaatcattcatgaatggtgttgccgcagctgtaccctgcctccccttagatttagaggggaagatggatgctggtatggcatggagatccggccggttaaggaaaaagaggaaaatctcgtgcgctccatggtcagcgccgggtctggagaggtggactccttcagcctgggcctgctctgtgtttccatcatgattgaagaggtgatgcggtctagatggagccgcaagatgctgatgacagggacccttgcggtctttttcctgctcatcatgggacagctgacctggaacgacctgattagactttgcatcatggtgggcgctaatgtgtccgatcggatgggcatggggacaacgtacctggccctcatggccacctttaagatgcgccctatgttcgctgtcggactgctctttagacggctgacatctcgcgaggttcttctgctcaccattggcctgagcctggtggcctccgtggaacttcccaactctctggaggaactcggggacggactggcgatgggcatcatgatgctcaaactgcttacagatttccaaagccaccagctgtggaccacgctcctgtccctgacatttattaagaccacccttagcctggactatgcttggaaaacaatggccatggtcctctctatcgtgtccctgttccccctctgtctgagcaccacatctcagaagacgacctggcttcctgttctgctggggtcctttggatgcaaaccgctcacaatgttcctgatcaccgagaacaagatttggggcagaaagagctggccccttaatgaaggcatcatggccgtggggattgtctctatcctgctctccagcctgctcaaaaacgatgtgcctctggctggaccccttattgccggcgggatgctgatcgcttgttacgttatctccggaagctctgccgacctgagcctcgagcgggcggccgaggtgtcctgggaagaggaagctgagcattctggcgccagccacaatattctggtcgaagtgcaggatgacgggacaatgaagatcaaagatgaggagcgcgacgatacccttacgattctgctcaaggctaccctgctcgccgtctccggagtgtatcctatgtctatccccgccacactgtttgtttggtacttctggcagaagaagaaacagagaagcggcgtgctttgggacacccctagccctcccgaagtcgagcgggctgtgctggatgacggcatttatcgcatcctgcagagagggctcctgggacggtctcaggttggcgtgggggtcttccaagacggagtgtttcatacaatgtggcacgtgaccagaggcgcggttcttatgtaccaggggaaacgcctggaacccagctgggcctccgtcaagaaagatctcatcagctacggaggcggctggcggttccaggggtcttggaacacaggagaggaggtgcaagtgattgctgtcgaacccggcaagaatcctaaaaacgtgcaaacgacccccgggacatttaagaccccggagggagaagttggcgccatcgccctggacttcaaacctgggacctccggaagccccattgtgaatagagagggcaagatcgtcggcctctatgggaacggagtggttacaacgtctggcacctacgtgtccgctattgcccaggcgaaggctagccaggaagggcctctgcccgagatcgaggatgaagtctttaaaaagcgcaatcttacaattatggacctgcaccccggatccggcaaaacccggagatatctgcctgccatcgtgcgcgaggccatcaagcggaaactcagaacactgattcttgctccgacccgcgttgtggcctctgaaatggcggaggctctgaaggggatgcccatccggtaccaaacgacagccgtcaagagcgaacataccggcaaagagattgtggatctcatgtgccacgccaccttcacaatgagactgctgtcccctgtgcgggtccccaactataatatgatcattatggacgaggctcattttaccgatcctgccagcatcgctgcccgcggatacatctctacaagagttggcatgggggaagcggccgctattttcatgaccgccacgccccctggatccgtggaggcttttccgcagagcaacgccgtgatccaggacgaagaacgggatattcccgaacgctcttggaatagcggctatgactggatcacagatttccctgggaagaccgtctggtttgtgccctccattaaatctggaaacgacatcgccaattgtctcagaaagaacggcaaacgggttatccagcttagcagaaagacattcgacaccgagtaccaaaagacgaaaaacaatgattgggactacgtggtcaccacagatatttccgagatgggggctaacttccgcgcggaccgggtgatcgatcctagacgctgcctgaagcccgttattctgaaagacggcccggaacgggtgatcctcgccggacctatgcccgtcaccgctgcctctgccgctcagagacgcggccggattgggagaaatcagaacaaggagggagatcagtatatctacatgggccaacccctgaataacgacgaagatcacgcccattggacagaggcgaaaatgcttctggacaatattaacacccctgaggggatcatccccgctctctttgaacctgagcgcgaaaagagcgccgccattgatggagagtatagactgcggggcgaagctcgcaagacattcgtggagctgatgagaagaggggacctcccggtctggctttcctacaaagtggccagcgagggctttcagtattctgatcgcagatggtgcttcgacggagaacggaataaccaggttctggaggaaaatatggacgtggagatctggaccaaggaaggcgagcgcaagaagctgcgcccccggtggctcgatgcgagaacgtactccgaccctctggcccttcgcgagtttaaagagttcgctgccgggcggagaagcgtgtccggagatctgattctcgagatcggcaagctgccccagcacctgacactccgggctcaaaacgcccttgacaatctggtcatgctgcacaactctgaacaagggggaaaggcttatcgccatgccatggaggaactccctgataccattgagaccctgatgcttctggcgctcatcgccgttctgacaggcggcgtgaccctgtttttcctcagcgggaagggacttggcaagacatccatcgggctgctgtgtgtgatggcttctagcgtcctcctgtggatggcctccgtggagccccactggattgctgccagcatcattcttgaatttttcctgatggttctcctgatcccggagcctgacagacagcggacgccccaggataatcaactggcctacgtggtcattggactcctttttatgatcctgaccgtggctgcgaacgaaatgggcctgctcgagacaaccaaaaaggacctggggatcggacatgtcgtggccgagaaccaccaccatgctacaatgcttgatattgacctgcaccctgcctctgcctggaccctctacgctgttgccacgaccatcattacacccatgatgcgccataccatcgaaaatacaaccgcgaacatttccctgacggccatcgctaatcaggccgctattctgatgggcctcgataaaggctggcctatcagcaagatggacatcggggtgccccttctggccctgggatgctattctcaggtcaacccgctcacactgaccgcggccgtgcttatgctggttgctcactacgccattatcggccctgggctccaagctaaagccacaagagaggctcagaagcggaccgccgcgggaattatgaagaatcccaccgtggatggcatcgtcgccattgacctggaccccgtggtgtatgatgctaaattcgaaaagcagctggggcagatcatgctccttatcctgtgtacatcccaaattctgctcatgcgcacgacctgggccctgtgcgagagcatcacacttgctaccggacctctgacaaccctctgggaaggctctccgggcagattttggaacacgacaattgccgttagcatggccaatatcttccgggggtcctacctggcgggagctggcctggccttctctctcatgaaaagccttgggggaggccgcagagggaccggagctcagggcgagaccctgggcgagaagtggaaacggcagctgaaccagctctccaagagcgaatttaatacatataagagatccgggattatggaggtcgaccgctctgaagccaaagagggaatgaagcggggcgaaaccacaaaacatgccgtgagcagagggacggctaagctgcgctggttcgtggagcggaaccttgtcaaacccgagggaaaggttatcgatctgggctgtgggagaggaggctggtcctactattgcgccggcctcaagaaagtgaccgaagtgaaggggtacacaaaaggaggccctgggcacgaggaacccatccctatggcgacctacggatggaatattgtcaagctgcactctggccgcgacgtgtttttcacaccccctgagaaatgtgataccctgctctgcgacatcggggaaagctccccgaaccccacgattgaggagggacggacccttagagttctgaagatggtggaaccttggctgcgcggcaatcaattttgtatcaaaattctcaacccctatatgccttctgtcgtggagacactggaacagatgcagcggaagcatggcgggatgcttgttagaaatcccctgagccgcaactccacccacgagatgtactgggtgagctgcggaacaggcaatatcgtctctgccgtgaacatgacctcccggatgctcctgaacagattcacaatggctcatcgcaagccgacctatgagagagatgtggacctgggggccggaacgcggcacgtcgctgttgaacctgagattgccaatctcgatatcatcggccagcgcattgaaaacatcaaaaatgagcacaagagcacatggcattacgacgaagataacccctataaaacctgggcgtaccacgggtcttatgaggtgaagccctccggaagcgcctcttccatggtgaatggcgtcgtgagactgcttaccaaaccttgggacgttattcccatggtgacacaaatcgctatgacggacaccacaccttttggccagcagcgggtcttcaaggagaaggtggataccagaacaccgcggcccaaacgcgggaccgcccaaattatggaagttacagctaagtggctgtggggatttctcagcagaaacaaaaagcctcggatctgtacccgcgaggagttcacgagaaaagtgcggtccaatgccgctatcggcgccgtctttgtggacgagaaccagtggaatagcgcgaaggaagccgttgaggatgagcgcttctgggacctggtgcatagagaacgggagcttcacaagcaggggaaatgcgctacctgcgtctacaacatgatgggaaagcgcgagaagaagctgggcgagtttgggaaagccaagggctctagagctatttggtacatgtggctcggagcccggttcctggagttcgaggccctgggctttatgaatgaggatcattggttcagccgcgaaaactccctctctggggtggagggagaaggcctgcacaaacttgggtatatcctgagagacattagcaaaatccccggaggcaatatgtacgcggatgacacagctgggtgggatacccggattacagaggacgatctccagaacgaggccaagatcaccgacatcatggaacctgagcacgccctgcttgctacgtccatttttaaactgacatatcaaaataaggtcgtgcgcgttcagagacccgccaaatctggcaccgtgatggatgtcatcagccggagagaccagcgcggatccggccaggtggggacatacggactcaacaccttcacgaacatggaagtgcaactgattcggcagatggagtctgaaggcatctttagcccgtccgagctggagaatagcaacctcgctgaaagagttctggactggcttgagaagcatggggtggaacgcctgaaacggatggccatttctggagatgactgtgtcgtgaagcctaccgatgacagattcgcgacagccctcaccgctctgaatgatatgggcaaggttcgcaaagacatcccccagtgggagccttccaaggggtggaacgattggcagcaagtgcccttttgcagccaccatttccaccagcttatcatgaaagacggccgggaaattgtcgtgccttgtagaaatcaggatgagctggtcggacgcgcccgggtgtctcagggcgctgggtggtccctcagagagacagcctgcctgggaaagagctatgcgcaaatgtggcagctgatgtactttcaccgccgggacctcagactggccgctaacgccatctgttccgctgttcccgtgaattgggtcccgacctctcggacaacctggagcattcatgcccaccatcagtggatgacgacagaagatatgctttccgtgtggaacagagtttggatcgaggaaaatccttggatggaggacaaaacccacgtgagctcttgggaagacgtcccctatctgggcaagcgcgaggatcaatggtgcgggtccctcattggactgaccgctcgggccacatgggcgaccaacatccaggtggccattaatcaggtgagacgccttatcggcaacgagaattacctggactacatgacaagcatgaagagattcaaaaacgaatctgatcccgagggggctctctggtga

SEQ ID NO: 19457 - RNA, 9879 nt, synthetic construct
  misc_feature 1..9879: note = derived and/or modified CDS sequence (opt5) from DENV-1__KM403633__SS-prME
  source 1..9879: mol_type = other RNA
agcgtgaccatgctgctcatgctgcttcccacagctctggctttccacctcacgaccagaggcggggaacctcatatgatcgtgtccaagcaggaacggggaaaatctctgctttttaagacaagcgccggcgttaacatgtgcaccctgattgcgatggacctcggggaactgtgtgaagatacaatgacctacaaatgcccgcgcatcacagaagctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgcgcgagaagtcttggctggtccataaacagtggtttcttgacctgcctctcccctggacgtccggggctagcacatcccaagagacctggaatagacaggatctgctggtgacattcaagaccgcgcacgccaaaaagcaggaagtcgtggttctcggatctcaagagggcgctatgcacaccgccctgacaggggccacggaaattcagaccagcggaacaaccacaatctttgctggccatcttaagtgccggctgaaaatggacaagctcaccctgaaaggggtgtcctatgtcatgtgtacgggcagcttcaagctggagaaagaagtggccgagacacagcacggaaccgttcttgtgcaggtcaagtacgagggcaccgatgcgccgtgcaagattcctatctctacacaagacgaaaaaggggtgacccagaacggaagactcatcacagctaatcccattgtgacggataaggagaaacctgttaacatcgaaaccgagccgcccttcggcgagtcctatattgtcatcggggccggagaaaaggccctgaaactgagctggtttaagaagggctctagcattgggaaaatgttcgaggctacagcccgcggcgctcggagaatggccatcctcggagacaccgcgtgggattttggctccatcgggggagtgttcacatctgtgggcaagctggtccatcaggtgtttgggaccgcctacggagttcttttcagcggcgtgtcctggacgatgaaaattgggatcggcattctgctcacctggctgggactgaatagccgctctacatcccttagcatgacctgtatcgctgtcggcatggtgacactctacctgggggttatggtgcaggccgactctggatgcgtcattaactggaagggccgggaactgaaatgtgggtccggaatctttgtgaccaacgaggttcacacatggaccgaacaatataagttccaggctgatagccctaagagactctccgccgcgattggcaaagcctgggaggagggggtgtgcggcatccgctctgctacgcggctggaaaatatcatgtggaagcagattagcaacgagcttaatcatatcctgctcgaaaacgacatgaaatttacagtcgtggtgggagacgccaatggcattctgacccaggggaagaaaatgatcagaccgcaacccatggagcacaagtactcctggaaatcttggggaaaggctaagattatcggcgccgatacccagaacacaaccttcatcattgacgggcctgatacgcccgaatgtcctgacgatcagcgcgcctggaatatctgggaggtcgaggactatggatttggcgttttcacaaccaacatttggctgaaacttcgggatagctacacacagatgtgcgaccacagactcatgtccgctgcgatcaaggatagcaaagccgtgcatgctgacatgggctattggattgaatctgagaagaatgaaacctggaaactggcccgcgcctcctttatcgaggtgaagacatgtatctggccccggagccacaccctgtggtctaacggggtcctcgaatccgagatgattatcccgaagatttacggaggccctatcagccaacataattatagacccgggtacttcacgcagaccgctggaccttggcacctgggcaaacttgagctggatttcaacctctgcgaagggacaaccgtggttgtggacgagcactgcggaaatcggggcccctctctgcgcacaaccacggtcacaggcaagattatccatgaatggtgttgcagaagctgtaccctgcctccccttcggtttagaggggaggatggatgctggtacggcatggagatccgcccggtgaaagaaaaggaggaaaacctcgttcggtccatggtgagcgccgggtctggagaggtcgactccttcagcctgggcctgctctgtgtgtccattatgatcgaagaggttatgagatctcgctggagcagaaaaatgctgatgacagggacccttgcggtgtttttcctgctcattatgggacagctgacctggaatgacctgatccggctttgcattatggtcggcgctaacgtgtccgatcgcatgggcatggggacaacgtatctggccctcatggccacctttaagatgagacctatgttcgctgtgggactgctctttcggcgcctgacatctagagaggtccttctgctcaccatcggcctgagcctggttgcctccgtggaacttcccaactctctggaggaactcggggacggactggcgatgggcattatgatgctcaagctgcttacagatttccaaagccaccagctgtggaccacgctcctgtccctgacatttatcaaaaccacccttagcctggactacgcttggaagacaatggccatggtgctctctatcgtctccctgttccccctctgtctgagcaccacatctcagaaaacgacctggcttcctgtgctgctggggtcctttggatgcaagccgctcacaatgttcctgattaccgagaataaaatctggggccggaagtcctggccccttaacgaaggcattatggccgttgggatcgtgtctattctgctctccagcctgctcaagaatgatgtccctctggctggaccccttatcgccggcgggatgctgatcgcttgttatgtgatttccggaagctctgccgacctgagcctcgagcgcgcggccgaggtttcctgggaagaggaagctgagcattctggcgccagccacaacatcctggtggaagtccaggatgacgggacaatgaaaattaaggatgaggagagagacgatacccttacgatcctgctcaaagctaccctgctcgccgtgtccggagtctaccctatgtctattcccgccacactgtttgtgtggtatttctggcaaaagaaaaagcagcggagcggcgttctttgggacacccctagccctcccgaagtggagcgcgctgtcctggatgacggcatctacagaatcctgcagcgggggctcctgggaagatctcaggtgggcgttggggtgttccaagacggagtctttcatacaatgtggcacgtgacccgcggcgcggtgcttatgtatcaggggaaacggctggaacccagctgggcctccgttaagaaggatctcattagctacggaggcggctggagattccaggggtcttggaatacaggagaggaggtccaggtgatcgctgtggaacccggcaaaaaccctaagaatgtccaaacgacccccgggacatttaaaaccccggagggagaagtgggcgccattgccctggacttcaagcctgggacctccggaagccccatcgttaaccgcgagggcaaaattgtgggcctctacgggaatggagtcgtgacaacgtctggcacctatgtttccgctatcgcccaggcgaaggctagccaggaagggcctctgcccgagattgaggatgaagtgtttaagaaacggaaccttacaatcatggacctgcaccccggatccggcaagaccagacgctacctgcctgccatcgtccgggaggccattaaaagaaagctccgcacactgatccttgctccgacccgggtggttgcctctgaaatggcggaggctctgaaagggatgcccattagatatcaaacgacagccgtcaagagcgaacataccggcaaggagatcgtcgatctcatgtgccacgccaccttcacaatgcggctgctgtcccctgtgcgcgtgcccaattacaacatgattatcatggacgaggctcattttaccgatcctgccagcatcgctgccagaggatatatttctacacgggtcggcatgggggaagcggccgctatcttcatgaccgccacgccccctggatccgttgaggcttttccgcagagcaatgccgtgattcaggacgaagaacgcgatatccccgaaagatcttggaacagcggctacgactggattacagatttccctgggaaaaccgtgtggtttgtcccctccatcaagtctggaaatgacatcgccaactgtctccggaaaaacggcaagagagtgattcagcttagccgcaaaacattcgacaccgagtatcaaaagacgaagaataacgattgggactacgttgtgaccacagatatctccgagatgggggctaatttccgggcggacagagtcattgatcctcgccggtgcctgaaacccgtgatcctgaaggacggcccggaaagagttattctcgccggacctatgcccgtgaccgctgcctctgccgctcagcgccggggcagaatcgggcgcaaccagaataaagagggagatcagtacatttatatgggccaacccctgaacaatgacgaagatcacgcccattggacagaggcgaagatgcttctggacaacatcaatacccctgaggggatcattcccgctctctttgaacctgagagagaaaagagcgccgccatcgatggagagtaccggctgcgcggcgaggctagaaagacattcgtcgagctgatgcggcgcggggacctcccggtgtggctttcctataaggtcgccagcgagggctttcagtactctgatagacggtggtgcttcgacggagaaagaaacaatcaggtgctggaggaaaacatggacgttgagatttggaccaaagaaggcgagcgcaagaaactgcggcccagatggctcgatgcgcgcacgtattccgaccctctggcccttcgggagtttaaggagttcgctgccgggagacggagcgtgtccggagatctgatcctcgagattggcaaactgccccagcacctgacactccgcgctcaaaatgcccttgacaacctggtgatgctgcacaattctgaacaagggggaaaggcttacagacatgccatggaggaactccctgataccatcgagaccctgatgcttctggcgctcatcgccgtcctgacaggcggcgttaccctgtttttcctcagcgggaaaggacttggcaagacatccattgggctgctgtgtgtgatggcttctagcgtgctcctgtggatggcctccgtcgagccccactggatcgctgccagcattatccttgaatttttcctgatggtgctcctgattccggagcctgaccggcagcgcacgccccaggataaccaactggcctatgttgtgatcggactcctttttatgatcctgaccgtcgctgcgaacgaaatgggcctgctcgagacaaccaagaaagacctggggattggacatgtggtcgccgagaatcaccaccatgctacaatgcttgatatcgacctgcaccctgcctctgcctggaccctctacgctgtggccacgaccattatcacacccatgatgagacataccattgaaaacacaaccgcgaatatctccctgacggccattgctaaccaggccgctatcctgatgggcctcgataagggctggcctatcagcaaaatggacattggggttccccttctggccctgggatgctactctcaggtgaatccgctcacactgaccgcggccgtccttatgctggtggctcactatgccatcattggccctgggctccaagctaaggccacacgggaggctcagaaacgcaccgccgcgggaatcatgaagaaccccaccgttgatggcattgtggccatcgacctggaccccgtcgtgtacgatgctaagttcgaaaaacagctggggcagatcatgctccttattctgtgtacatcccaaatcctgctcatgagaacgacctgggccctgtgcgagagcattacacttgctaccggacctctgacaaccctctgggaaggctctccgggcaagttttggaatacgacaatcgccgtgagcatggccaacattttccgggggtcctatctggcgggagctggcctggccttctctctcatgaaaagccttgggggaggccgcagagggaccggagctcagggcgagaccctgggcgagaagtggaaacggcagctgaatcagctctccaagagcgaatttaacacatacaagagatccgggatcatggaggttgaccgctctgaagccaaagagggactgaagcggggcgaaaccacaaaacatgccgtcagcagagggacggctaaacttcgctggttcgtggagcggaatctggtgaaacccgagggaaaggtcatcgatctcggctgtgggagaggaggctggtcctattactgcgccggcctgaagaaagttaccgaagtgaaggggtatacaaaaggaggccctgggcacgaggaacccattcctatggcgacctacggatggaacatcgtgaagctgcactctggccgcgacgtctttttcacaccccctgagaaatgtgataccctcctttgcgacattggggaaagctccccgaatcccacgatcgaggagggacggaccctgagagtgctgaagatggttgaaccttggctccgcggcaaccaattttgtattaaaatcctgaatccctacatgccttctgtggtcgagacacttgaacagatgcagcggaagcatggcgggatgctggtgagaaaccccctcagccgcaattccacccacgagatgtattgggttagctgcggaacaggcaacattgtgtctgccgtcaacatgacctcccggatgctgctgaatagattcacaatggctcatcgcaagccgacctacgagagagatgtggacctcggggccggaacgcggcacgtggctgtcgaacctgagatcgccaacctggatatcattggccagcgcatcgaaaatattaaaaacgagcacaagagcacatggcattatgacgaagataatccctacaaaacctgggcgtatcacgggtcttacgaggttaagccctccggaagcgcctcttccatggtgaacggcgtggtcagacttctgaccaaaccttgggacgtgatccccatggttacacaaattgctatgacggacaccacaccttttggccagcagcgggtgttcaaggagaaggtcgataccagaacaccgcggcccaaacgcgggaccgcccaaatcatggaagtgacagctaagtggctctggggatttctgagcagaaataaaaagcctcggatctgtacccgcgaggagttcacgagaaaagttcggtccaacgccgctattggcgccgtgtttgtcgacgagaatcagtggaacagcgcgaaggaagccgtggaggatgagcgcttctgggaccttgttcatagagaacgggagctgcacaagcaggggaaatgcgctacctgcgtgtataatatgatgggaaagcgcgagaaaaagctcggcgagtttgggaaagccaagggctctagagctatctggtacatgtggctgggagcccggttcctggagttcgaggccctcggctttatgaacgaggatcattggttcagccgcgaaaattccctgtctggggtcgagggagaaggccttcacaagctggggtacattctcagagacatcagcaaaattcccggaggcaacatgtatgcggatgacacagctgggtgggatacccggatcacagaggacgatctgcagaatgaggccaagatcaccgacattatggaacctgagcacgcccttctggctacgtccatctttaaactcacataccaaaacaaggtggtccgcgtgcagagacccgccaaatctggcaccgttatggatgtgattagccggagagaccagcgcggatccggccaggtcgggacatatggactgaacaccttcacgaatatggaagtgcaactgatccggcagatggagtctgaaggcatttttagcccgtccgagctcgagaacagcaatctggctgaaagagtgcttgactggctggagaagcatggggttgaacgcctcaaacggatggccatctctggagatgactgtgtggtcaagcctaccgatgacagattcgcgacagccctgaccgctcttaacgatatgggcaaggtgcgcaaagacatcccccagtgggagccttccaaggggtggaatgattggcagcaagttcccttttgcagccaccatttccaccagctgattatgaaagacggccgggaaatcgtggtcccttgtagaaaccaggatgagctcgtgggacgcgcccgggtctctcagggcgctgggtggtccctgagagagacagcctgcctgggaaagagctacgcgcaaatgtggcagctcatgtattttcaccgccgggacctgagacttgccgctaatgccatttgttccgctgtgcccgttaactgggtgccgacctctcggacaacctggagcatccatgcccaccatcagtggatgacgacagaagatatgctgtccgtctggaatagagtgtggattgaggaaaacccttggatggaggacaaaacccacgttagctcttgggaagacgtgccctacctcggcaagcgcgaggatcaatggtgcgggtccctgatcggacttaccgctcgggccacatgggcgaccaatattcaggtcgccatcaaccaggtgagacgcctgatcggcaatgagaactatctcgactacatgacaagcatgaagagattcaaaaatgaatctgatcccgagggggctctgtggtga

SEQ ID NO: 19458 - RNA, 9879 nt, synthetic construct
  misc_feature 1..9879: note = derived and/or modified CDS sequence (opt5) from DENV-1__KM403592__SS-prME
  source 1..9879: mol_type = other RNA
agcgtgaccatgctgctcatgctgcttcccacagctctggctttccacctcacgacccggggcggggagcctcatatgatcgtctccaagcaggaacggggaaaatctctgctttttaagacaagcgctggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtggctcagaacggacggctcatcaccgccaatcccattgtgacagataaagagaagcctgttaacatcgaaacggagccgcccttcggcgagtcctatattgtcatcggggccggagaaaaagctctgaagctgagctggtttaagaaaggctctagcattgggaagatgttcgaggccaccgctagaggcgcccgccggatggcgatcctcggagacacagcctgggattttggctccatcgggggagtgttcacctctgtgggcaaactggtccatcaggtgtttgggacagcttacggagttcttttcagcggcgtgtcctggaccatgaagattgggatcggcattctgctcacgtggctgggactgaatagcagatctacctcccttagcatgacatgtatcgccgtcggcatggtgaccctctacctgggggttatggtgcaggctgactctggatgcgtcattaactggaaaggccgcgaactgaagtgtgggtccggaatctttgtgacaaacgaggttcacacctggacagaacaatataagttccaggccgatagccctaaacggctctccgcggccattggcaaggcttgggaggagggggtgtgcggcatcagatctgccacccgcctggaaaatatcatgtggaaacagattagcaacgagcttaatcatatcctgctcgaaaacgacatgaagtttacggtcgtggtgggagacgctaatggcattctgacacaggggaaaaagatgatccggccgcaacccatggagcacaaatactcctggaagtcttggggaaaggccaaaattatcggcgccgatacccagaacaccacattcatcattgacgggcctgatacccccgaatgtcctgacgatcagagagcttggaatatctgggaggtcgaggactatggatttggcgttttcacgacaaacatttggctgaaacttcgcgatagctacacccagatgtgcgaccaccggctcatgtccgcggccatcaaagatagcaaggctgtgcatgccgacatgggctattggattgaatctgagaaaaatgaaacatggaagctggccagagcttcctttatcgaggtgaagacctgtatctggccccgcagccacacactgtggtctaacggggtcctcgaatccgagatgattatcccgaaaatttacggaggccctatcagccaacataattatcggcccgggtacttcacccagacggccggaccttggcacctgggcaaacttgagctggatttcaacctctgcgaagggaccacagtggttgtggacgagcactgcggaaatagaggcccctctctgcggaccacaaccgtcacgggcaaaattatccatgaatggtgttgccgcagctgtacactgcctccccttagatttagaggggaagatggatgctggtacggcatggagatcagaccggtgaaggaaaaagaggaaaacctcgttcgctccatggtgagcgcggggtctggagaggtcgactccttcagcctgggcctgctctgtgtgtccattatgatcgaagaggttatgcggtctagatggagccgcaagatgctgatgaccgggacacttgctgtgtttttcctgctcattatgggacagctgacctggaatgacctggtcagactttgcatcatggtgggcgccaacgtgtccgatcggatgggcatggggaccacatatctggccctcatggctacgtttaagatgcgccctatgttcgccgtcggactgctctttagacggctgacctctcgcgaggttcttctgctcacaattggcctgagcctggtggcgtccgtggaacttcccaactctctggaggaactcggggacggactggctatgggcatcatgatgctcaaactgcttaccgatttccaaagccaccagctgtggacaaccctcctgtccctgacgtttattaagacaacccttagcctggactacgcctggaaaaccatggccatggtcctctctatcgtgtccctgttccccctctgtctgagcacaacctctcagaagacaacgtggcttcctgttctgctggggtcctttggatgcaaaccgctcaccatgttcctgatcacagagaataagatttggggcagaaagagctggccccttaacgaaggcatcatggctgtggggattgtctctatcctgctctccagcctgctcaaaaatgatgtgcctctggccggaccccttattgctggcgggatgctgatcgcctgttatgttatctccggaagctctgcggacctgagcctcgagcgggccgctgaggtgtcctgggaagaggaagccgagcattctggcgctagccacaacattctggtcgaagtgcaggatgacgggaccatgaagatcaaagatgaggagcgcgacgatacacttaccattctgctcaaggccacgctgctcgccgtctccggagtgtaccctatgtctatccccgctaccctgtttgtttggtatttctggcagaagaagaaacagagaagcggcgtgctttgggacacacctagccctcccgaagtcgagcgggcggtgctggatgacggcatttaccgcatcctgcagagagggctcctgggacggtctcaggttggcgtgggggtcttccaagacggagtgtttcataccatgtggcacgtgacaagaggcgccgttcttatgtatcaggggaagcgcctggaacccagctgggcttccgtcaagaaagatctcatcagctacggaggcggctggcggttccaggggtcttggaataccggagaggaggtgcaagtgattgccgtcgaacccggcaagaaccctaaaaatgtgcaaacaatgcccgggacgtttaagaccccggagggagaagttggcgccatcgctctggacttcaaacctgggacatccggaagccccattgtgaacagagagggcaagatcgtcggcctctacgggaatggagtggttaccacctctggcacatatgtgtccgccattgcgcaggctaaggccagccaggaagggcctctgcccgagatcgaggatgaagtctttaaaaagcgcaaccttacgattatggacctgcaccccggatccggcaaaacccggagatacctgcctgccatcgtgcgcgaggctatcaagcggaaactcagaacactgattcttgccccgacccgcgttgtggcgtctgaaatggctgaggccctgaaggggatgcccatccggtatcaaacaaccgccgtcaagagcgaacatacgggcaaagagattgtggatctcatgtgccacgctacattcaccatgagactgctgtcccctgtgcgggtccccaattacaacatgatcattatggacgaggcccattttaccgatcctgctagcatcgccgcgcgcggatatatctctacaagagttggcatgggggaagccgctgccattttcatgaccgctacaccccctggatccgtggaggcctttccgcagagcaatgccgtgatccaggacgaagaacgggatattcccgaacgctcttggaacagcggctacgactggatcaccgatttccctgggaagacggtctggtttgtgccctccattaaatctggaaatgacatcgctaactgtctcagaaagaacggcaaacgggttatccagcttagcagaaagacattcgacaccgagtatcaaaagaccaagaataacgattgggactacgtggtcaccacggatatttccgagatgggggcgaatttccgcgccgaccgggtgatcgatcctagacgctgcctgaagcccgttattctgaaagacggcccggaacgggtgatcctcgctggacctatgcccgtcaccgccgcctctgctgcccagagacgcggccggattgggagaaaccagaataaggagggagatcagtacatctatatgggccaacccctgaacaatgacgaagatcacgcgcattggacagaggctaaaatgcttctggacaacattaatacccctgaggggatcatccccgccctctttgaacctgagcgcgaaaagagcgccgctattgatggagagtacagactgcggggcgaagcccgcaagacattcgtggagctgatgagaagaggggacctcccggtctggctttcctataaagtggcgagcgagggctttcagtactctgatcgcagatggtgcttcgacggagaacggaacaatcaggttctggaggaaaacatggacgtggagatctggaccaaggaaggcgagcgcaaaaagctgcgcccccggtggctcgatgccagaacatattccgaccctctggcccttcgcgagtttaaagagttcgccgctgggcggagaagcgtgtccggagatctgattctcgagatcggcaagctgccccagcacctgaccctccgggcccaaaatgctcttgacaacctggtcatgctgcacaattctgaacaagggggaaaagcctaccgccatgcgatggaggaactccctgatacgattgagacactgatgcttctggccctcatcgctgttctgaccggcggcgtgaccctgtttttcctcagcgggaagggacttggcaagacatccatcgggctgctgtgtgtgatggcctctagcgtcctcctgtggatggcttccgtggagccccactggattgccgccagcatcattcttgaatttttcctgatggttctcctgatcccggagcctgacagacagcggacaccccaggataaccaactggcttatgtggtcattggactcctttttatgatcctgacagtggcggccaacgaaatgggcctgctcgagacgaccaaaaaggacctggggatcggacatgtcgtggctgagaatcaccaccatgccacaatgcttgatattgacctgcaccctgcctctgcttggaccctctacgccgttgcgacaaccatcattacgcccatgatgcgccataccatcgaaaacacaaccgccaatatttccctgacagctatcgccaaccaggctgccattctgatgggcctcgataaaggctggcctatcagcaagatggacatcggggtgccccttctggcgctgggatgctactctcaggtcaatccgctcaccctgacggccgctgtgcttatgctggttgcccactatgctattatcggccctgggctccaagccaaagctacaagagaggcccagaagcggaccgcggccggaattatgaagaaccccacagtggatggcatcgtcgctattgacctggaccccgtggtgtacgatgccaaattcgaaaagcagctggggcagatcatgctccttatcctgtgtacctcccaaattctgctcatgcgcaccacatgggctctgtgcgagagcatcacgcttgccaccggacctctgacaaccctctgggaaggctctccgggcaaattttggaatacaaccattgccgttagcatggcgaacatcttcagagggtcctatctggctggagccggcctggctttctctctcatgaagtcccttgggggaggccggcgcgggacgggagcccagggcgagacactgggcgagaaatggaagagacagctgaatcagctctccaagagcgaatttaacacctacaaacggtccgggattatggaggtcgacagatctgaagccaaggagggactgaaacgcggcgaaaccacaaagcatgctgtgagccgggggaccgccaaacttagatggttcgtggagcgcaatctggtcaagcccgagggaaaggttatcgatctcggctgtgggcggggaggctggtcctattactgcgcgggcctgaaaaaggtgacagaagtgaaagggtatacgaagggaggccctgggcacgaggaacccatccctatggccacctacggatggaacattgtcaaactgcactctggcagagacgtgtttttcacaccccctgagaagtgtgataccctcctttgcgacatcggggaaagctccccgaatcccacaattgaggagggacgcaccctgcgggttctgaaaatggtggaaccttggctcagaggcaaccaattttgtatcaagattctgaatccctacatgccttctgtcgtggagacgcttgaacagatgcagcgcaagcatggcgggatgctggttcggaaccccctcagcagaaattccacccacgagatgtattgggtgagctgcggaacaggcaacatcgtctctgctgtgaacatgacctcccgcatgctgctgaatcggttcacaatggcccatagaaaaccgacctacgagcgcgatgtggacctcggggctggaacaagacacgtcgccgttgaacctgagattgcgaacctggatatcatcggccagcggattgaaaatatcaagaacgagcacaaaagcacctggcattatgacgaagataatccctacaagacgtgggcctatcacgggtcttacgaggtgaaaccctccggaagcgcttcttccatggtgaacggcgtcgtgcgccttctgacaaagccttgggacgttattcccatggtgacccaaatcgccatgaccgacacaacgccttttggccagcagagagtcttcaaggagaaagtggatacccggacaccgagacccaagcgggggaccgctcaaattatggaagttacagccaaatggctctggggatttctgagccgcaataagaaacctagaatctgtacccgggaggagttcacacgcaaggtgagatccaacgctgccatcggcgcggtctttgtggacgagaatcagtggaacagcgccaaggaagctgttgaggatgagcggttctgggaccttgtgcatcgcgaaagagagctgcacaaacaggggaagtgcgctacctgcgtctataatatgatgggaaaacgggaaaagaaactcggcgagtttgggaaggccaagggctctcgcgccatttggtacatgtggctgggagccagattcctggagttcgaggcgctcggctttatgaacgaggatcattggttcagccgggaaaattccctgtctggggtggagggagaaggccttcacaaactggggtacatcctccgcgacattagcaagatccccggaggcaacatgtatgctgatgacacggccgggtgggataccagaattacagaggacgatctgcagaatgaggccaaaatcaccgacatcatggaacctgagcacgcccttctggccacatccatttttaagctcacctaccaaaacaaagtcgtgcgggttcagcgccccgctaagtctggcacggtgatggatgtcatcagcagacgggaccagagaggatccggccaggtggggacatatggactgaacaccttcacaaatatggaagtgcaactgattcgccagatggagtctgaaggcatctttagcccgtccgagctcgagaacagcaatctggccgaacgggttcttgactggctggagaaacatggggtggaaagactcaagcgcatggcgatttctggagatgactgtgtcgtgaagcctaccgatgaccggttcgccacggctctgaccgcccttaacgatatgggcaaagttagaaaggacatcccccagtgggagccttccaaagggtggaatgattggcagcaagtgcccttttgcagccaccatttccaccagctgatcatgaaggacggccgcgaaattgtcgtgccttgtcggaaccaggatgagctcgtcggacgggctcgcgtgtctcagggcgccgggtggtccctgcgggagacagcgtgcctgggaaaaagctacgcccaaatgtggcagctcatgtattttcacagacgcgacctgcggcttgctgccaatgctatctgttccgccgttcccgtgaactgggtcccgacctctagaacaacctggagcattcatgctcaccatcagtggatgacaaccgaagatatgctgtccgtgtggaatcgggtttggatcgaggaaaacccttggatggaggacaagacgcacgtgagctcttgggaagacgtcccctacctcggcaagagagaggatcaatggtgcgggtccctgattggacttacagcccgcgcgacctgggccaccaatatccaggtggctattaaccaggtgcggagactgatcggcaatgagaactatctcgactacatgacaagcatgaaacgcttcaagaatgaatctgatcccgagggggccctgtggtga

SEQ ID NO: 19459 - RNA, 9879 nt, synthetic construct
  misc_feature 1..9879: note = derived and/or modified CDS sequence (opt5) from DENV-1__KM403593__SS-prME
  source 1..9879: mol_type = other RNA
agcgtgaccatgctgctcatgctgcttcccaccgctctggctttccacctcacgacccggggcggggagcctcatatgatcgtctccaagcaggaacggggaaaatctctgctttttaagacaagcgctggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtggctcagaacggacggctcatcaccgccaatcccattgtgacagataaagagaagcctgttaacatcgaaacggagccgcccttcggcgagtcctatattgtcatcggggccggagaaaaagctctgaagctgagctggtttaagaaaggctctagcattgggaagatgttcgaggccaccgctagaggcgcccgccggatggcgatcctcggagacacagcctgggattttggctccatcgggggagtgttcacctctgtgggcaaactggtccatcaggtgtttgggacagcttacggagttcttttcagcggcgtgtcctggaccatgaagattgggatcggcattctgctcacgtggctgggactgaatagcagatctacctcccttagcatgacatgtatcgccgtcggcatggtgaccctctacctgggggttatggtgcaggctgactctggatgcgtcattaactggaaaggccgcgaactgaagtgtgggtccggaatctttgtgacaaacgaggttcacacctggacagaacaatataagttccaggccgatagccctaaacggctctccgcggccattggcaaggcttgggaggagggggtgtgcggcatcagatctgccacccgcctggaaaatatcatgtggaaacagattagcaacgagcttaatcatatcctgctcgaaaacgacatgaagtttacggtcgtggtgggagacgctaatggcattctgacacaggggaaaaagatgatccggccgcaacccatggagcacaaatactcctggaagtcttggggaaaggccaaaattatcggcgccgatacccagaacaccacattcatcattgacgggcctgatacccccgaatgtcctgacgatcagagagcttggaatatctgggaggtcgaggactatggatttggcgttttcacgacaaacatttggctgaaacttcgcgatagctacacccagatgtgcgaccaccggctcatgtccgcggccatcaaagatagcaaggctgtgcatgccgacatgggctattggattgaatctgagaaaaatgaaacatggaagctggccagagcttcctttatcgaggtgaagacctgtatctggccccgcagccacacactgtggtctaacggggtcctcgaatccgagatgattatcccgaaaatttacggaggccctatcagccaacataattatcggcccgggtacttcacccagacggccggaccttggcacctgggcaaacttgagctggatttcaacctctgcgaagggaccacagtggttgtggacgagcactgcggaaatagaggcccctctctgcggaccacaaccgtcacgggcaaaattatccatgaatggtgttgccgcagctgtacactgcctccccttagatttagaggggaagatggatgctggtacggcatggagatcagaccggtgaaggaaaaagaggaaaacctcgttcgctccatggtgagcgcggggtctggagaggtcgactccttcagcctgggcctgctctgtgtgtccattatgatcgaagaggttatgcggtctagatggagccgcaagatgctgatgaccgggacacttgctgtgtttttcctgctcattatgggacagctgacctggaatgacctgatcagactttgcattatggtcggcgccaacgtgtccgatcggatgggcatggggaccacatatctggccctcatggctacgtttaagatgcgccctatgttcgccgtgggactgctctttagacggctgacctctcgcgaggtccttctgctcacaatcggcctgagcctggttgcgtccgtggaacttcccaactctctggaggaactcggggacggactggctatgggcattatgatgctcaaactgcttaccgatttccaaagccaccagctgtggacaaccctcctgtccctgacgtttatcaagacaacccttagcctggactacgcctggaaaaccatggccatggtgctctctatcgtctccctgttccccctctgtctgagcacaacctctcagaagacaacgtggcttcctgtgctgctggggtcctttggatgcaaaccgctcaccatgttcctgattacagagaataagatctggggcagaaagagctggccccttaacgaaggcattatggctgttgggatcgtgtctattctgctctccagcctgctcaaaaatgatgtccctctggccggaccccttatcgctggcgggatgctgatcgcctgttatgtgatttccggaagctctgcggacctgagcctcgagcgggccgctgaggtttcctgggaagaggaagccgagcattctggcgctagccacaacatcctggtggaagtccaggatgacgggaccatgaagattaaagatgaggagcgcgacgatacacttaccatcctgctcaaggccacgctgctcgccgtgtccggagtctaccctatgtctattcccgctaccctgtttgtgtggtatttctggcagaagaagaaacagagaagcggcgttctttgggacacacctagccctcccgaagtggagcgggcggtcctggatgacggcatctaccgcatcctgcagagagggctcctgggacggtctcaggtgggcgttggggtgttccaagacggagtctttcataccatgtggcacgtgacaagaggcgccgtgcttatgtatcaggggaagcgcctggaacccagctgggcttccgttaagaaagatctcattagctacggaggcggctggcggttccaggggtcttggaataccggagaggaggtccaggtgatcgccgtggaacccggcaagaaccctaaaaatgtccaaacaacgcccgggacctttaagacaccggagggagaagtgggcgccattgctctggacttcaaacctgggacctccggaagccccatcgttaacagagagggcaagattgtgggcctctacgggaatggagtcgtgaccacatctggcacgtatgtttccgccatcgcgcaggctaaggccagccaggaagggcctctgcccgagattgaggatgaagtgtttaaaaagcgcaaccttaccatcatggacctgcaccccggatccggcaaaacacggagatacctgcctgccatcgtccgcgaggctattaagcggaaactcagaaccctgatccttgccccgacacgcgtggttgcgtctgaaatggctgaggccctgaaggggatgcccattcggtatcaaaccacggccgtgaagtccgaacatacaggcaaagagatcgtcgatctcatgtgccacgctaccttcaccatgagactgctgtcccctgtgcgggtgcccaattacaacatgattatcatggacgaggcccattttacagatcctgctagcatcgccgcgcgcggatatatttctaccagagtcggcatgggggaagccgctgccatcttcatgacagctacaccccctggatccgttgaggcctttccgcagagcaatgccgtgattcaggacgaagaacgggatatccccgaacgctcttggaacagcggctacgactggattacggatttccctgggaagacagtgtggtttgtcccctccatcaaatctggaaatgacatcgctaactgtctcagaaagaacggcaaacgggtgattcagcttagcagaaagaccttcgacacagagtatcaaaagaccaaaaataacgattgggactacgttgtgacgaccgatatctccgagatgggggcgaatttccgcgccgaccgggtcattgatcctagacgctgcctgaagcccgtgatcctgaaagacggcccggaacgggttattctcgctggacctatgcccgtgacagccgcctctgctgcccagagacgcggccggatcgggagaaaccagaataaggagggagatcagtacatttatatgggccaacccctgaacaatgacgaagatcacgcgcattggaccgaggctaaaatgcttctggacaacatcaatacacctgaggggatcattcccgccctctttgaacctgagcgcgaaaagagcgccgctatcgatggagagtacagactgcggggcgaagcccgcaagaccttcgtcgagctgatgagaagaggggacctcccggtgtggctttcctataaagtcgcgagcgagggctttcagtactctgatcgcagatggtgcttcgacggagaacggaacaatcaggtgctggaggaaaacatggacgttgagatttggacaaaggaaggcgagcgcaagaagctgcgcccccggtggctcgatgccagaacctattccgaccctctggcccttcgcgagtttaaagagttcgccgctgggcggagaagcgtgtccggagatctgatcctcgagattggcaagctgccccagcacctgacgctccgggcccaaaatgctcttgacaacctggtgatgctgcacaattctgaacaagggggaaaagcctaccgccatgcgatggaggaactccctgatacaatcgagaccctgatgcttctggccctcatcgctgtcctgaccggcggcgttacactgtttttcctcagcgggaagggacttggcaagacctccattgggctgctgtgtgtgatggcctctagcgtgctcctgtggatggcttccgtcgagccccactggatcgccgccagcattatccttgaatttttcctgatggtgctcctgattccggagcctgacagacagcggacaccccaggataaccaactggcttatgttgtgatcggactcctttttatgatcctgacggtcgcggccaacgaaatgggcctgctcgagaccaccaagaaggacctggggattggacatgtggtcgctgagaatcaccaccatgccaccatgcttgatatcgacctgcaccctgcctctgcttggacactctacgccgtggcgaccacgattatcacccccatgatgcgccatacaattgaaaacaccacagccaatatctccctgaccgctattgccaaccaggctgccatcctgatgggcctcgataaaggctggcctatcagcaagatggacattggggttccccttctggcgctgggatgctactctcaggtgaatccgctcacgctgacagccgctgtccttatgctggtggcccactatgctatcattggccctgggctccaagccaaagctaccagagaggcccagaagcggacagcggccggaatcatgaagaaccccaccgttgatggcattgtggctatcgacctggaccccgtcgtgtacgatgccaaattcgaaaagcagctggggcagatcatgctccttattctgtgtacctcccaaatcctgctcatgcgcacaacgtgggctctgtgcgagagcattacccttgccacaggacctctgaccacactctgggaaggctctccgggcaaattttggaataccacgatcgccgtgagcatggcgaacattttcagagggtcctatctggctggagccggcctggctttctctctcatgaaaagccttgggggaggccggcgcgggacaggagcccagggcgagaccctgggcgagaaatggaagagacagctgaatcagctctccaagagcgaatttaacacctacaaacggtccgggatcatggaggttgacagatctgaagccaaggagggactgaaacgcggcgaaacaaccaagcatgctgtcagccgggggacagccaaacttagatggttcgtggagcgcaatctggtgaagcccgagggaaaggtcatcgatctcggctgtgggcggggaggctggtcctattactgcgcgggcctgaaaaaggttacggaagtgaaagggtataccaagggaggccctgggcacgaggaacccattcctatggccacatacggatggaacatcgtgaaactgcactctggcagagacgtctttttcacaccccctgagaagtgtgataccctcctttgcgacattggggaaagctccccgaatcccaccatcgaggagggacgcacgctgcgggtgctgaaaatggttgaaccttggctcagaggcaaccaattttgtattaagatcctgaatccctacatgccttctgtggtcgagacccttgaacagatgcagcgcaagcatggcgggatgctggtgcggaaccccctcagcagaaattccacacacgagatgtattgggttagctgcggaaccggcaacattgtgtctgctgtcaacatgacatcccgcatgctgctgaatcggttcaccatggcccatagaaaaccgacatacgagcgcgatgtggacctcggggctggaaccagacacgtggccgtcgaacctgagatcgcgaacctggatatcattggccagcggatcgaaaatattaagaacgagcacaaaagcacgtggcattatgacgaagataatccctacaagacatgggcctatcacgggtcttacgaggttaaaccctccggaagcgcttcttccatggtgaacggcgtggtccgccttctgaccaagccttgggacgtgatccccatggttacccaaattgccatgacagacacgaccccttttggccagcagagagtgttcaaggagaaagtcgatacacggaccccgagacccaagcgggggacagctcaaatcatggaagtgaccgccaaatggctctggggatttctgagccgcaataagaaacctagaatctgtacacgggaggagttcacccgcaaggttagatccaacgctgccattggcgcggtgtttgtcgacgagaatcagtggaacagcgccaaggaagctgtggaggatgagcggttctgggaccttgttcatcgcgaaagagagctgcacaaacaggggaagtgcgccacgtgcgtgtataatatgatgggaaaacgggaaaagaaactcggcgagtttgggaaggctaagggctctcgcgccatctggtacatgtggctgggagccagattcctggagttcgaggcgctcggctttatgaacgaggatcattggttcagccgggaaaattccctgtctggggtcgagggagaaggccttcacaaactggggtacattctccgcgacatcagcaagattcccggaggcaacatgtatgctgatgacaccgccgggtgggatacaagaatcaccgaggacgatctgcagaatgaggccaaaatcacagacattatggaacctgagcacgcccttctggccacctccatctttaagctcacgtaccaaaacaaagtggtccgggtgcagcgccccgctaagtctggcacagttatggatgtgattagcagacgggaccagagaggatccggccaggtcgggacctatggactgaacacattcaccaatatggaagtgcaactgatccgccagatggagtctgaaggcatttttagcccgtccgagctcgagaacagcaatctggccgaacgggtgcttgactggctggagaaacatggggttgaaagactcaagcgcatggcgatctctggagatgactgtgtggtcaagcctacggatgaccggttcgccaccgctctgacagcccttaacgatatgggcaaagtgagaaaggacatcccccagtgggagccttccaaagggtggaatgattggcagcaagttcccttttgcagccaccatttccaccagctgattatgaaggacggccgcgaaatcgtggtcccttgtcggaaccaggatgagctcgtgggacgggctcgcgtctctcagggcgccgggtggtccctgcgggagaccgcgtgcctgggaaaaagctacgcccaaatgtggcagctcatgtattttcacagacgcgacctgcggcttgctgccaatgctatttgttccgccgtgcccgttaactgggtgccgacatctagaaccacatggagcatccatgctcaccatcagtggatgaccacggaagatatgctgtccgtctggaatcgggtgtggattgaggaaaacccttggatggaggacaagacacacgttagctcttgggaagacgtgccctacctcggcaagagagaggatcaatggtgcgggtccctgatcggacttaccgcccgcgcgacctgggccacaaatattcaggtcgctatcaaccaggtgcggagactgatcggcaatgagaactatctcgactacatgaccagcatgaaacgcttcaagaatgaatctgatcccgagggggccctgtggtga

SEQ ID NO: 19460 - RNA, 9879 nt, synthetic construct
  misc_feature 1..9879: note = derived and/or modified CDS sequence (opt5) from DENV-1__KM403603__SS-prME
  source 1..9879: mol_type = other RNA
agcgtgaccatgctgctcatgctgcttcccacagccctggctttccacctcacgacccggggcggggagcctcatatgattgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaaacgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccaaggaaggcgagcgcaagaagctgcgcccccggtggctcgatgcgagaacgtattccgaccctctggcccttcgcgagtttaaagagttcgctgccgggcggagaagcgtgtccggagatctgatcctcgagattggcaagctgccccagcacctgacactccgggctcaaaatgcccttgacaacctggtgatgctgcacaattctgaacaagggggaaaggcttaccgccatgccatggaggaactccctgataccatcgagaccctgatgcttctggcgctcatcgccgtcctgacaggcggcgttaccctgtttttcctcagcgggaagggacttggcaagacatccattgggctgctgtgtgtgatggcttctagcgtgctcctgtggatggcctccgtcgagccccactggatcgctgccagcattatccttgaatttttcctgatggtgctcctgattccggagcctgacagacagcggacgccccaggataaccaactggcctatgttgtgatcggactcctttttatgatcctgaccgtcgctgcgaacgaaatgggcctgctcgagacaaccaaaaaggacctggggattggacatgtggtcgccgagaatcaccaccatgctacaatgcttgatatcgacctgcaccctgcctctgcctggaccctctacgctgtggccacgaccattatcacacccatgatgcgccataccattgaaaacacaaccgcgaatatctccctgacggccattgctaaccaggccgctatcctgatgggcctcgataaaggctggcctatcagcaagatggacattggggttccccttctggccctgggatgctactctcaggtgaatccgctcacactgaccgcggccgtccttatgctggtggctcactatgccatcattggccctgggctccaagctaaagccacaagagaggctcagaagcggaccgccgcgggaatcatgaagaaccccaccgttgatggcattgtggccatcgacctggaccccgtcgtgtacgatgctaaattcgaaaagcagctggggcagatcatgctccttattctgtgtacatcccaaatcctgctcatgcgcacgacctgggccctgtgcgagagcattacacttgctaccggacctctgacaaccctctgggaaggctctccgggcaaattttggaatacgacaatcgccgtgagcatggccaacattttcagagggtcctatctggcgggagctggcctggccttctctctcatgaagacccttgggggaggccggcgcgggaccggagctcagggcgagacactgggcgagaaatggaagagacagctgaatcagctcagcaagtccgaatttaacacctacaaacggagcgggatcatggaggttgacagatccgaagccaaggagggactgaaacgcggcgaaacaacgaagcatgccgtctctcgggggaccgctaaacttagatggttcgtggagcgcaatctggtgaagcccgagggaaaggtcatcgatctcggctgtgggcggggaggctggagctattactgcgccggcctgaaaaaggttacagaagtgaaagggtataccaagggaggccctgggcacgaggaacccattcctatggcgacatacggatggaacatcgtgaaactgcactccggcagagacgtctttttcacgccccctgagaagtgtgataccctcctttgcgacattggggaatctagcccgaatcccaccatcgaggagggacgcacactgcgggtgctgaaaatggttgaaccttggctcagaggcaaccaattttgtattaagatcctgaatccctacatgccttccgtggtcgagacccttgaacagatgcagcgcaagcatggcgggatgctggtgcggaaccccctctctagaaatagcacacacgagatgtattgggtttcctgcggaaccggcaacattgtgagcgccgtcaacatgacatctcgcatgctgctgaatcggttcaccatggctcatagaaaaccgacgtacgagcgcgatgtggacctcggggccggaacaagacacgtggctgtcgaacctgagatcgccaacctggatatcattggccagcggatcgaaaatattaagaacgagcacaaatccacctggcattatgacgaagataatccctacaagacctgggcgtatcacgggagctacgaggttaaaccctctggatccgccagctctatggtgaacggcgtggtccgccttctgacaaagccttgggacgtgatccccatggttacgcaaattgctatgaccgacacaaccccttttggccagcagagagtgttcaaggagaaagtcgatacacggaccccgagacccaagcgggggacagcccaaatcatggaagtgaccgctaaatggctctggggatttctgtcccgcaataagaaacctagaatctgtacgcgggaggagttcacccgcaaggttagaagcaacgccgctattggcgccgtgtttgtcgacgagaatcagtggaactccgcgaaggaagccgtggaggatgagcggttctgggaccttgttcatcgcgaaagagagctgcacaaacaggggaagtgcgctacatgcgtgtataatatgatgggaaaacgggaaaagaaactcggcgagtttgggaaggccaagggcagccgcgctatctggtacatgtggctgggagccagattcctggagttcgaggccctcggctttatgaacgaggatcattggttctctcgggaaaatagcctgtccggggtcgagggagaaggccttcacaaactggggtacattctccgcgacatctctaagattcccggaggcaacatgtatgcggatgacaccgctgggtgggatacaagaatcaccgaggacgatctgcagaatgaggccaaaatcacggacattatggaacctgagcacgcccttctggctacaagcatctttaagctcacctaccaaaacaaagtggtccgggtgcagcgccccgccaagtccggcacagttatggatgtgatttctagacgggaccagagaggaagcggccaggtcgggacctatggactgaacacgttcaccaatatggaagtgcaactgatccgccagatggagtccgaaggcatcttttctccgagcgagctcgagaactccaatctggctgaacgggtgcttgactggctggagaaacatggggttgaaagactcaagcgcatggccatcagcggagatgactgtgtggtcaagcctacagatgaccggttcgcgaccgccctgacagctcttaacgatatgggcaaagtgagaaaggacatcccccagtgggagccttctaaagggtggaatgattggcagcaagttcccttttgctcccaccatttccaccagctgattatgaaggacggccgcgaaatcgtggtcccttgtcggaaccaggatgagctcgtgggacgggcccgcgtcagccagggcgctgggtggtctctgcgggagaccgcctgcctgggaaaatcctacgcgcaaatgtggcagctcatgtattttcacagacgcgacctgcggcttgccgctaatgccatttgtagcgctgtgcccgttaactgggtgccgacatccagaaccacgtggtctatccatgcccaccatcagtggatgacaaccgaagatatgctgagcgtctggaatcgggtgtggattgaggaaaacccttggatggaggacaagacccacgtttccagctgggaagacgtgccctacctcggcaagagagaggatcaatggtgcgggtctctgatcggacttacagctcgcgccacctgggcgacaaatattcaggtcgccatcaaccaggtgcggagactgatcggcaatgagaactatctcgactacatgacgtccatgaaacgcttcaagaatgaaagcgatcccgagggggctctgtggtga

SEQ ID NO: 19461 - RNA, 9879 nt, synthetic construct
  misc_feature 1..9879: note = derived and/or modified CDS sequence (opt5) from DENV-1__KM403585__SS-prME
  source 1..9879: mol_type = other RNA
agcgtgaccatgctgctcatgctgcttcccacagctctggctttccacctcacgaccagaggcggggaacctcatatgatcgtgtccaagcaggaacggggaaagtctctgctttttaagacaagcgccggcgttaacatgtgcaccctgattgcgatggacctcggggaactgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgttgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggacggattgttcagtacgaaaacctgaagtattctgtgatcgtcacggtgcacaccggcgatcagcatcaagttgggaatgagacaaccgaacacggaacaatcgctaccattacgccccaggcccctacctccgaggtgcagctgacagactacggcgccctcaccctggactgtagcccccgcacaggccttgatttcaacgaaatggtcctgctcaccatgaaagagaagtcttggctggtgcataaacagtggtttcttgacctgcctctcccctggacgtccggggctagcacatcccaagagacctggaatagacaggatctgctggtcacattcaagaccgcgcacgccaaaaagcaggaagtggttgtgctcggatctcaagagggcgctatgcacaccgccctgacaggggccacggaaatccagaccagcggaacaaccacaatttttgctggccatcttaagtgccggctgaaaatggacaagctcaccctgaaaggggtctcctatgtgatgtgtacgggcagcttcaagctggagaaagaagttgccgagacacagcacggaaccgtgcttgtccaggtgaagtacgagggcaccgatgcgccgtgcaagatccctatttctacacaagacgaaaaaggggtgacccagaacggaagactcatcacagctaatcccatcgttacggataaggagaaacctgtcaacattgaaaccgagccgcccttcggcgagtcctatatcgtgattggggccggagaaaaggccctgaaactgagctggtttaagaagggctctagcatcgggaaaatgttcgaggctacagcccgcggcgctcggagaatggccattctcggagacaccgcgtgggattttggctccatcgggggagtgttcacatctgtcggcaagctggtgcatcaggtttttgggaccgcctacggagtgcttttcagcggcgtctcctggacgatgaaaatcgggattggcatcctgctcacctggctgggactgaatagccgctctacatcccttagcatgacctgtattgctgtgggcatggttacactctacctgggggtgatggtccaggccgactctggatgcgtgatcaactggaagggccgggaactgaaatgtgggtccggaatttttgttaccaacgaggtgcacacatggaccgaacaatataagttccaggctgatagccctaagagactctccgccgcgatcggcaaagcctgggaggagggggtctgcggcattcgctctgctacgcggctggaaaatatcatgtggaagcagatcagcaacgagcttaatcatattctgctcgaaaacgacatgaaatttacagtggtggtcggagacgcctacggcatcctgacccaggggaagaaaatgattagaccgcaacccatggagcacaagtattcctggaaatcttggggaaaggctaagatcattggcgccgatacccagaatacaaccttcatcatcgacgggcctgatacgcccgaatgtcctgacgatcagcgcgcctggaacatttgggaggttgaggactacggatttggcgtgttcacaaccaatatctggctgaaacttcgggatagctatacacagatgtgcgaccacagactcatgtccgctgcgattaaggatagcaaagccgtgcatgctgacatgggctactggatcgaatctgagaagaacgaaacctggaaactggcccgcgcctcctttattgaggtcaagacatgtatctggccccggagccacaccctgtggtctaatggggtgctcgaatccgagatgatcattccgaagatctatggaggccctattagccaacataactacagacccgggtacttcacgcagaccgctggaccttggcacctgggcaaacttgagctggatttcaatctctgcgaagggacaaccgttgtggtcgacgagcactgcggaaaccggggcccctctctgcgcacaaccacggtgacaggcaagatcattcatgaatggtgttgcagaagctgtaccctgcctccccttcggtttagaggggaggatggatgctggtatggcatggagatccgcccggttaaagaaaaggaggaaaatctcgtgcggtccatggtcagcgccgggtctggagaggtggactccttcagcctgggcctgctctgtgtttccatcatgattgaagaggtgatgagatctcgctggagcagaaaaatgctgatgacagggacccttgcggtctttttcctgctcatcatgggacagctgacctggaacgacctgattcggctttgcatcatggtgggcgctaatgtgtccgatcgcatgggcatggggacaacgtacctggccctcatggccacctttaagatgagacctatgttcgctgtcggactgctctttcggcgcctgacatctagagaggttcttctgctcaccattggcctgagcctggtggcctccgtggaacttcccaactctctggaggaactcggggacggactggcgatgggcatcatgatgctcaagctgcttacagatttccaaagccaccagctgtggaccacgctcctgtccctgacatttattaaaaccacccttagcctggactatgcttggaagacaatggccatggtcctctctatcgtgtccctgttccccctctgtctgagcaccacatctcagaaaacgacctggcttcctgttctgctggggtcctttggatgcaagccgctcacaatgttcctgatcaccgagaacaaaatttggggccggaagtcctggccccttaatgaaggcatcatggccgtggggattgtctctatcctgctctccagcctgctcaagaacgatgtgcctctggctggaccccttattgccggcgggatgctgatcgcttgttacgttatctccggaagctctgccgacctgagcctcgagcgcgcggccgaggtgtcctgggaagaggaagctgagcattctggcgccagccacaatattctggtcgaagtgcaggatgacgggacaatgaaaatcaaggatgaggagagagacgatacccttacgattctgctcaaagctaccctgctcgccgtctccggagtgtatcctatgtctatccccgccacactgtttgtttggtacttctggcaaaagaaaaagcagcggagcggcgtgctttgggacacccctagccctcccgaagtcgagcgcgctgtgctggatgacggcatttatagaatcctgcagcgggggctcctgggaagatctcaggttggcgtgggggtcttccaagacggagtgtttcatacaatgtggcacgtgacccgcggcgcggttcttatgtaccaggggaaacggctggaacccagctgggcctccgtcaagaaggatctcatcagctacggaggcggctggagattccaggggtcttggaacacaggagaggaggtccaggtgattgctgtcgaacccggcaaaaatcctaagaacgtgcaaacgacccccgggacatttaaaaccccggagggagaagttggcgccatcgccctggacttcaagcctgggacctccggaagccccattgtgaatcgcgagggcaaaatcgtcggcctctatgggaacggagtggttacaacgtctggcacctacgtgtccgctattgcccaggcgaaggctagccaggaagggcctctgcccgagatcgaggatgaagtctttaagaaacggaatcttacaattatggacctgcaccccggatccggcaagaccagacgctatctgcctgccatcgtgcgggaggccatcaaaagaaagctccgcacactgattcttgctccgacccgggttgtggcctctgaaatggcggaggctctgaaagggatgcccatcagataccaaacgacagccgtcaagagcgaacataccggcaaggagattgtggatctcatgtgccacgccaccttcacaatgcggctgctgtcccctgtgcgcgtccccaactataatatgatcattatggacgaggctcattttaccgatcctgccagcatcgctgccagaggatacatctctacacgggttggcatgggggaagcggccgctattttcatgaccgccacgccccctggatccgtggaggcttttccgcagagcaacgccgtgatccaggacgaagaacgcgatattcccgaaagatcttggaatagcggctatgactggatcacagatttccctgggaaaaccgtctggtttgtgccctccattaagtctggaaacgacatcgccaattgtctccggaaaaacggcaagagagttatccagcttagccgcaaaacattcgacaccgagtaccaaaagacgaagaacaatgattgggactacgtggtcaccacagatatttccgagatgggggctaacttccgggcggacagagtgatcgatcctcgccggtgcctgaaacccgttattctgaaggacggcccggaaagagtgatcctcgccggacctatgcccgtcaccgctgcctctgccgctcagcgccggggcagaattgggcgcaatcagaacaaagagggagatcagtatatctacatgggccaacccctgaataacgacgaagatcacgcccattggacagaggcgaagatgcttctggacaatattaacacccctgaggggatcatccccgctctctttgaacctgagagagaaaagagcgccgccattgatggagagtatcggctgcgcggcgaggctagaaagacattcgtggagctgatgcggcgcggggacctcccggtctggctttcctacaaggtggccagcgagggctttcagtattctgatagacggtggtgcttcgacggagaaagaaataaccaggttctggaggaaaatatggacgtggagatctggaccaaagaaggcgagcgcaagaaactgcggcccagatggctcgatgcgcgcacgtactccgaccctctggcccttcgggagtttaaggagttcgctgccgggagacggagcgtgtccggagatctgattctcgagatcggcaaactgccccagcacctgacactccgcgctcaaaacgcccttgacaatctggtcatgctgcacaactctgaacaagggggaaaggcttatagacatgccatggaggaactccctgataccattgagaccctgatgcttctggcgctcatcgccgttctgacaggcggcgtgaccctgtttttcctcagcgggaaaggacttggcaagacatccatcgggctgctgtgtgtgatggcttctagcgtcctcctgtggatggcctccgtggagccccactggattgctgccagcatcattcttgaatttttcctgatggttctcctgatcccggagcctgaccggcagcgcacgccccaggataatcaactggcctacgtggtcattggactcctttttatgatcctgaccgtggctgcgaacgaaatgggcctgctcgagacaaccaagaaagacctggggatcggacatgtcgtggccgagaaccaccaccatgctacaatgcttgatattgacctgcaccctgcctctgcctggaccctctacgctgttgccacgaccatcattacacccatgatgagacataccatcgaaaatacaaccgcgaacatttccctgacggccatcgctaatcaggccgctattctgatgggcctcgataagggctggcctatcagcaaaatggacatcggggtgccccttctggccctgggatgctattctcaggtcaacccgctcacactgaccgcggccgtgcttatgctggttgctcactacgccattatcggccctgggctccaagctaaggccacacgggaggctcagaaacgcaccgccgcgggaattatgaagaatcccaccgtggatggcatcgtcgccattgacctggaccccgtggtgtatgatgctaagttcgaaaaacagctggggcagatcatgctccttatcctgtgtacatcccaaattctgctcatgagaacgacctgggccctgtgcgagagcatcacacttgctaccggacctctgacaaccctctgggaaggctctccgggccggttttggaacacgacaattgccgttagcatggccaatatcttccgcgggtcctacctggcgggagctggcctggccttctctctcatgaaaagccttgggggaggcagacgggggaccggagctcagggcgagaccctgggcgagaaatggaagagacagctgaaccagctctccaaaagcgaatttaatacatataagcgctccgggattgtcgaggtggaccggtctgaagccaaggagggaatgaaaagaggcgaaaccacaaagcatgccgtgagccgcgggacggctaaactgcggtggttcgtcgagagaaaccttgttaagcccgagggaaaagtgatcgatctgggctgtgggcgcggaggctggtcctactattgcgccggcctcaagaaggtgaccgaagtcaaagggtacacaaagggaggccctgggcacgaggaacccatccctatggcgacctacggatggaatattgtgaaactgcactctggccgggacgtctttttcacaccccctgagaagtgtgataccctgctctgcgacatcggggaaagctccccgaaccccacgattgaggagggaagaacccttcgcgtgctgaaaatggtcgaaccttggctgcggggcaatcaattttgtatcaagattctcaacccctatatgccttctgtggttgagacactggaacagatgcagagaaaacatggcgggatgcttgtgcgcaatcccctgagccggaactccacccacgagatgtactgggtcagctgcggaacaggcaatatcgtgtctgccgtgaacatgacctccagaatgctcctgaaccgcttcacaatggctcatagaaagccgacctatgagcgggatgtcgacctgggggccggaacgcgccacgttgctgtggaacctgagattgccaatctcgatatcatcggccagagaattgaaaacatcaagaatgagcacaaaagcacatggcattacgacgaagataacccctataagacctgggcgtaccacgggtcttatgaggtgaaaccctccggaagcgcctcttccatggtcaatggcgtggttcggctgcttaccaagccttgggacgtgattcccatggtcacacaaatcgctatgacggacaccacaccttttggccagcagagagtgttcaaagagaaggttgatacccggacaccgcgccccaagagagggaccgcccaaattatggaagtgacagctaaatggctgtggggatttctcagccggaacaagaaacctcgcatctgtaccagagaggagttcacgcggaaggtccgctccaatgccgctatcggcgccgtgtttgttgacgagaaccagtggaatagcgcgaaagaagccgtggaggatgagagattctgggacctggtccatcgggaacgcgagcttcacaagcaggggaagtgcgctacctgcgtgtacaacatgatgggaaaaagagaaaagaaactgggcgagtttgggaaggccaaaggctctcgggctatttggtacatgtggctcggagcccgcttcctggagttcgaggccctgggctttatgaatgaggatcattggttcagcagagaaaactccctctctggggtcgagggagaaggcctgcacaaacttgggtatatcctgcgggacattagcaagatccccggaggcaatatgtacgcggatgacacagctgggtgggatacccgcattacagaggacgatctccagaacgaggccaaaatcaccgacatcatggaacctgagcacgccctgcttgctacgtccatttttaagctgacatatcaaaataaagtggttagagtgcagcggcccgccaagtctggcaccgtcatggatgtgatcagcagacgcgaccagcggggatccggccaggtggggacatacggactcaacaccttcacgaacatggaagttcaactgattagacagatggagtctgaaggcatctttagcccgtccgagctggagaatagcaacctcgctgaacgcgtgctggactggcttgagaaacatggggtcgaacggctgaagagaatggccatttctggagatgactgtgtggttaaacctaccgatgaccgcttcgcgacagccctcaccgctctgaatgatatgggcaaggtgcggaaggacatcccccagtgggagccttccaaagggtggaacgattggcagcaagtccccttttgcagccaccatttccaccagcttatcatgaaggacggcagagaaattgtggtcccttgtcgcaatcaggatgagctggtgggacgggccagagtttctcagggcgctgggtggtccctccgcgagacagcctgcctgggaaaaagctatgcgcaaatgtggcagctgatgtactttcaccggagagacctccggctggccgctaacgccatctgttccgctgtgcccgtcaattgggtgccgacctctagaacaacctggagcattcatgcccaccatcagtggatgacgacagaagatatgctttccgtttggaaccgcgtgtggatcgaggaaaatccttggatggaggacaagacccacgtcagctcttgggaagacgtgccctatctgggcaaacgggaggatcaatggtgcgggtccctcattggactgaccgctagagccacatgggcgaccaacatccaggtggccattaatcaggttcgcagacttatcggcaacgagaattacctggactacatgacaagcatgaagcggttcaagaacgaatctgatcccgagggggctctctggtga

SEQ ID NO: 19462 - RNA, 9879 nt, synthetic construct
  misc_feature 1..9879: note = derived and/or modified CDS sequence (opt5) from DENV-1__KM403595__SS-prME
  source 1..9879: mol_type = other RNA
agcgtgaccatgctgctcatgctgcttcccacagctctggctttccacctcacgacccggggcggggaacctcatatgatcgtctccaagcaggaacggggaaaatctctgctttttaagaccagcgccggcgttaacatgtgcaccctgattgcgatggacctcggggaactgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggaccgcagatctgtcgccctggctcctcatgtggggctcggactggagacacggaccgaaacgtggatgagctccgagggcgcctggcgccagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaagaccgaggtcacaaaccctgccgttcttcggaaactgtgcattgaagcgaagatctctaataccacgacagactcccgctgtccgacccaaggagaggccaccctcgtggaagaacaagatgctaacttcgtgtgcagacggacatttgtcgaccgcggctggggcaatgggtgtggactgttcggcaaagggagccttctgacctgcgccaagtttaaatgcgtgacaaagctcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaggagaaatcttggctggtccataagcagtggtttcttgacctgcctctcccctggacgtccggggctagcacatcccaagagacctggaatcggcaggatctgctggtgacattcaaaaccgcgcacgccaagaaacaggaagtcgtggttctcggatctcaagagggcgctatgcacaccgccctgacaggggccacggaaattcagaccagcggaacaaccacaatctttgctggccatcttaagtgcagactgaagatggacaaactcaccctgaagggggtgtcctatgtcatgtgtacgggcagcttcaaactggagaaggaagtggccgagacacagcacggaaccgttcttgtgcaggtcaaatacgagggcaccgatgcgccgtgcaagattcctatctctacacaagacgaaaagggggtgacccagaacggacgcctcatcacagctaatcccattgtgacggataaagagaagcctgttaacatcgaaattgagccgcccttcggcgagtcctatatcgtcattggggccggagaaaaagccctgaagctgagctggtttaaaaagggctctagcatcgggaagatgttcgaggctaccgcccggggcgctagacgcatggccatcctcggagacacagcgtgggattttggctccattgggggagtgttcacctctgtgggcaaactggtccatcaggtgtttgggacagcctacggagttcttttcagcggcgtgtcctggaccatgaagatcgggattggcatcctgctcacgtggctgggactgaatagccggtctacctcccttagcatgacatgtattgctgtcggcatggtgaccctctacctgggggttatggtgcaggccgactctggatgcgtcatcaactggaaaggcagagaactgaagtgtgggtccggaatttttgtgacaaacgaggttcacacctggacagaacaatataaattccaggctgatagccctaagcgcctctccgccgcgatcggcaaggcctgggaggagggggtgtgcggcatccggtctgctaccagactggaaaatattatgtggaaacagatcagcaacgagcttaatcatattctgctcgaaaacgacatgaagtttacggtcgtggtgggagacgccaatggcatcctgacacaggggaaaaagatgattcgcccgcaacccatggagcacaaatactcctggaagtcttggggaaaagctaagatcatcggcgccgatacccagaacaccacattcattatcgacgggcctgatacccccgaatgtcctgacgatcagcgggcctggaatatttgggaggtcgaggactatggatttggcgttttcacgacaaacatctggctgaaacttagagatagctacacccagatgtgcgaccaccgcctcatgtccgctgcgattaaagatagcaaggccgtgcatgctgacatgggctattggatcgaatctgagaaaaatgaaacatggaagctggcccgggcctcctttatcgaggtgaaaacctgtatttggcccagaagccacacactgtggtctaacggggtcctcgaatccgagatgatcattccgaagatctacggaggccctattagccaacataattatcggcccgggtacttcacccagacggctggaccttggcacctgggcaaacttgagctggatttcaacctctgcgaagggaccacagtggttgtggacgagcactgcggaaatcgcggcccctctctgagaaccacaaccgtcacgggcaaaatcatccatgaatggtgttgccggagctgtacactgcctccccttagatttcgcggggaggatggatgctggtacggcatggagattcggccggtgaaggaaaaagaggaaaacctcgttagatccatggtgagcgccgggtctggagaggtcgactccttcagcctgggcctgctctgtgtgtccatcatgattgaagaggttatgcgctctagatggagccggaagatgctgatgaccgggacacttgcgatctttttcctgctcattatgggacagctgacctggaatgacctgatccgcctttgcattatggtgggcgctaacgtctccgatagaatgggcatggggaccacatatctggccctcatggccacgtttaaaatgcggcctatgttcgctgtgggactgctctttcgcagactgacctctcgggaggtgcttctgctcacaatcggcctgagcctggtcgcctccgttgaacttcccaactctctggaggaactcggggacggactggcgatgggcatcatgatgctcaagctgcttaccgatttccaaagccaccagctgtggacaaccctcctgtccctgacgtttattaagacaacccttagcctggactacgcttggaaaaccatggccatggtgctctctatcgtgtccctgttccccctctgtctgagcacaacctctcagaagacaacgtggcttcctgtcctgctggggtcctttggatgcaaaccgctcaccatgttcctgattacagagaataagatctggggccgcaaaagctggccccttaacgaaggcattatggccgtggggatcgtttctatcctgctctccagcctgctcaagaatgatgtgcctctggctggaccccttattgccggcgggatgctgatcgcttgttatgtcatttccggaagctctgccgacctgagcctcgagagagcggccgaggtgtcctgggaagaggaagctgagcattctggcgccagccacaacatcctggttgaagtgcaggatgacgggaccatgaagattaaagatgaggagcgggacgatacacttaccatcctgctcaaggctacgctgctcgccgtctccggagtgtaccctatgtctatccccgccaccctgtttgtctggtatttctggcagaagaagaaacagcgcagcggcgtgctttgggacacacctagccctcccgaagttgagagagctgtgctggatgacggcatttaccggatcctgcagagagggctcctgggacgctctcaggtcggcgtgggggttttccaagacggagtgtttcataccatgtggcacgtcacacggggcgcggtgcttatgtatcaggggaaaagactggaacccagctgggcctccgtgaaaaaggatctcattagctacggaggcggctggcgcttccaggggtcttggaataccggagaggaggttcaggtcatcgctgtggaacccggcaagaaccctaaaaatgtgcaaacaacgcccgggacctttaagacaccggagggagaagtcggcgccattgccctggacttcaaacctgggacctccggaagccccatcgtgaaccgggagggcaagattgttggcctctacgggaatggagtggtcaccacatctggcacgtatgtgtccgctatcgcccaggcgaaagctagccaggaagggcctctgcccgagatcgaggatgaagtttttaagaagagaaaccttaccattatggacctgcaccccggatccggcaaaacacgccggtacctgcctgccatcgtgagagaggccattaagcgcaaactccggaccctgatccttgctccgacaagagtcgtggcctctgaaatggcggaggctctgaaggggatgcccattcggtatcaaaccacggccgttaaaagcgaacatacaggcaaggagatcgtggatctcatgtgccacgccaccttcaccatgcgcctgctgtcccctgtcagagtgcccaattacaacatgatcattatggacgaggctcattttacagatcctgccagcatcgctgcccggggatatatttctacccgcgtgggcatgggggaagcggccgctatcttcatgacagccacaccccctggatccgtcgaggcttttccgcagagcaatgccgttattcaggacgaagagagagatatccccgaacggtcttggaacagcggctacgactggatcacggatttccctgggaagacagtgtggtttgtgccctccattaaatctggaaatgacatcgccaactgtctcagaaagaacggcaaacgcgtcattcagcttagccggaagaccttcgacacagagtatcagaagaccaagaataacgattgggactacgtggttacgaccgatatctccgagatgggggctaatttcagagcggaccgcgtgattgatcctcggagatgcctgaagcccgtcatcctgaaagacggcccggaacgcgtgattctcgccggacctatgcccgttacagctgcctctgccgctcagcggagaggccgcatcgggagaaaccagaataaggagggagatcagtacatctatatgggccaacccctgaacaatgacgaagatcacgcccattggaccgaggcgaaaatgcttctggacaacattaatacacctgaggggatcattcccgctctctttgaacctgagcgggaaaagagcgccgccatcgatggagagtaccgcctgagaggcgaagctcggaaaaccttcgtggagctgatgcgcagaggggacctcccggtctggctttcctataaggtggccagcgagggctttcagtactctgatcggagatggtgcttcgacggagaacgcaacaatcaggtcctggaggaaaacatggacgtggagatttggacaaaggaaggcgagcggaaaaagctgagaccccgctggctcgatgcgcggacctattccgaccctctggcccttagagagtttaaagagttcgctgccgggcggcgcagcgtttccggagatctgatcctcgagatcggcaagctgccccagcacctgacgctcagagctcaaaatgcccttgacaacctggtgatgctgcacaattctgaacaagggggaaaggcttaccggcatgccatggaggaactccctgatacaattgagaccctgatgcttctggcgctcatcgccgtgctgaccggcggcgtcacactgtttttcctcagcgggaagggacttggcaaaacctccattgggctgctgtgtgttatggcttctagcgtgctcctgtggatggcctccgtggagccccactggatcgctgccagcattatccttgaatttttcctgatggtcctcctgatcccggagcctgaccgccagagaacaccccaggataaccaactggcctatgtggttattggactcctttttatgatcctgacggtggctgcgaacgaaatgggcctgctcgagaccacaaagaaggacctggggattggacatgtcgtggccgagaatcaccaccatgctaccatgcttgatatcgacctgcaccctgcctctgcctggacactctacgctgtcgccaccacgattatcacccccatgatgcggcatacaattgaaaacaccacagcgaatatctccctgaccgccatcgctaaccaggccgctattctgatgggcctcgataaaggctggcctatcagcaagatggacattggggtgccccttctggccctgggatgctactctcaggttaatccgctcacgctgacagcggccgtgcttatgctggtcgctcactatgccatcattggccctgggctccaagctaaagccacccgcgaggctcagaagagaacagccgcgggaatcatgaaaaaccccaccgtggatggcatcgttgccattgacctggaccccgtggtctacgatgctaagttcgaaaagcagctggggcagatcatgctccttattctgtgtacctcccaaatcctgctcatgcggacaacgtgggccctgtgcgagagcattacccttgctacaggacctctgaccacactctgggaaggctctccgggcaaattttggaataccacgatcgccgtgagcatggccaacatcttccgcgggtcctatctggcgggagctggcctggccttctctctcatgaagtcccttgggggaggcagacgggggacaggagctcagggcgagaccctgggcgagaaatggaagagacagctgaatcagctctccaaaagcgaatttaacacctacaagcgctccgggattatggaggtggaccggtctgaagccaaggagggactgaaaagaggcgaaacaaccaagcatgccgttagccgcgggacagctaaacttcggtggttcgtcgagagaaatctggtgaagcccgagggaaaagtgatcgatctcggctgtgggcgcggaggctggtcctattactgcgccggcctgaagaaggtcacggaagttaaagggtataccaagggaggccctgggcacgaggaacccattcctatggcgacatacggatggaacatcgtgaaactgcactctggccgggacgtgtttttcacaccccctgagaagtgtgataccctcctttgcgacattggggaaagctccccgaatcccaccatcgaggagggaagaacgctgcgcgtcctgaaaatggtggaaccttggctccggggcaaccaattttgtattaagatcctgaatccctacatgccttctgttgtggagacccttgaacagatgcagagaaaacatggcgggatgctggtccgcaaccccctcagcagaaattccacacacgagatgtattgggtgagctgcggaaccggcaacatcgtttctgccgtgaacatgacatccagaatgctgctgaatcgcttcaccatggctcatagaaagccgacatacgagcgggatgtcgacctcggggccggaacccgccacgtggctgtggaacctgagacggccaacctggatattatcggccagagaattgaaaatatcaagaacgagcacaaaagcacatggcattatgacgaagataatccctacaagacctgggcgtatcacgggtcttacgaggtcaaaccctccggaagcgcctcttccatggttaacggcgtggtgcggcttctgaccaagccttgggacgtcattcccatggtgacacaaatcgctatgacggacaccacaccttttggccagcagagagttttcaaagagaaggtggatacccggacaccgcgccccaagagagggaccgcccaaatcatggaagtcacagctaaatggctctggggatttctgagccggaataagaaacctcgcatttgtaccagagaggagttcacgcggaaggtgcgctccaacgccgctatcggcgccgtttttgtggacgagaatcagtggaacagcgcgaaagaagccgtcgaggatgagagattctgggaccttgtgcatcgggaacgcgagctgcacaagcaggggaagtgcgctacctgcgtttataatatgatgggaaaaagagaaaagaaactcggcgagtttgggaaggccaaaggctctcgggctatttggtacatgtggctgggagcccgcttcctggagttcgaggccctcggctttatgaacgaggatcattggttcagcagagaaaattccctgtctggggtggagggagaaggccttcacaagctggggtacatcctccgggacattagcaagatccccggaggcaacatgtatgcggatgacacagctgggtgggatacccgcatcacagaggacgatctgcagaatgaggccaaaattaccgacatcatggaacctgagcacgcccttctggctacgtccatttttaagctcacataccaaaacaaagtcgtgagagtccagcggcccgccaagtctggcaccgtgatggatgttatcagcagacgcgaccagcggggatccggccaggtggggacatatggactgaacaccttcacgaatatggaagtccaactgattagacagatggagtctgaaggcatctttagcccgtccgagctcgagaacagcaatctggctgaacgcgtgcttgactggctggagaaacatggggtggaacggctcaagagaatggccatctctggagatgactgtgttgtgaaacctaccgatgaccgcttcgcgacagccctgaccgctcttaacgatatgggcaaggtccggaaggacattccccagtgggagccttccaaagggtggaatgattggcagcaagtgcccttttgcagccaccatttccaccagctgatcatgaaggacggcagagaaattgttgtgccttgtcgcaaccaggatgagctcgtcggacgggccagagtgtctcagggcgctgggtggtccctgcgcgagacagcctgcctgggaaaaagctacgcgcaaatgtggcagctcatgtattttcaccggagagacctgcggcttgccgctaatgccatctgttccgctgtccccgtgaactgggttccgacctctagaacaacctggagcattcatgcccaccatcagtggatgacgacagaagatatgctgtccgtgtggaatcgcgtctggatcgaggaaaacccttggatggaggacaagacccacgtgagctcttgggaagacgttccctacctcggcaaacgggaggatcaatggtgcgggtccctgattggacttaccgctagagccacatgggcgaccaatatccaggtggccatcaaccaggtccgcagactgattggcaatgagaactatctcgactacatgacaagcatgaagcggttcaagaatgaatctgatcccgagggggctctgtggtga

SEQ ID NO: 19463 - RNA, 9879 nt, synthetic construct
  misc_feature 1..9879: note = derived and/or modified CDS sequence (opt5) from DENV-1__KM403604__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaagtctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacagggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccacaagcaatggtttcttgacctgcctctcccctggacgtccggggctagcacatcccaggagacctggaatcgccaggatctgctggtgacattcaaaaccgcgcatgccaagaagcaagaagtcgtggttctcggatctcaggagggcgctatgcacaccgccctgacaggggccacggaaattcagaccagcggaacaaccacaatctttgctggccaccttaaatgcagactgaagatggacaaactcaccctgaagggggtgtcctatgtcatgtgtacgggcagcttcaaactggagaaggaagtggccgagacacagcatggaaccgttcttgtgcaagtcaagtacgagggcaccgatgcgccgtgcaaaattcctatctctacacaggacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccaccaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaagccgactctggatgcgtcattaactggaaaggccgcgaactgaagtgtgggtccggaatctttgtgaccaacgaggttcatacatggaccgaacagtataagttccaggctgatagccctaaacggctctccgccgcgattggcaaggcctgggaggagggggtgtgcggcatcagatctgctacgcgcctggaaaatatcatgtggaaacagattagcaacgagcttaatcacatcctgctcgaaaacgacatgaagtttacagtcgtggtgggagacgccaatggcattctgacccaagggaaaaagatgatccggccgcagcccatggagcataaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacaaatgtgcgaccaccggctcatgtccgctgcgatcaaagatagcaaggccgtgcacgctgacatgggctattggattgaatctgagaaaaatgaaacctggaagctggccagagcctcctttatcgaggtgaagacatgtatctggccccgcagccataccctgtggtctaacggggtcctcgaatccgagatgattatcccgaaaatttacggaggccctatcagccagcacaattatcggcccgggtacttcacgcagaccgctggaccttggcatctgggcaaacttgagctggatttcaacctctgcgaagggacaaccgtggttgtggacgagcactgcggaaatagaggcccctctctgcggacaaccacggtcacaggcaaaattatccacgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacaactgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccagagccatcagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcactctggcgccagccataacatcctggtggaagtccaagatgacgggacaatgaagattaaagatgaggagcgcgacgatacccttacgatcctgctcaaggctaccctgctcgccgtgtccggagtctaccctatgtctattcccgccacactgtttgtgtggtatttctggcagaaaaagaaacagagaagcggcgttctttgggacacccctagccctcccgaagtggagcgggctgtcctggatgacggcatctaccgcatcctgcagagagggctcctgggacggtctcaagtgggcgttggggtgttccaggacggagtctttcacacaatgtggcatgtgaccagaggcgcggtgcttatgtatcaggggaagcgcctggaacccagctgggcctccgttaagaaagatctcattagctacggaggcggctggcggttccaggggtcttggaatacaggagaggaggtccaagtgatcgctgtggaacccggcaagaaccctaaaaatgtccagacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaagaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcagacgacagccgtgaagtccgaacacaccggcaaagagatcgtcgatctcatgtgccatgccaccttcacaatgagactgctgtcccctgtgcgggtgcccaattacaacatgattatcatggacgaggctcactttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcaacttagcagaaagacattcgacaccgagtatcagaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcaatacatttatatgggccagcccctgaacaatgacgaagatcatgcccactggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccaaggaaggcgagcgcaagaagctgcgcccccggtggctcgatgcgagaacgtattccgaccctctggcccttcgcgagtttaaagagttcgctgccgggcggagaagcgtgtccggagatctgatcctcgagattggcaagctgccccaacatctgacactccgggctcagaatgcccttgacaacctggtgatgctgcacaattctgaacaagggggaaaggcttaccgccacgccatggaggaactccctgataccatcgagaccctgatgcttctggcgctcatcgccgtcctgacaggcggcgttaccctgtttttcctcagcgggaagggacttggcaagacatccattgggctgctgtgtgtgatggcttctagcgtgctcctgtggatggcctccgtcgagccccattggatcgctgccagcattatccttgaatttttcctgatggtgctcctgattccggagcctgacagacagcggacgccccaagataaccagctggcctatgttgtgatcggactcctttttatgatcctgaccgtcgctgcgaacgaaatgggcctgctcgagacaaccaaaaaggacctggggattggacacgtggtcgccgagaatcatcaccacgctacaatgcttgatatcgacctgcatcctgcctctgcctggaccctctacgctgtggccacgaccattatcacacccatgatgcgccacaccattgaaaacacaaccgcgaatatctccctgacggccattgctaaccaggccgctatcctgatgggcctcgataaaggctggcctatcagcaagatggacattggggttccccttctggccctgggatgctactctcaagtgaatccgctcacactgaccgcggccgtccttatgctggtggctcattatgccatcattggccctgggctccaggctaaagccacaagagaggctcagaagcggaccgccgcgggaatcatgaagaaccccaccgttgatggcattgtggccatcgacctggaccccgtcgtgtacgatgctaaattcgaaaagcagctggggcaaatcatgctccttattctgtgtacatcccagatcctgctcatgcgcacgacctgggccctgtgcgagagcattacacttgctaccggacctctgacaaccctctgggaaggctctccgggcaaattttggaatacgacaatcgccgtgagcatggccaacattttcagagggtcctatctggcgggagctggcctggccttctctctcatgaaaagccttgggggaggccggcgcgggaccggagctcagggcgagaccctgggcgagaaatggaagagacagctgaatcaactctccaagagcgaatttaacacatacaaacggtccgggatcatggaggttgacagatctgaagccaaggagggactgaaacgcggcgaaaccacaaagcacgccgtcagccgggggacggctaaacttagatggttcgtggagcgcaatctggtgaagcccgagggaaaggtcatcgatctcggctgtgggcggggaggctggtcctattactgcgccggcctgaaaaaggttaccgaagtgaaagggtatacaaagggaggccctgggcatgaggaacccattcctatggcgacctacggatggaacatcgtgaaactgcactctggcagagacgtctttttcacaccccctgagaagtgtgataccctcctttgcgacattggggaaagctccccgaatcccacgatcgaggagggacgcaccctgcgggtgctgaaaatggttgaaccttggctcagaggcaaccagttttgtattaagatcctgaatccctacatgccttctgtggtcgagacacttgaacagatgcagcgcaagcacggcgggatgctggtgcggaaccccctcagcagaaattccacccatgagatgtattgggttagctgcggaacaggcaacattgtgtctgccgtcaacatgacctcccgcatgctgctgaatcggttcacaatggctcacagaaaaccgacctacgagcgcgatgtggacctcggggccggaacgagacatgtggctgtcgaacctgagatcgccaacctggatatcattggccaacggatcgaaaatattaagaacgagcacaaaagcacatggcactatgacgaagataatccctacaagacctgggcgtatcatgggtcttacgaggttaaaccctccggaagcgcctcttccatggtgaacggcgtggtccgccttctgaccaagccttgggacgtgatccccatggttacacagattgctatgacggacaccacaccttttggccagcaaagagtgttcaaggagaaagtcgatacccggacaccgagacccaagcgggggaccgcccagatcatggaagtgacagctaaatggctctggggatttctgagccgcaataagaaacctagaatctgtacccgggaggagttcacgcgcaaggttagatccaacgccgctattggcgccgtgtttgtcgacgagaatcagtggaacagcgcgaaggaagccgtggaggatgagcggttctgggaccttgttcaccgcgaaagagagctgcataaacaggggaagtgcgctacctgcgtgtataatatgatgggaaaacgggaaaagaaactcggcgagtttgggaaggccaagggctctcgcgctatctggtacatgtggctgggagccagattcctggagttcgaggccctcggctttatgaacgaggatcactggttcagccgggaaaattccctgtctggggtcgagggagaaggccttcataaactggggtacattctccgcgacatcagcaagattcccggaggcaacatgtatgcggatgacacagctgggtgggataccagaatcacagaggacgatctgcaaaatgaggccaaaatcaccgacattatggaacctgagcacgcccttctggctacgtccatctttaagctcacataccagaacaaagtggtccgggtgcagcgccccgccaagtctggcaccgttatggatgtgattagcagacgggaccagagaggatccggccaagtcgggacatatggactgaacaccttcacgaatatggaagtgcagctgatccgccagatggagtctgaaggcatttttagcccgtccgagctcgagaacagcaatctggctgaacgggtgcttgactggctggagaaacacggggttgaaagactcaagcgcatggccatctctggagatgactgtgtggtcaagcctaccgatgaccggttcgcgacagccctgatcgctcttaacgatatgggcaaagtgagaaaggacattccccagtgggagccttccaaagggtggaatgattggcaacaggttcccttttgcagccatcacttccatcagctgatcatgaaggacggccgcgaaattgtggtcccttgtcggaaccaggatgagctcgtgggacgggcccgcgtctctcaaggcgctgggtggtccctgcgggagaccgcctgcctgggaaaaagctacgcgcagatgtggcagctcatgtattttcacagacgcgacctgcggcttgccgctaatgccatctgttccgctgtgcccgttaactgggtgccgacatctagaaccacatggagcattcacgcccatcaccaatggatgaccacggaagatatgctgtccgtctggaatcgggtgtggatcgaggaaaacccttggatggaggacaagacacatgttagctcttgggaagacgtgccctacctcggcaagagagaggatcagtggtgcgggtccctgattggacttaccgctcgcgccacctgggcgacaaatatccaggtcgccatcaaccaggtgcggagactgattggcaatgagaactatctcgactacatgaccagcatgaaacgcttcaagaatgaatctgatcccgagggggctctgtggtga

SEQ ID NO: 19464 - RNA, 9879 nt, synthetic construct
  misc_feature 1..9879: note = derived and/or modified CDS sequence (opt5) from DENV-1__KM403588__SS-prME
  source 1..9879: mol_type = other RNA
agcgtgaccatgctgctcatgctgcttcccaccgctctggctttccacctcacgacccggggaggggaacctcatatgatcgtgtccaagcaggaacggggaaaatctctgctttttaagaccagcgctggcgttaacatgtgcaccctgattgcgatggacctcggggaactgtgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggggaaactcaccctgaagggcgtgtcctatgtcatgtgtacgggatccttcaaactggagaaggaagtggccgagacacagcacggcaccgttcttgtgcaggtcaagtacgaggggaccgacgcgccgtgcaaaattcctatctctacacaagatgaaaagggagtgacccagaacggccggctcatcacagctaatcccattgtgacggacaaagagaagcctgttaacatcgaaaccgagccgcccttcggggagtcctatattgtcatcggagccggcgaaaaagccctgaagctgagctggtttaagaaagggtctagcattggcaagatgttcgaggctacagccagaggagctcgccggatggccatcctcggcgatatcgcgtgggactttgggtccattggaggcgtgttcacctctgtggggaaactggtccatcaggtgtttggaacagcctacggcgttcttttcagcggggtgtcctggaccatgaagatcggcattggaatcctgctcacgtggctgggcctgaatagcagatctacctcccttagcatgacatgtattgctgtcgggatggtgaccctctacctgggagttatggtgcaggccgattctggctgcgtcatcaactggaaagggcgcgaactgaagtgtggatccggcatttttgtgacaaacgaggttcacacctggacagaacaatataagttccaggctgacagccctaaacggctctccgccgcgatcgggaaggcctgggaggagggcgtgtgcggaatcagatctgctacccgcctggaaaatattatgtggaaacagatcagcaacgagcttaatcatattctgctcgaaaacgatatgaagtttacggtcgtggtgggcgacgccaatgggatcctgacacagggcaagaagatgattcggccgcaacccatggagcacaaatactcctggaagtcttggggcaaggctaaaatcatcggggccgacacccagaacaccacattcattatcgatggacctgacacccccgaatgtcctgatgaccagagagcctggaatatttgggaggtcgaggattatggctttggcgttttcacgacaaacatctggctgaaacttcgcgacagctacacccagatgtgcgatcaccggctcatgtccgctgcgattagagacagcaaagccgtgcatgctgatatggggtattggatcgaatctgagaagaatgaaacatggaaactggcccgcgcctcctttatcgaggtgaagacctgtatttggccccggagccacacactgtggtctaacggagtcctcgaatccgagatgatcattccgaagatctacggcgggcctattagccaacataattatagacccggatacttcacccagacggctggcccttggcacctggggaaacttgagctggacttcaacctctgcgaaggaaccacagtggttgtggatgagcactgcggcaatcggggcccctctctgcgcaccacaaccgtcacggggaagatcatccatgaatggtgttgcagaagctgtacactgcctccccttcggtttagaggagaggacggctgctggtacgggatggagattcgcccggtgaaagaaaaggaggaaaacctcgttcggtccatggtgagcgccggatctggcgaggtcgattccttcagcctggggctgctctgtgtgtccatcatgattgaagaggttatgagatctcgctggagcagaaaaatgctgatgaccggaacacttgcggtgtttttcctgctcatcatgggccagctgacctggaatgacctgattcggctttgcatcatggtcggcgctaacgtgtccgaccgcatggggatgggaaccacatatctggccctcatggccacgtttaagatgagacctatgttcgctgtgggcctgctctttcggcgcctgacctctagagaggtccttctgctcacaattgggctgagcctggttgcctccgtggaacttcccaactctctggaggaactcggagatggcctggcgatggggatcatgatgctcaagctgcttaccgacttccaaagccaccagctgtggacaaccctcctgtccctgacgtttatcaaaacaacccttagcctggattacgcttggaagaccatggccatggtgctctctattgtctccctgttccccctctgtctgagcacaacctctcagaaaacaacgtggcttcctgtgctgctgggatcctttggctgcaagccgctcaccatgttcctgatcacagagaataaaatttggggcagaaagagctggccccttaacgaagggatcatggccgttggaattgtgtctatcctgctctccagcctgctcaagaatgacgtccctctggctggcccccttatcgccgggggaatgctgattgcttgttatgtgatctccggcagctctgccgatctgagcctcgagcgcgcggccgaggtttcctgggaagaggaagctgagcattctggggccagccacaacattctggtggaagtccaggacgatggaaccatgaaaatcaaggacgaggagagagatgacacacttaccattctgctcaaagctacgctgctcgccgtgtccggcgtctaccctatgtctatccccgccaccctgtttgtgtggtatttctggcaaaagaaaaagcagcggagcggcgttctttgggatacacctagccctcccgaagtggagcgcgctgtcctggacgatgggatctaccggattctgcagcggggactcctgggcagatctcaggtgggggttggagtgttccaagacggcgtctttcataccatgtggcacgtgacacgcggggcggtgcttatgtatcagggaaaacggctggaacccagctgggcctccgttaagaaggacctcatcagctacggcggcgggtggagattccagggatcttggaataccggcgaggaggtccaggtgattgctgtggaacccgggaaaaaccctaagaatgtccaaacaacgcccggaacctttaaaacaccggagggcgaagtgggggccatcgccctggatttcaagcctggaacctccggcagccccattgttaaccgcgagggcaaaatcgtggggctctacggaaatggcgtcgtgaccacatctgggacgtatgtttccgctattgcccaggcgaaggctagccaggaaggacctctgcccgagatcgaggacgaagtgtttaagaaacggaaccttaccatcatggatctgcaccccggctccgggaagacaagacgctacctgcctgccattgtccgggaggccatcaaaagaaagctccgcaccctgattcttgctccgacacgggtggttgcctctgaaatggcggaggctctgaaaggcatgcccatcagatatcaaaccacggccgtcaagagcgaacatacaggaaaggagattgtcgacctcatgtgccacgccaccttcaccatgcggctgctgtcccctgtgcgcgtgcccaattacaacatgatcatcatggatgaggctcattttacagaccctgccagcattgctgccagaggctatatctctacccgggtcgggatgggagaagcggccgctattttcatgacagccacaccccctggctccgttgaggcttttccgcagagcaatgccgtgatccaggatgaagaacgcgacattcccgaaagatcttggaacagcgggtacgattggatcacggacttccctggaaaaacagtgtggtttgtcccctccatcaagtctggcaatgatattgccaactgtctccggaaaaacgggaagagagtgatccagcttagccgcaaaaccttcgacacagagtatcaaaagaccaagaataacgactgggattacgttgtgacgaccgacatttccgagatgggcgctaatttccgggcggatagagtcatcgaccctcgccggtgcctgaaacccgtgattctgaaggatggaccggaaagagttatcctcgccggccctatgcccgtggctgccgcctctgctgcccagcgccgggggagaattggacgcaaccagaataaagagggcgaccagtacatctatatggggcaacccctgaacaatgatgaagaccacgcgcattggacagaggctaagatgcttctggataacatcaatacccctgagggaattatccccgccctctttgaacctgagagagaaaagagcgccgctattgacggcgagtaccggctgcgcggggaggccagaaagacattcgtcgagctgatgcggcgcggcgatctcccggtgtggctttcctataaggtcgcgagcgagggatttcagtactctgacagacggtggtgcttcgatggcgaaagaaacaatcaggtgctggaggaaaacatggacgttgagatctggaccaaagaaggggagcgcaagaaactgcggcccagatggctcgacgcccgcacatattccgatcctctggcccttcgggagtttaaggagttcgccgctggaagacggagcgtgtccggcgacctgattctcgagatcgggaaactgccccagcacctgaccctccgcgcccaaaatgctcttgataacctggtgatgctgcacaattctgaacagggaggcaaggcctacagacatgcgatggaggaactccctgacacgatcgagacactgatgcttctggccctcattgctgtcctgaccggcggggttaccctgtttttcctcagcggaaaaggccttgggaagacatccatcggactgctgtgtgtgatggcctctagcgtgctcctgtggatggcttccgtcgagccccactggattgccgccagcatcattcttgaatttttcctgatggtgctcctgatcccggagcctgatcggcagcgcacaccccaggacaaccaactggcttatgttgtgatcggcctcctttttatgattctgacagtcgcggccaacgaaatggggctgctcgagacgaccaagaaagatctgggaatcggccatgtggtcgctgagaatcaccaccatgccacaatgcttgacattgatctgcaccctgcctctgcttggaccctctacgccgtggcgacaaccatcattacgcccatgatgagacataccatcgaaaacacaaccgccaatatttccctgacagctatcgccaaccaggctgccatcctgatgggcctcgacaaggggtggcctattagcaaaatggatatcggagttccccttctggcgctgggctgctactctcaggtgaatccgctcaccctgacggccgctgtccttatgctggtggcccactatgctattatcgggcctggactccaagccaaggctacacgggaggcccagaaacgcaccgcggccggcattatgaagaaccccacagttgacgggatcgtggctatcgatctggaccccgtcgtgtacgacgccaagttcgaaaaacagctgggacagattatgctccttatcctgtgtacctcccaaattctgctcatgagaaccacatgggctctgtgcgagagcatcacgcttgccaccggccctctgacaaccctctgggaaggctctccggggaagttttggaatacaaccattgccgtgagcatggcgaacatcttccggggatcctatctggctggcgccgggctggctttctctctcatgaaaagccttggaggcgggcgcagaggaacgggcgcccagggcgagacactgggggagaagtggaaacggcagctgaatcagctctccaagagcgaatttaacacctacaagagatccggaatcatggaggttgatcgctctgaagccaaagagggcctgaagagaggggaaaccacaaaacatgctgtcagcagaggaaccgccaaacttcgctggttcgtggagcggaatctggtgaaacccgagggcaaggtcattgacctcgggtgtggaagaggcggctggtcctattactgcgcggggctgaagaaagttacagaagtgaagggatatacgaaaggcgggcctggacacgaggaacccatccctatggccacctacggctggaacattgtgaagctgcactctgggcgcgatgtctttttcacaccccctgagaaatgtgacaccctcctttgcgatatcggagaaagctccccgaatcccacaattgaggagggccggaccctgagagtgctgaagatggttgaaccttggctccgcggcaaccaattttgtatcaaaattctgaatccctacatgccttctgtggtcgagacgcttgaacagatgcagcggaagcatgggggaatgctggtgagaaaccccctcagccgcaattccacccacgagatgtattgggttagctgcggcacagggaacatcgtgtctgctgtcaacatgacctcccggatgctgctgaatagattcacaatggcccatcgcaagccgacctacgagagagacgtggatctcggagctggcacacggcacgtggccgtcgaacctgagatcgcgaacctggacattatcgggcagcgcattgaaaatatcaaaaacgagcacaagagcacctggcattatgatgaagacaatccctacaaaacgtgggcctatcacggatcttacgaggttaagccctccggcagcgcttcttccatggtgaacggcgtggtcagacttctgacaaaaccttgggatgtgattcccatggttacccaaatcgccatgaccgacacaacgccttttgggcagcagcgggtgttcaaggagaaggtcgacaccagaacaccgcggcccaaacgcggaaccgctcaaatcatggaagtgacagccaagtggctctggggctttctgagcagaaataaaaagcctcggatttgtacccgcgaggagttcacaagaaaagttcggtccaacgctgccatcggggcggtgtttgtcgatgagaatcagtggaacagcgccaaggaagctgtggaggacgagcgcttctgggatcttgttcatagagaacgggagctgcacaagcagggaaaatgcgctacctgcgtgtataatatgatgggcaagcgcgagaaaaagctcggggagtttggcaaagctaagggatctagagccatttggtacatgtggctgggcgcccggttcctggagttcgaggcgctcgggtttatgaacgaggaccattggttcagccgcgaaaattccctgtctggagtcgagggcgaagggcttcacaagctgggatacatcctcagagatattagcaaaatccccggcgggaacatgtatgctgacgatacggccggctgggacacccggatcacagaggatgacctgcagaatgaggccaagattaccgatatcatggaacctgagcacgcccttctggccacatccatttttaaactcacctaccaaaacaaggtggtccgcgtgcagagacccgctaaatctggaacggttatggacgtgatcagccggagagatcagcgcggctccgggcaggtcggaacatatggcctgaacaccttcacaaatatggaagtgcaactgattcggcagatggagtctgaagggatctttagcccgtccgagctcgagaacagcaatctggccgaaagagtgcttgactggctggagaagcatggagttgaacgcctcaaacggatggcgatctctggcgacgattgtgtggtcaagcctaccgacgatagattcgccacggctctgaccgcccttaacgacatggggaaggtgcgcaaagatattccccagtgggagccttccaagggctggaatgactggcagcaagttcccttttgcagccaccatttccaccagctgatcatgaaagatggacgggaaattgtggtcccttgtagaaaccaggacgagctcgtgggccgcgctcgggtctctcagggggccggatggtccctgagagagacagcgtgcctgggcaagagctacgcccaaatgtggcagctcatgtattttcaccgccgggatctgagacttgctgccaatgctatctgttccgccgtgcccgttaactgggtgccgacctctcggacaacctggagcattcatgctcaccatcagtggatgacaaccgaagacatgctgtccgtctggaatagagtgtggatcgaggaaaacccttggatggaggataaaacgcacgttagctcttgggaagacgtgccctacctcgggaagcgcgaggaccaatggtgcggatccctgattggccttacagcccgggcgacctgggccaccaatatccaggtcgctatcaaccaggtgagacgcctgattgggaatgagaactatctcgattacatgacaagcatgaagagattcaaaaatgaatctgaccccgagggcgccctgtggtga

SEQ ID NO: 19465 - RNA, 9879 nt, synthetic construct
  misc_feature 1..9879: note = derived and/or modified CDS sequence (opt5) from DENV-1__KM403605__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctatccaagacgaaaagggggtgacacagaacggacggctcattaccgctaatcccatcgtgacagataaagagaagcctgttaacattgaaacggagccgcccttcggcgagtcctatatcgtcattggggccggagaaaaagccctgaagctgagctggtttaagaaaggctctagcatcgggaagatgttcgaggctaccgccagaggcgctcgccggatggccatcctcggagacacagcgtgggattttggctccattgggggagtgttcacctctgtgggcaaactggtccatcaggtgtttgggacagcctacggagttcttttcagcggcgtgtcctggaccatgaagatcgggattggcatcctgctcacgtggctgggactgaatagcagatctacctcccttagcatgacatgtattgctgtcggcatggtgaccctctacctgggggttatggtgcaggccgactctggatgcgtcatcaactggaaaggccgcgaactgaagtgtgggtccggaatttttgtgacaaacgaggttcacacctggacagaacaatataagttccaggctgatagccctaaacggctctccgccgcgatcggcaaggcctgggaggagggggtgtgcggcatcagatctgctacccgcctggaaaatattatgtggaaacagatcagcaacgagcttaatcatattctgctcgaaaacgacatgaagtttacggtcgtggtgggagacgccaatggcatcctgacacaggggaaaaagatgattcggccgcaacccatggagcacaaatactcctggaagtcttggggaaaggctaaaatcatcggcgccgatacccagaacaccacattcattatcgacgggcctgatacccccgaatgtcctgacgatcagagagcctggaatatttgggaggtcgaggactatggatttggcgttttcacgacaaacatctggctgaaacttcgcgatagctacacccagatgtgcgaccaccggctcatgtccgctgcgattaaagatagcaaggccgtgcatgctgacatgggctattggatcgaatctgagaaaaatgaaacatggaagctggccagagcctcctttatcgaggtgaagacctgtatttggccccgcagccacacactgtggtctaacggggtcctcgaatccgagatgatcattccgaaaatctacggaggccctattagccaacataattatcggcccgggtacttcacccagacggctggaccttggcacctgggcaaacttgagctggatttcaacctctgcgaagggaccacagtggttgtggacgagcactgcggaaatagaggcccctctctgcggaccacaaccgtcacgggcaaaatcatccatgaatggtgttgccgcagctgtacactgcctccccttagatttagaggggaagatggatgctggtacggcatggagattagaccggtgaaggaaaaagaggaaaacctcgttcgctccatggtgagcgccgggtctggagaggtcgactccttcagcctgggcctgctctgtgtgtccatcatgattgaagaggttatgcggtctagatggagccgcaagatgctgatgaccgggacacttgcggtgtttttcctgctcatcatgggacagctgacctggaatgacctgattagactttgcatcatggtcggcgctaacgtgtccgatcggatgggcatggggaccacatatctggccctcatggccacgtttaagatgcgccctatgttcgctgtgggactgctctttagacggctgacctctcgcgaggtccttctgctcacaattggcctgagcctggttgcctccgtggaacttcccaactctctggaggaactcggggacggactggcgatgggcatcatgatgctcaaactgcttaccgatttccaaagccaccagctgtggacaaccctcctgtccctgacgtttatcaagacaacccttagcctggactacgcttggaaaaccatggccatggtgctctctattgtctccctgttccccctctgtctgagcacaacctctcagaagacaacgtggcttcctgtgctgctggggtcctttggatgcaaaccgctcaccatgttcctgatcacagagaataagatttggggcagaaagagctggccccttaacgaaggcatcatggccgttgggattgtgtctatcctgctctccagcctgctcaaaaatgatgtccctctggctggaccccttatcgccggcgggatgctgattgcttgttatgtgatctccggaagctctgccgacctgagcctcgagcgggcggccgaggtttcctgggaagaggaagctgagcattctggcgccagccacaacattctggtggaagtccaggatgacgggaccatgaagatcaaagatgaggagcgcgacgatacacttaccattctgctcaaggctacgctgctcgccgtgtccggagtctaccctatgtctatccccgccaccctgtttgtgtggtatttctggcagaagaagaaacagagaagcggcgttctttgggacacacctagccctcccgaagtggagcgggctgtcctggatgacggcatctaccgcattctgcagagagggctcctgggacggtctcaggtgggcgttggggtgttccaagacggagtctttcataccatgtggcacgtgacaagaggcgcggtgcttatgtatcaggggaaacgcctggaacccagctgggcctccgttaagaaagatctcatcagctacggaggcggctggcggttccaggggtcttggaataccggagaggaggtccaggtgattgctgtggaacccggcaagaaccctaaaaatgtccaaacaacgcccgggacctttaagacaccggagggagaagtgggcgccatcgccctggacttcaaacctgggacctccggaagccccattgttaacagagagggcaagatcgtgggcctctacgggaatggagtcgtgaccacatctggcacgtatgtttccgctattgcccaggcgaaggctagccaggaagggcctctgcccgagatcgaggatgaagtgtttaaaaagcgcaaccttaccatcatggacctgcaccccggatccggcaaaacacggagatacctgcctgccattgtccgcgaggccatcaagcggaaactcagaaccctgattcttgctccgacacgcgtggttgcctctgaaatggcggaggctctgaaggggatgcccatccggtatcaaaccacggccgtgaagtccgaacatacaggcaaagagattgtcgatctcatgtgccacgccaccttcaccatgagactgctgtcccctgtgcgggtgcccaattacaacatgatcatcatggacgaggctcattttacagatcctgccagcattgctgcccgcggatatatctctaccagagtcggcatgggggaagcggccgctattttcatgacagccacaccccctggatccgttgaggcttttccgcagagcaatgccgtgatccaggacgaagaacgggatattcccgaacgctcttggaacagcggctacgactggatcacggatttccctgggaagacagtgtggtttgtcccctccatcaaatctggaaatgacattgccaactgtctcagaaagaacggcaaacgggtgatccagcttagcagaaagaccttcgacacagagtatcaaaagaccaaaaataacgattgggactacgttgtgacgaccgatatttccgagatgggggctaatttccgcgcggaccgggtcatcgatcctagacgctgcctgaagcccgtgattctgaaagacggcccggaacgggttatcctcgccggacctatgcccgtgacagctgcctctgccgctcagagacgcggccggattgggagaaaccagaataaggagggagatcagtacatctatatgggccaacccctgaacaatgacgaagatcacgcccattggaccgaggcgaaaatgcttctggacaacatcaatacacctgaggggattatccccgctctctttgaacctgagcgcgaaaagagcgccgccattgatggagagtacagactgcggggcgaagctcgcaagaccttcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatctggacaaaggaaggcgagcgcaagaagctgcgcccccggtggctcgatgcgagaacctattccgaccctctggcccttcgcgagtttaaagagttcgctgccgggcggagaagcgtgtccggagatctgattctcgagatcggcaagctgccccagcacctgacgctccgggctcaaaatgcccttgacaacctggtgatgctgcacaattctgaacaagggggaaaggcttaccgccatgccatggaggaactccctgatacaatcgagaccctgatgcttctggcgctcattgccgtcctgaccggcggcgttacactgtttttcctcagcgggaagggacttggcaagacctccatcgggctgctgtgtgtgatggcttctagcgtgctcctgtggatggcctccgtcgagccccactggattgctgccagcatcattcttgaatttttcctgatggtgctcctgatcccggagcctgacagacagcggacaccccaggataaccaactggcctatgttgtgatcggactcctttttatgattctgacggtcgctgcgaacgaaatgggcctgctcgagaccaccaaaaaggacctggggatcggacatgtggtcgccgagaatcaccaccatgctaccatgcttgatattgacctgcaccctgcctctgcctggacactctacgctgtggccaccacgatcattacccccatgatgcgccatacaatcgaaaacaccacagcgaatatttccctgaccgccatcgctaaccaggccgctatcctgatgggcctcgataaaggctggcctattagcaagatggacatcggggttccccttctggccctgggatgctactctcaggtgaatccgctcacgctgacagcggccgtccttatgctggtggctcactatgccattatcggccctgggctccaagctaaagccaccagagaggctcagaagcggacagccgcgggaattatgaagaaccccaccgttgatggcatcgtggccatcgacctggaccccgtcgtgtacgatgctaaattcgaaaagcagctggggcagattatgctccttatcctgtgtacctcccaaattctgctcatgcgcacaacgtgggccctgtgcgagagcatcacccttgctacaggacctctgaccacactctgggaaggctctccgggcaaattttggaataccacgattgccgtgagcatggccaacatcttcagagggtcctatctggcgggagctggcctggccttctctctcatgaagacacttgggggaggccggcgcgggaccggagctcagggcgagaccctgggcgagaaatggaagagacagctgaatcagctcagcaagtccgaatttaacacatacaaacggagcgggatcatggaggttgacagatccgaagccaaggagggactgaaacgcggcgaaaccacaaagcatgccgtctctcgggggacggctaaacttagatggttcgtggagcgcaatctggtgaagcccgagggaaaggtcattgatctcggctgtgggcggggaggctggagctattactgcgccggcctgaaaaaggttaccgaagtgaaagggtatacaaagggaggccctgggcacgaggaacccatccctatggcgacctacggatggaacattgtgaaactgcactccggcagagacgtctttttcacaccccctgagaagtgtgataccctcctttgcgacatcggggaatctagcccgaatcccacgattgaggagggacgcaccctgcgggtgctgaaaatggttgaaccttggctcagaggcaaccaattttgtatcaagattctgaatccctacatgccttccgtggtcgagacacttgaacagatgcagcgcaagcatggcgggatgctggtgcggaaccccctctctagaaatagcacccacgagatgtattgggtttcctgcggaacaggcaacatcgtgagcgccgtcaacatgacctctcgcatgctgctgaatcggttcacaatggctcatagaaaaccgacctacgagcgcgatgtggacctcggggccggaacgagacacgtggctgtcgaacctgagatcgccaacctggatattatcggccagcggattgaaaatatcaagaacgagcacaaatccacatggcattatgacgaagataatccctacaagacctgggcgtatcacgggagctacgaggttaaaccctctggatccgccagctctatggtgaacggcgtggtccgccttctgaccaagccttgggacgtgattcccatggttacacaaatcgctatgacggacaccacaccttttggccagcagagagtgttcaaggagaaagtcgatacccggacaccgagacccaagcgggggaccgcccaaatcatggaagtgacagctaaatggctctggggatttctgtcccgcaataagaaacctagaatttgtacccgggaggagttcacgcgcaaggttagaagcaacgccgctatcggcgccgtgtttgtcgacgagaatcagtggaactccgcgaaggaagccgtggaggatgagcggttctgggaccttgttcatcgcgaaagagagctgcacaaacaggggaagtgcgctacctgcgtgtataatatgatgggaaaacgggaaaagaaactcggcgagtttgggaaggccaagggcagccgcgctatttggtacatgtggctgggagccagattcctggagttcgaggccctcggctttatgaacgaggatcattggttctctcgggaaaatagcctgtccggggtcgagggagaaggccttcacaaactggggtacatcctccgcgacatttctaagatccccggaggcaacatgtatgcggatgacacagctgggtgggataccagaatcacagaggacgatctgcagaatgaggccaaaattaccgacatcatggaacctgagcacgcccttctggctacgagcatttttaagctcacataccaaaacaaagtggtccgggtgcagcgccccgccaagtccggcaccgttatggatgtgatctctagacgggaccagagaggaagcggccaggtcgggacatatggactgaacaccttcacgaatatggaagtgcaactgattcgccagatggagtccgaaggcatcttttctccgagcgagctcgagaactccaatctggctgaacgggtgcttgactggctggagaaacatggggttgaaagactcaagcgcatggccatcagcggagatgactgtgaggtgaagcctaccgatgaccggttcgcgacagccctgaccgctcttaacgatatgggcaaagtcagaaaggacattccccagtgggaaccttctaaagggtggaatgattggcagcaagtgcccttttgctcccaccatttccaccagctgatcatgaaggacggccgcgagattgttgtgccttgtcggaaccaggatgagctcgtcggacgggcccgcgtgagccagggcgctgggtggtctctgcgggaaacagcctgcctgggaaaatcctacgcgcaaatgtggcagctcatgtattttcacagacgcgacctgcggcttgccgctaatgccatctgtagcgctgtccccgtgaactgggttccgacctccagaacaacctggtctattcatgcccaccatcagtggatgacgacagaggatatgctgagcgtgtggaatcgggtctggatcgaagagaacccttggatggaagacaagacccacgtgtccagctgggaggacgttccctacctcggcaagagagaggatcaatggtgcgggtctctgattggacttaccgctcgcgccacatgggcgaccaatatccaggtggccatcaaccaggtccggagactgattggcaatgaaaactatctcgactacatgacatccatgaaacgcttcaagaatgagagcgatcccgaaggggctctgtggtga

SEQ ID NO: 19466 - RNA, 9879 nt, synthetic construct
  misc_feature 1..9879: note = derived and/or modified CDS sequence (opt5) from DENV-1__KM403606__SS-prME
  source 1..9879: mol_type = other RNA
agcgtgaccatgctgctgatgctgcttcccacagccctggctttccacctcacgacccggggcggggagcctcatatgattgtctccaagcaggaacggggaaaatctctgctttttaagaccagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctaccctggagatccagctcacagactacggcgccctgacccttgactgtagcccccggacaggcctggatttcaacgaaatggtgctcctgaccatgaaggagaaaagctggcttgtccataagcagtggtttctggacctccctctgccctggacgtctggggcttccacaagccaagagacctggaatcgccaggatctgctcgtgacattcaaaaccgcgcacgccaagaagcaggaagtcgtggttctgggatcccaagagggcgctatgcacaccgcccttacaggggccacggaaattcagacctctggaacaaccacaatctttgctggccatctgaaatgcagactcaagatggacaaactgaccctgaagggggtgagctatgtcatgtgtacgggctccttcaaacttgagaaggaagtggccgagacacagcacggaaccgttctcgtgcaggtcaagtacgagggcaccgatgcgccgtgcaaaattcctatcagcacacaagacgaaaagggggtgacccagaacggacggctgatcacagctaatcccattgtgacggataaagagaagcctgttaacatcgaaaccgagccgcccttcggcgagtcttatattgtcatcggggccggagaaaaagccctgaagctctcctggtttaagaaaggcagctctattgggaagatgttcgaggctacagccagaggcgctcgccggatggccatcctgggagacaccgcgtgggattttggcagcatcgggggagtgttcacatccgtgggcaaacttgtccatcaggtgtttgggaccgcctacggagttctgttctctggcgtgagctggacgatgaagattgggatcggcattctcctgacctggctgggacttaattccagaagcacatctctctccatgacctgtatcgctgtcggcatggtgacactgtacctgggggttatggtgcaggccgacagcggatgcgtcattaactggaaaggccgcgaactcaagtgtgggtctggaatctttgtgaccaacgaggttcacacatggaccgaacaatataagttccaggctgattcccctaaacggctgagcgccgcgattggcaaggcctgggaggagggggtgtgcggcatcagatccgctacgcgccttgaaaatatcatgtggaaacagatttctaacgagctgaatcatatcctcctggaaaacgacatgaagtttacagtcgtggtgggagacgccaatggcattctgacccaggggaaaaagatgatccggccgcaacccatggagcacaaatacagctggaagtcctggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggcttaagctccgcgattcttacacacagatgtgcgaccaccggctgatgagcgctgcgatcaaagattccaaggccgtgcatgctgacatgggctattggattgaaagcgagaaaaatgaaacctggaagctggccagagcctcttttatcgaggtgaagacatgtatctggccccgctcccacaccctctggagcaacggggtcctggaatctgagatgattatcccgaaaatttacggaggccctatctcccaacataattatcggcccgggtacttcacgcagaccgctggaccttggcaccttggcaagctggagctcgatttcaacctgtgcgaagggacaaccgtggttgtggacgagcactgcggaaatagaggccccagcctgcggacaaccacggtcacaggcaaaattatccatgaatggtgttgccgctcttgtacccttcctcccctcagatttagaggggaagatggatgctggtacggcatggagatcagaccggtgaaggaaaaagaggaaaacctggttcgcagcatggtgtccgccgggagcggagaggtcgactctttctccctgggcctcctgtgtgtgagcattatgatcgaagaggttatgcggtccagatggtctcgcaagatgcttatgacagggaccctggcggtgtttttcctcctgattatgggacagctgacctggaatgaccttatcagactgtgcattatggtcggcgctaacgtgagcgatcggatgggcatggggacaacgtatctcgccctgatggccacctttaagatgcgccctatgttcgctgtgggactcctgtttagacggcttacatcccgcgaggtcctgctcctgaccatcggcctgtctcttgttgccagcgtggaactgcccaactccctcgaggaactgggggacggactcgcgatgggcattatgatgctgaaacttctgacagatttccaatctcaccagctctggaccacgctgctgagccttacatttatcaagaccaccctgtccctcgactacgcttggaaaacaatggccatggtgctgagcatcgtctctctcttccccctgtgtctttccaccacaagccagaagacgacctggctgcctgtgctgctcgggtcttttggatgcaaaccgctgacaatgttccttattaccgagaataagatctggggcagaaagtcctggcccctgaacgaaggcattatggccgttgggatcgtgagcattctcctgtcttccctcctgaaaaatgatgtccctcttgctggacccctgatcgccggcgggatgctgatcgcttgttatgtgattagcggatccagcgccgacctctctctggagcgggcggccgaggttagctgggaagaggaagctgagcattccggcgcctctcacaacatccttgtggaagtccaggatgacgggacaatgaagattaaagatgaggagcgcgacgataccctgacgatcctcctgaaggctaccctcctggccgtgagcggagtctaccctatgtccattcccgccacactttttgtgtggtatttctggcagaaaaagaaacagagatctggcgttctgtgggacaccccttcccctcccgaagtggagcgggctgtcctggatgacggcatctaccgcatcctccagagagggctgcttggacggtcccaggtgggcgttggggtgttccaagacggagtctttcatacaatgtggcacgtgaccagaggcgcggtgctgatgtatcaggggaaacgcctcgaaccctcttgggccagcgttaagaaagatctgatttcctacggaggcggctggcggttccaggggagctggaatacaggagaggaggtccaggtgatcgctgtggaacccggcaagaaccctaaaaatgtccaaacgacccccgggacatttaagaccccggagggagaagtgggcgccattgccctcgacttcaaacctgggacctctggatcccccatcgttaacagagagggcaagattgtgggcctgtacgggaatggagtcgtgacaacgagcggcacctatgtttctgctatcgcccaggcgaaggcttcccaggaagggcctcttcccgagattgaggatgaagtgtttaaaaagcgcaacctgacaatcatggacctgcaccccggaagcggcaaaacccggagatacctccctgccatcgtccgcgaggccattaagcggaaactgagaacacttatcctggctccgacccgcgtggttgcctccgaaatggcggaggctctcaaggggatgcccattcggtatcaaacgacagccgtgaagtctgaacataccggcaaagagatcgtcgatctgatgtgccacgccaccttcacaatgagactgctcagccctgtgcgggtgcccaattacaacatgattatcatggacgaggctcattttaccgatcctgcctccatcgctgcccgcggatatattagcacaagagtcggcatgggggaagcggccgctatcttcatgaccgccacgccccctggatctgttgaggcttttccgcagtccaatgccgtgattcaggacgaagaacgggatatccccgaacgcagctggaactctggctacgactggattacagatttccctgggaagaccgtgtggtttgtccccagcatcaaatccggaaatgacatcgccaactgtcttagaaagaacggcaaacgggtgattcagctgtctagaaagacattcgacaccgagtatcaaaagacgaaaaataacgattgggactacgttgtgaccacagatatcagcgagatgggggctaatttccgcgcggaccgggtcattgatcctagacgctgcctgaagcccgtgatcctcaaagacggcccggaacgggttattctggccggacctatgcccgtgaccgctgcctccgccgctcagagacgcggccggatcgggagaaaccagaataaggagggagatcagtacatttatatgggccaaccccttaacaatgacgaagatcacgcccattggacagaggcgaaaatgctgctcgacaacatcaatacccctgaggggatcattcccgctctgtttgaacctgagcgcgaaaagtctgccgccatcgatggagagtacagactgcggggcgaagctcgcaagacattcgtcgagctcatgagaagaggggaccttccggtgtggctgagctataaagtcgcctccgagggctttcagtacagcgatcgcagatggtgcttcgacggagaacggaacaatcaggtgctggaggaaaacatggacgttgagatttggaccaaggaaggcgagcgcaaaaagctccgcccccggtggctggatgcgagaacgtattctgaccctcttgccctgcgcgagtttaaagagttcgctgccgggcggagatccgtgagcggagatctcatcctggagattggcaagctgccccagcacctcacacttcgggctcaaaatgccctggacaacctggtgatgctccacaattccgaacaagggggaaaggcttaccgccatgccatggaggaactgcctgataccatcgagacccttatgctgctcgcgctgatcgccgtcctgacaggcggcgttaccctctttttcctttctgggaagggactgggcaagacaagcattgggctgctctgtgtgatggcttcctctgtgctgctttggatggccagcgtcgagccccactggatcgctgcctccattatcctggaatttttcctcatggtgctgctgattccggagcctgacagacagcggacgccccaggataaccaactcgcctatgttgtgatcggacttctgtttatgatcctgaccgtcgctgcgaacgaaatgggcctcctggagacaaccaaaaaggaccttgggattggacatgtggtcgccgagaatcaccaccatgctacaatgctggatatcgacctccaccctgccagcgcctggaccctgtacgctgtggccacgaccattatcacacccatgatgcgccataccattgaaaacacaaccgcgaatatctctctgacggccattgctaaccaggccgctatcctcatgggccttgataaaggctggcctatctccaagatggacattggggttcccctgctggccctcggatgctacagccaggtgaatccgctgacacttaccgcggccgtcctgatgctcgtggctcactatgccatcattggccctgggctgcaagctaaagccacaagagaggctcagaagcggaccgccgcgggaatcatgaagaaccccaccgttgatggcattgtggccatcgacctggaccccgtcgtgtacgatgctaaattcgaaaagcagctcgggcagatcatgcttctgattctgtgtacatctcaaatcctcctgatgcgcacgacctgggccctttgcgagtccattacactggctaccggacctctcacaaccctgtgggaaggcagcccgggcaaattttggaatacgacaatcgccgtgtctatggccaacattttcagagggagctatctggcgggagctggcctcgccttctcccttatgaagaccctcgggggaggccggcgcgggaccggagctcagggcgagacactgggcgagaaatggaagagacagctcaatcagctgtctaagagcgaatttaacacctacaaacggtccgggatcatggaggttgacagaagcgaagccaaggagggacttaaacgcggcgaaacaacgaagcatgccgtctcccgggggaccgctaaactgagatggttcgtggagcgcaatctcgtgaagcccgagggaaaggtcatcgatctgggctgtgggcggggaggctggtcttattactgcgccggcctgaaaaaggttacagaagtgaaagggtataccaagggaggccctgggcacgaggaacccattcctatggcgacatacggatggaacatcgtgaaactccacagcggcagagacgtctttttcacaccccctgagaagtgtgatacgcttctgtgcgacattggggaatcctctccgaatcccaccatcgaggagggacgcacactgcgggtgctcaaaatggttgaaccttggctgagaggcaaccaattttgtattaagatccttaatccctacatgcctagcgtggtcgagaccctggaacagatgcagcgcaagcatggcgggatgctcgtgcggaaccccctgtccagaaattctacacacgagatgtattgggttagctgcggaaccggcaacattgtgtccgccgtcaacatgacaagccgcatgctgctcaatcggttcaccatggctcatagaaaaccgacgtacgagcgcgatgtggacctgggggccggaacaagacacgtggctgtcgaacctgagatcgccaaccttgatatcattggccagcggatcgaaaatattaagaacgagcacaaatctacctggcattatgacgaagataatccctacaagacctgggcgtatcacgggtcctacgaggttaaacccagcggatctgcctccagcatggtgaacggcgtggtccgcctgctcacaaagccttgggacgtgatccccatggttacgcaaattgctatgaccgacacaaccccttttggccagcagagagtgttcaaggagaaagtcgatacacggaccccgagacccaagcgggggacagcccaaatcatggaagtgaccgctaaatggctgtggggatttctttctcgcaataagaaacctagaatctgtacgcgggaggagttcacccgcaaggttagatccaacgccgctattggcgccgtgtttgtcgacgagaatcagtggaacagcgcgaaggaagccgtggaggatgagcggttctgggacctggttcatcgcgaaagagagctccacaaacaggggaagtgcgctacatgcgtgtataatatgatgggaaaacgggaaaagaaactgggcgagtttgggaaggccaagggctcccgcgctatctggtacatgtggctgggagccagattcctcgagttcgaggccctgggctttatgaacgaggatcattggttcagccgggaaaattctcttagcggggtcgagggagaaggcctgcacaaactcgggtacattctgcgcgacatctccaagattcccggaggcaacatgtatgcggatgacaccgctgggtgggatacaagaatcaccgaggacgatcttcagaatgaggccaaaatcacggacattatggaacctgagcacgccctgctcgctacatctatctttaagctgacctaccaaaacaaagtggtccgggtgcagcgccccgccaagagcggcacagttatggatgtgatttccagacgggaccagagaggatctggccaggtcgggacctatggactgaacacgttcaccaatatggaagtgcaactcatccgccagatggagagcgaaggcatcttttccccgtctgagctggagaacagcaatcttgctgaacgggtgctggactggctcgagaaacatggggttgaaagactgaagcgcatggccatctccggagatgactgtgtggtcaagcctacagatgaccggttcgcgaccgcccttacagctctgaacgatatgggcaaagtgagaaaggacatcccccagtgggagcctagcaaagggtggaatgattggcagcaagttcccttttgctctcaccatttccaccagctcattatgaaggacggccgcgaaatcgtggtcccttgtcggaaccaggatgagctggtgggacgggcccgcgtctcccagggcgctgggtggagcctgcgggagaccgcctgcctcggaaaatcttacgcgcaaatgtggcagctgatgtattttcacagacgcgaccttcggctggccgctaatgccatttgttccgctgtgcccgttaactgggtgccgacaagcagaaccacgtggtccatccatgcccaccatcagtggatgacaaccgaagatatgctctctgtctggaatcgggtgtggattgaggaaaacccttggatggaggacaagacccacgttagctcctgggaagacgtgccctacctgggcaagagagaggatcaatggtgcgggagccttatcggactgacagctcgcgccacctgggcgacaaatattcaggtcgccatcaaccaggtgcggagactcatcggcaatgagaactatctggactacatgacgtctatgaaacgcttcaagaatgaatccgatcccgagggggctctgtggtga

SEQ ID NO: 19467 - RNA, 9879 nt, synthetic construct
  misc_feature 1..9879: note = derived and/or modified CDS sequence (opt5) from DENV-1__KM403591__SS-prME
  source 1..9879: mol_type = other RNA
agcgtgaccatgctgctcatgctgcttcccacagctctggctttccacctcacgacccggggaggggaacctcatatgatcgtctccaagcaagaacggggaaaatctctgctttttaagacaagcgccggagttaacatgtgcaccctgattgcgatggacctcggggaactgtgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaagatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggggaaactcaccctgaagggcgtgtcctatgtcatgtgtacgggatccttcaaactggagaaggaagtggccgagacacagcacggcaccgttcttgtgcaggtcaagtacgaggggaccgacgcgccgtgcaaaattcctatctctacacaagatgaaaagggagtgacccagaacggccggctcatcacagctaatcccattgtgacggacaaagagaagcctgttaacatcgaaaccgagccgcccttcggggagtcctatattgtcatcggagccggcgaaaaagccctgaagctgagctggtttaagaaagggtctagcattggcaagatgttcgaggctacagccagaggagctcgccggatggccatcctcggcgataccgcgtgggactttgggtccatcggaggcgtgttcacatctgtggggaaactggtccatcaggtgtttggaaccgcctacggcgttcttttcagcggggtgtcctggacgatgaagattggcatcggcattctgctcacctggctgggcctgaatagcagatctacatcccttagcatgacctgtatcgctgtcgggatggtgacactctacctgggagttatggtgcaggccgattctggctgcgtcattaactggaaagggcgcgaactgaagtgtggatccggcatctttgtgaccaacgaggttcacacatggaccgaacaatataagttccaggctgacagccctaaacggctctccgccgcgattgggaaggcctgggaggagggcgtgtgcggaatcagatctgctacgcgcctggaaaatatcatgtggaaacagattagcaacgagcttaatcatatcctgctcgaaaacgatatgaagtttacagtcgtggtgggcgacgccaatgggattctgacccagggcaagaagatgatccggccgcaacccatggagcacaaatactcctggaagtcttggggcaaggctaaaattatcggggccgacacccagaacacaaccttcatcattgatggacctgacacgcccgaatgtcctgatgaccagagagcctggaatatctgggaggtcgaggattatggctttggcgttttcacaaccaacatttggctgaaacttcgcgacagctacacacagatgtgcgatcaccggctcatgtccgctgcgatcaaagacagcaaggccgtgcatgctgatatggggtattggattgaatctgagaaaaatgaaacctggaagctggccagagcctcctttatcgaggtgaagacatgtatctggccccgcagccacaccctgtggtctaacggagtcctcgaatccgagatgattatcccgaaaatttacggcgggcctatcagccaacataattatcggcccggatacttcacgcagaccgctggcccttggcacctggggaaacttgagctggacttcaacctctgcgaaggaacaaccgtggttgtggatgagcactgcggcaatagaggcccctctctgcggacaaccacggtcacagggaaaattatccatgaatggtgttgccgcagctgtaccctgcctccccttagatttcggggagaggacggctgctggtacgggatggagatcagaccggtgaaggaaaaagaggaaaacctcgttcgctccatggtgagcgccggatctggcgaggtcgattccttcagcctggggctgctctgtgtgtccattatgatcgaagaggttatgcggtctagatggagccgcaagatgctgatgacaggaacccttgcggtgtttttcctgctcattatgggccagctgacctggaatgacctgatcagactttgcattatggtcggcgctaacgtgtccgaccggatggggatgggaacaacgtatctggccctcatggccacctttaagatgcgccctatgttcgctgtgggcctgctctttagacggctgacatctcgcgaggtccttctgctcaccatcgggctgagcctggttgcctccgtggaacttcccaactctctggaggaactcggagatggcctggcgatggggattatgatgctcaaactgcttacagacttccaaagccaccagctgtggaccacgctcctgtccctgacatttatcaagaccacccttagcctggattacgcttggaaaacaatggccatggtgctctctatcgtctccctgttccccctctgtctgagcaccacatctcagaagacgacctggcttcctgtgctgctgggatcctttggctgcaaaccgctcacaatgttcctgattaccgagaataagatctggggcagaaagagctggccccttaacgaagggattatggccgttggaatcgtgtctattctgctctccagcctgctcaaaaatgacgtccctctggctggcccccttatcgccgggggaatgctgatcgcttgttatgtgatttccggcagctctgccgatctgagcctcgagcgggcggccgaggtttcctgggaagaggaagctgagcattctggggccagccacaacatcctggtggaagtccaggacgatggaacaatgaagattaaagacgaggagcgcgatgacacccttacgatcctgctcaaggctaccctgctcgccgtgtccggcgtctaccctatgtctattcccgccacactgtttgtgtggtatttctggcagaagaagaaacagagaagcggcgttctttgggatacccctagccctcccgaagtggagcgggctgtcctggacgatgggatctaccgcatcctgcagagaggactcctgggccggtctcaggtgggggttggagtgttccaagacggcgtctttcatacaatgtggcacgtgaccagaggggcggtgcttatgtatcagggaaagcgcctggaacccagctgggcctccgttaagaaagacctcattagctacggcggcgggtggcggttccagggatcttggaatacaggcgaggaggtccaggtgatcgctgtggaacccgggaagaaccctaaaaatgtccaaacgacccccggaacatttaagaccccggagggcgaagtgggggccattgccctggatttcaaacctggaacctccggcagccccatcgttaacagagagggcaagattgtggggctctacggaaatggcgtcgtgacaacgtctgggacctatgtttccgctatcgcccaggcgaaggctagccaggaaggacctctgcccgagattgaggacgaagtgtttaaaaagcgcaaccttacaatcatggatctgcaccccggctccgggaaaaccaagcggtacctgcctgccatcgtcagagaggccattaaacgcaagctccggacactgatccttgctccgaccagagtggttgcctctgaaatggcggaggctctgaagggcatgcccattcgctatcaaacgacagccgtgaaaagcgaacataccggaaaggagatcgtcgacctcatgtgccacgccaccttcacaatgcggctgctgtcccctgtgagagtgcccaattacaacatgattatcatggatgaggctcattttaccgaccctgccagcatcgctgcccggggctatatttctacacgcgtcgggatgggagaagcggccgctatcttcatgaccgccacgccccctggctccgttgaggcttttccgcagagcaatgccgtgattcaggatgaagagagagacatccccgaacggtcttggaacagcgggtacgattggattacagacttccctggaaaaaccgtgtggtttgtcccctccatcaagtctggcaatgatatcgccaactgtctccgcaaaaacgggaagagagtgattcagcttagccggaagacattcgacaccgagtatcagaagacgaagaataacgactgggattacgttgtgaccacagacatctccgagatgggcgctaatttcagagcggatcgcgtcattgaccctcggagatgcctgaaacccgtgatcctgaaggatggaccggaacgcgttattctcgccggccctatgcccgtgaccgctgcctctgccgctcagcggagagggcgcatcggacggaaccagaataaagagggcgaccagtacatttatatggggcaacccctgaacaatgatgaagaccacgcccattggacagaggcgaagatgcttctggataacatcaatacccctgagggaatcattcccgctctctttgaacctgagagagaaaagagcgccgccatcgacggcgagtaccgcctgagaggggaagctcggaaaacattcgtcgagctgatgcgcagaggcgatctcccggtgtggctttcctataaggtcgccagcgagggatttcagtactctgaccggcgctggtgcttcgatggcgaaagaaacaatcaggtgctggaggaaaacatggacgttgagatttggaccaaagaaggggagcggaagaaactgagaccccgctggctcgacgcgcggacgtattccgatcctctggcccttagagagtttaaggagttcgctgccggacgccggagcgtgtccggcgacctgatcctcgagattgggaaactgccccagcacctgacactcagagctcaaaatgcccttgataacctggtgatgctgcacaattctgaacagggaggcaaggcttaccggcatgccatggaggaactccctgacaccatcgagaccctgatgcttctggcgctcatcgccgtcctgacaggcggggttaccctgtttttcctcagcggaaagggccttgggaaaacatccattggactgctgtgtgtgatggcttctagcgtgctcctgtggatggcctccgtcgagccccactggatcgctgccagcattatccttgaatttttcctgatggtgctcctgattccggagcctgatcgccagagaacgccccaggacaaccaactggcctatgttgtgatcggcctcctttttatgatcctgaccgtcgctgcgaacgaaatggggctgctcgagacaaccaagaaagatctgggaattggccatgtggtcgccgagaatcaccaccatgctacaatgcttgacatcgatctgcaccctgcctctgcctggaccctctacgctgtggccacgaccattatcacacccatgatgcggcataccattgaaaacacaaccgcgaatatctccctgacggccattgctaaccaggccgctatcctgatgggcctcgacaaggggtggcctatcagcaaaatggatattggagttccccttctggccctgggctgctactctcaggtgaatccgctcacactgaccgcggccgtccttatgctggtggctcactatgccatcattgggcctggactccaagctaaggccacacgcgaggctcagaagagaaccgccgcgggcatcatgaaaaaccccaccgttgacgggattgtggccatcgatctggaccccgtcgtgtacgacgctaagttcgaaaaacagctgggacagatcatgctccttattctgtgtacatcccaaatcctgctcatgcggacgacctgggccctgtgcgagagcattacacttgctaccggccctctgacaaccctctgggaaggctctccggggaagttttggaatacgacaatcgccgtgagcatggccaacattttccgcggatcctatctggcgggcgctgggctggccttctctctcatgaaaagccttggaggcgggagacggggaaccggcgctcagggcgagaccctgggggagaagtggaagcgccagctgaatcagctctccaaaagcgaatttaacacatacaagagatccggaatcatggaggttgatcggtctgaagccaaagagggcctgaagagaggggaaaccacaaaacatgccgtcagccgcggaacggctaaacttcggtggttcgtggagagaaatctggtgaagcccgagggcaaagtcatcgacctcgggtgtggacgcggcggctggtcctattactgcgccgggctgaagaaagttaccgaagtgaagggatatacaaaaggcgggcctggacacgaggaacccattcctatggcgacctacggctggaacatcgtgaagctgcactctgggcgggatgtctttttcacaccccctgagaaatgtgacaccctcctttgcgatattggagaaagctccccgaatcccacgatcgaggagggcagaaccctgcgcgtgctgaagatggttgaaccttggctccggggcaaccaattttgtattaagatcctgaatccctacatgccttctgtggtcgagacacttgaacagatgcagagaaaacatgggggaatgctggtgcgcaaccccctcagcagaaattccacccacgagatgtattgggttagctgcggcacagggaacattgtgtctgccgtcaacatgacctccagaatgctgctgaatcgcttcacaatggctcatcggaagccgacctacgagagagacgtggatctcggagccggcacgcgccacgtggctgtcgaacctgagatcgccaacctggacatcattgggcagagaatcgaaaatattaaaaacgagcacaagagcacatggcattatgatgaagacaatccctacaaaacctgggcgtatcacggatcttacgaggttaagccctccggcagcgcctcttccatggtgaacggcgtggtccggcttctgaccaagccttgggatgtgatccccatggttacacaaattgctatgacggacaccacaccttttgggcagcagcgcgtgttcaaagagaaggtcgacaccagaacaccgcggcccaaaagaggaaccgcccaaatcatggaagtgacagctaagtggctctggggctttctgagccggaataaaaagcctcgcatctgtaccagagaggagttcacgcggaaggttcgctccaacgccgctattggggccgtgtttgtcgatgagaatcagtggaacagcgcgaaagaagccgtggaggacgagagattctgggatcttgttcatcgggaacgcgagctgcacaagcagggaaaatgcgctacctgcgtgtataatatgatgggcaagagagagaaaaagctcggggagtttggcaaggccaaaggatctcgggctatctggtacatgtggctgggcgcccgcttcctggagttcgaggccctcgggtttatgaacgaggaccattggttcagcagagaaaattccctgtctggagtcgagggcgaagggcttcacaagctgggatacattctccgggatatcagcaaaattcccggcgggaacatgtatgcggacgatacagctggctgggacacccgcatcacagaggatgacctgcagaatgaggccaagatcaccgatattatggaacctgagcacgcccttctggctacgtccatctttaaactcacataccaaaacaaggtggtcagagtgcagcggcccgccaaatctggaaccgttatggacgtgattagccgcagagatcagcggggctccgggcaggtcggaacatatggcctgaacaccttcacgaatatggaagtgcaactgatcagacagatggagtctgaagggatttttagcccgtccgagctcgagaacagcaatctggctgaacgcgtgcttgactggctggagaagcatggagttgaacggctcaagagaatggccatctctggcgacgattgtgtggtcaaacctaccgacgatcgcttcgcgacagccctgaccgctcttaacgacatggggaaggtgcggaaagatatcccccagtgggagccttccaagggctggaatgactggcagcaagttcccttttgcagccaccatttccaccagctgattatgaaagatggaagagaaatcgtggtcccttgtcgcaaccaggacgagctcgtgggccgggccagagtctctcagggggctggatggtccctgcgcgagacagcctgcctgggcaagagctacgcgcaaatgtggcagctcatgtattttcaccggagagatctgcgccttgccgctaatgccatttgttccgctgtgcccgttaactgggtgccgacctctcggacaacctggagcatccatgcccaccatcagtggatgacgacagaagacatgctgtccgtctggaatagagtgtggattgaggaaaacccttggatggaggataagacccacgttagctcttgggaagacgtgccctacctcgggaaacgggaggaccaatggtgcggatccctgatcggccttaccgctagagccacatgggcgaccaatattcaggtcgccatcaaccaggtgcgccggctgatcgggaatgagaactatctcgattacatgacaagcatgaagagattcaaaaatgaatctgaccccgagggcgctctgtggtga

SEQ ID NO: 19468 - RNA, 9879 nt, synthetic construct
  misc_feature 1..9879: note = derived and/or modified CDS sequence (opt5) from DENV-1__KM403607__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctatccaagacgaaaagggggtgacacagaacggacggctcattaccgctaatcccatcgtgacagataaagagaagcctgttaacattgaaacggagccgcccttcggcgagtcctatatcgtcattggggccggagaaaaagccctgaagctgagctggtttaagaaaggctctagcatcgggaagatgttcgaggctaccgccagaggcgctcgccggatggccatcctcggagacacagcgtgggattttggctccattgggggagtgttcacctctgtgggcaaactggtccatcaggtgtttgggacagcctacggagttcttttcagcggcgtgtcctggaccatgaagatcgggattggcatcctgctcacgtggctgggactgaatagcagatctacctcccttagcatgacatgtattgctgtcggcatggtgaccctctacctgggggttatggtgcaggccgactctggatgcgtcatcaactggaaaggccgcgaactgaagtgtgggtccggaatttttgtgacaaacgaggttcacacctggacagaacaatataagttccaggctgatagccctaaacggctctccgccgcgatcggcaaggcctgggaggagggggtgtgcggcatcagatctgctacccgcctggaaaatattatgtggaaacagatcagcaacgagcttaatcatattctgctcgaaaacgacatgaagtttacggtcgtggtgggagacgccaatggcatcctgacacaggggaaaaagatgattcggccgcaacccatggagcacaaatactcctggaagtcttggggaaaggctaaaatcatcggcgccgatacccagaacaccacattcattatcgacgggcctgatacccccgaatgtcctgacgatcagagagcctggaatatttgggaggtcgaggactatggatttggcgttttcacgacaaacatctggctgaaacttcgcgatagctacacccagatgtgcgaccaccggctcatgtccgctgcgattaaagatagcaaggccgtgcatgctgacatgggctattggatcgaatctgagaaaaatgaaacatggaagctggccagagcctcctttatcgaggtgaagacctgtatttggccccgcagccacacactgtggtctaacggggtcctcgaatccgagatgatcattccgaaaatctacggaggccctattagccaacataattatcggcccgggtacttcacccagacggctggaccttggcacctgggcaaacttgagctggatttcaacctctgcgaagggaccacagtggttgtggacgagcactgcggaaatagaggcccctctctgcggaccacaaccgtcacgggcaaaatcatccatgaatggtgttgccgcagctgtacactgcctccccttagatttagaggggaagatggatgctggtacggcatggagattagaccggtgaaggaaaaagaggaaaacctcgttcgctccatggtgagcgccgggtctggagaggtcgactccttcagcctgggcctgctctgtgtgtccatcatgattgaagaggttatgcggtctagatggagccgcaagatgctgatgaccgggacacttgcggtgtttttcctgctcatcatgggacagctgacctggaatgacctgattagactttgcatcatggtcggcgctaacgtgtccgatcggatgggcatggggaccacatatctggccctcatggccacgtttaagatgcgccctatgttcgctgtgggactgctctttagacggctgacctctcgcgaggtccttctgctcacaattggcctgagcctggttgcctccgtggaacttcccaactctctggaggaactcggggacggactggcgatgggcatcatgatgctcaaactgcttaccgatttccaaagccaccagctgtggacaaccctcctgtccctgacgtttatcaagacaacccttagcctggactacgcttggaaaaccatggccatggtgctctctattgtctccctgttccccctctgtctgagcacaacctctcagaagacaacgtggcttcctgtgctgctggggtcctttggatgcaaaccgctcaccatgttcctgatcacagagaataagatttggggcagaaagagctggccccttaacgaaggcatcatggccgttgggattgtgtctatcctgctctccagcctgctcaaaaatgatgtccctctggctggaccccttatcgccggcgggatgctgattgcttgttatgtgatctccggaagctctgccgacctgagcctcgagcgggcggccgaggtttcctgggaagaggaagctgagcattctggcgccagccacaacattctggtggaagtccaggatgacgggaccatgaagatcaaagatgaggagcgcgacgatacacttaccattctgctcaaggctacgctgctcgccgtgtccggagtctaccctatgtctatccccgccaccctgtttgtgtggtatttctggcagaagaagaaacagagaagcggcgttctttgggacacacctagccctcccgaagtggagcgggctgtcctggatgacggcatctaccgcattctgcagagagggctcctgggacggtctcaggtgggcgttggggtgttccaagacggagtctttcataccatgtggcacgtgacaagaggcgcggtgcttatgtatcaggggaaacgcctggaacccagctgggcctccgttaagaaagatctcatcagctacggaggcggctggcggttccaggggtcttggaataccggagaggaggtccaggtgattgctgtggaacccggcaagaaccctaaaaatgtccaaacaacgcccgggacctttaagacaccggagggagaagtgggcgccatcgccctggacttcaaacctgggacctccggaagccccattgttaacagagagggcaagatcgtgggcctctacgggaatggagtcgtgaccacatctggcacgtatgtttccgctattgcccaggcgaaggctagccaggaagggcctctgcccgagatcgaggatgaagtgtttaaaaagcgcaaccttaccatcatggacctgcaccccggatccggcaaaacacggagatacctgcctgccattgtccgcgaggccatcaagcggaaactcagaaccctgattcttgctccgacacgcgtggttgcctctgaaatggcggaggctctgaaggggatgcccatccggtatcaaaccacggccgtgaagtccgaacatacaggcaaagagattgtcgatctcatgtgccacgccaccttcaccatgagactgctgtcccctgtgcgggtgcccaattacaacatgatcatcatggacgaggctcattttacagatcctgccagcattgctgcccgcggatatatctctaccagagtcggcatgggggaagcggccgctattttcatgacagccacaccccctggatccgttgaggcttttccgcagagcaatgccgtgatccaggacgaagaacgggatattcccgaacgctcttggaacagcggctacgactggatcacggatttccctgggaagacagtgtggtttgtcccctccatcaaatctggaaatgacattgccaactgtctcagaaagaacggcaaacgggtgatccagcttagcagaaagaccttcgacacagagtatcaaaagaccaaaaataacgattgggactacgttgtgacgaccgatatttccgagatgggggctaatttccgcgcggaccgggtcatcgatcctagacgctgcctgaagcccgtgattctgaaagacggcccggaacgggttatcctcgccggacctatgcccgtgacagctgcctctgccgctcagagacgcggccggattgggagaaaccagaataaggagggagatcagtacatctatatgggccaacccctgaacaatgacgaagatcacgcccattggaccgaggcgaaaatgcttctggacaacatcaatacacctgaggggattatccccgctctctttgaacctgagcgcgaaaagagcgccgccattgatggagagtacagactgcggggcgaagctcgcaagaccttcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatctggacaaaggaaggcgagcgcaagaagctgcgcccccggtggctcgatgcgagaacctattccgaccctctggcccttcgcgagtttaaagagttcgctgccgggcggagaagcgtgtccggagatctgattctcgagatcggcaagctgccccagcacctgacgctccgggctcaaaatgcccttgacaacctggtgatgctgcacaattctgaacaagggggaaaggcttaccgccatgccatggaggaactccctgatacaatcgagaccctgatgcttctggcgctcattgccgtcctgaccggcggcgttacactgtttttcctcagcgggaagggacttggcaagacctccatcgggctgctgtgtgtgatggcttctagcgtgctcctgtggatggcctccgtcgagccccactggattgctgccagcatcattcttgaatttttcctgatggtgctcctgatcccggagcctgacagacagcggacaccccaggataaccaactggcctatgttgtgatcggactcctttttatgattctgacggtcgctgcgaacgaaatgggcctgctcgagaccaccaaaaaggacctggggatcggacatgtggtcgccgagaatcaccaccatgctaccatgcttgatattgacctgcaccctgcctctgcctggacactctacgctgtggccaccacgatcattacccccatgatgcgccatacaatcgaaaacaccacagcgaatatttccctgaccgccatcgctaaccaggccgctatcctgatgggcctcgataaaggctggcctattagcaagatggacatcggggttccccttctggccctgggatgctactctcaggtgaatccgctcacgctgacagcggccgtccttatgctggtggctcactatgccattatcggccctgggctccaagctaaagccaccagagaggctcagaagcggacagccgcgggaattatgaagaaccccaccgttgatggcatcgtggccatcgacctggaccccgtcgtgtacgatgctaaattcgaaaagcagctggggcagattatgctccttatcctgtgtacctcccaaattctgctcatgcgcacaacgtgggccctgtgcgagagcatcacccttgctacaggacctctgaccacactctgggaaggctctccgggcaaattttggaataccacgattgccgtgagcatggccaacatcttcagagggtcctatctggcgggagctggcctggccttctctctcatgaagacacttgggggaggccggcgcgggaccggagctcagggcgagaccctgggcgagaaatggaagagacagctgaatcagctcagcaagtccgaatttaacacatacaaacggagcgggatcatggaggttgacagatccgaagccaaggagggactgaaacgcggcgaaaccacaaagcatgccgtctctcgggggacggctaaacttagatggttcgtggagcgcaatctggtgaagcccgagggaaaggtcattgatctcggctgtgggcggggaggctggagctattactgcgccggcctgaaaaaggttaccgaagtgaaagggtatacaaagggaggccctgggcacgaggaacccatccctatggcgacctacggatggaacattgtgaaactgcactccggcagagacgtctttttcacaccccctgagaagtgtgataccctcctttgcgacatcggggaatctagcccgaatcccacgattgaggagggacgcaccctgcgggtgctgaaaatggttgaaccttggctcagaggcaaccaattttgtatcaagattctgaatccctacatgccttccgtggtcgagacacttgaacagatgcagcgcaagcatggcgggatgctggtgcggaaccccctctctagaaatagcacccacgagatgtattgggtttcctgcggaacaggcaacatcgtgagcgccgtcaacatgacctctcgcatgctgctgaatcggttcacaatggctcatagaaaaccgacctacgagcgcgatgtggacctcggggccggaacgagacacgtggctgtcgaacctgagatcgccaacctggatattatcggccagcggattgaaaatatcaagaacgagcacaaatccacatggcattatgacgaagataatccctacaagacctgggcgtatcacgggagctacgaggttaaaccctctggatccgccagctctatggtgaacggcgtggtccgccttctgaccaagccttgggacgtgattcccatggttacacaaatcgctatgacggacaccacaccttttggccagcagagagtgttcaaggagaaagtcgatacccggacaccgagacccaagcgggggaccgcccaaatcatggaagtgacagctaaatggctctggggatttctgtcccgcaataagaaacctagaatttgtacccgggaggagttcacgcgcaaggttagaagcaacgccgctatcggcgccgtgtttgtcgacgagaatcagtggaactccgcgaaggaagccgtggaggatgagcggttctgggaccttgttcatcgcgaaagagagctgcacaaacaggggaagtgcgctacctgcgtgtataatatgatgggaaaacgggaaaagaaactcggcgagtttgggaaggccaagggcagccgcgctatttggtacatgtggctgggagccagattcctggagttcgaggccctcggctttatgaacgaggatcattggttctctcgggaaaatagcctgtccggggtcgagggagaaggccttcacaaactggggtacatcctccgcgacatttctaagatccccggaggcaacatgtatgcggatgacacagctgggtgggataccagaatcacagaggacgatctgcagaatgaggccaaaattaccgacatcatggaacctgagcacgcccttctggctacgagcatttttaagctcacataccaaaacaaagtggtccgggtgcagcgccccgccaagtccggcaccgttatggatgtgatctctagacgggaccagagaggaagcggccaggtcgggacatatggactgaacaccttcacgaatatggaagtgcaactgattcgccagatggagtccgaaggcatcttttctccgagcgagctcgagaactccaatctggctgaacgggtgcttgactggctggagaaacatggggttgaaagactcaagcgcatggccatcagcggagatgactgtgtggtcaagcctaccgatgaccggttcgcgacagccctgaccgctcttaacgatatgggcaaagtgagaaaggacattccccagtgggagccttctaaagggtggaatgattggcagcaagttcccttttgctcccaccatttccaccagctgatcatgaaggacggccgcgaaattgtggtcccttgtcggaaccaggatgagctcgtgggacgggcccgcgtcagccagggcgctgggtggtctctgcgggagacagcctgcctgggaaaatcctacgcgcaaatgtggcagctcatgtattttcacagacgcgacctgcggcttgccgctaatgccatctgtagcgctgtgcccgttaactgggtgccgacctccagaacaacctggtctattcatgcccaccatcagtggatgacgacagaagatatgctgagcgtctggaatcgggtgtggatcgaggaaaacccttggatggaggacaagacccacgtttccagctgggaagacgtgccctacctcggcaagagagaggatcaatggtgcgggtctctgattggacttaccgctcgcgccacatgggcgaccaatatccaggtcgccatcaaccaggtgcggagactgattggcaatgagaactatctcgactacatgacatccatgaaacgcttcaagaatgaaagcgatcccgagggggctctgtggtga

SEQ ID NO: 19469 - RNA, 9879 nt, synthetic construct
  misc_feature 1..9879: note = derived and/or modified CDS sequence (opt5) from DENV-1__KM403581__SS-prME
  source 1..9879: mol_type = other RNA
agcgtgaccatgctgctgatgctgcttcccacagctctggctttccacctcacgacccggggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccgcgcattacagaggctgaacccgacgatgtggactgttggtgcaatgccaccgatacgtgggtgacctatggaacatgttcccaaaccggcgagcacagacgggaccgcagatctgtcgccctggctcctcatgtggggctcggactggagacacggaccgaaacgtggatgagctccgagggcgcctggcgccagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaagaccgaggtcacaaaccctgccgttcttcggaaactgtgcattgaagcgaagatctctaataccacgacagactcccgctgtccgacccaaggagaggccaccctcgtggaagaacaagatgctaacttcgtgtgcagacggacatttgtcgaccgcggctggggcaatgggtgtggactgttcggcaaagggagccttctgacctgcgccaagtttaaatgcgtgacaaagctcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaggagaaatcttggctggtccataagcagtggtttcttgacctgcctctcccctggacgtccggggctagcacatcccaagagacctggaatcggcaggatctgctggtgacattcaaaaccgcgcacgccaagaaacaggaagtcgtggttctcggatctcaagagggcgctatgcacaccgccctgacaggggccacggaaattcagaccagcggaacaaccacaatctttgctggccatcttaagtgcagactgaagatggacaaactcaccctgaagggggtgtcctatgtcatgtgtacgggcagcttcaaactggagaaggaagtggccgagacacagcacggaaccgttcttgtgcaggtcaaatacgagggcaccgatgcgccgtgcaagattcctatctctacacaagacgaaaagggggtgacccagaacggacgcctcatcacagctaatcccattgtgacggataaagagaagcctgttaacatcgaaaccgagccgcccttcggcgagtcctatattgtcatcggggccggagaaaaagccctgaagctgagctggtttaaaaagggctctagcattgggaagatgttcgaggctacagcccggggcgctagacgcatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagccggtctacatcccttagcatgacctgtatcgctgtcggcatggtgacactctacctgggggttatggtgcaggccgactctggatgcgtcattaactggaaaggcagagaactgaagtgtgggtccggaatctttgtgaccaacgaggttcacacatggaccgaacaatataaattccaggctgatagccctaagcgcctctccgccgcgattggcaaggcctgggaggagggggtgtgcggcatccggtctgctacgagactggaaaatatcatgtggaaacagattagcaacgagcttaatcatatcctgctcgaaaacgacatgaagtttacagtcgtggtgggagacgccaatggcattctgacccaggggaaaaagatgatccgcccgcaacccatggagcacaaatactcctggaagtcttggggaaaagctaagattatcggcgccgatacccagaacacaaccttcatcattgacgggcctgatacgcccgaatgtcctgacgatcagcgggcctggaatatctgggaggtcgaggactatggatttggcgttttcacaaccaacatttggctgaaacttagagatagctacacacagctctgcgaccaccgcctgatgtccgctgcgatcaaagatagcaaggccgtgcatgctgacatgggctattggattgaatctgagaaaaatgaaacctggaagctggcccgggcctcctttatcgaggtgaaaacatgtatctggcccagaagccacaccctctggtctaacggggtcctggaatccgagatgattatcccgaagatttacggaggccctatcagccaacataattatcggcccgggtacttcacgcagaccgctggaccttggcaccttggcaagctggagctcgatttcaacctgtgcgaagggacaaccgtggttgtggacgagcactgcggaaatcgcggcccctctctgagaacaaccacggtcacaggcaaaattatccatgaatggtgttgccggagctgtacccttcctcccctcagatttcgcggggaggatggatgctggtacggcatggagatccggccggtgaaggaaaaagaggaaaacctggttagatccatggtgagcgccgggtctggagaggtcgactccttcagcctgggcctcctgtgtgtgtccattatgatcgaagaggttatgcgctctagatggagccggaagatgcttatgacagggaccctggcgatctttttcctcctgatcatgggacagctgacctggaatgaccttattcgcctgtgcatcatggtgggcgctaacgtctccgatagaatgggcatggggacaacgtatctcgccctgatggccacctttaaaatgcggcctatgttcgctgtgggactcctgtttcgcagacttacatctcgggaggtgctgctcctgaccattggcctgagccttgtcgcctccgttgaactgcccaactctctcgaggaactgggggacggactcgcgatgggcatcatgatgctgaaacttctgacagatttccaaagccaccagctctggaccacgctgctgtcccttacatttatcaagaccaccctgagcctcgactacgcttggaaaacaatggccatggtgctgtctattgtgtccctcttccccctgtgtcttagcaccacatctcagaagacgacctggctgcctgtcctgctcgggtcctttggatgcaaaccgctgacaatgttccttatcaccgagaataagatttggggccgcaaaagctggcccctgaacgaaggcatcatggccgtggggattgtttctatcctcctgtccagcctcctgaagaatgatgtgcctcttgctggacccctgatcgccggcgggatgctgattgcttgttatgtcatctccggaagctctgccgacctcagcctggagagagcggccgaggtgtcctgggaagaggaagctgagcattctggcgccagccacaacattcttgttgaagtgcaggatgacgggacaatgaagatcaaagatgaggagcgggacgataccctgacgattctcctgaaggctaccctcctggccgtctccggagtgtaccctatgtctatccccgccacactttttgtctggtatttctggcagaagaagaaacagcgcagcggcgtgctgtgggacacccctagccctcccgaagttgagagagctgtgctggatgacggcatctaccggattctccagagagggctgcttggacgctctcaggtcggcgtgggggttttccaagacggagtgtttcatacaatgtggcacgtcacccggggcgcggtgctgatgtatcaggggaaaagactcgaacccagctgggcctccgtgaaaaaggatctgatcagctacggaggcggctggcgcttccaggggtcttggaatacaggagaggaggttcaggtcattgctgtggaacccggcaagaaccctaaaaatgtgcaaacgacccccgggacatttaagaccccggagggagaagtcggcgccatcgccctcgacttcaaacctgggacctccggaagccccattgtgaaccgggagggcaagatcgttggcctgtacgggaatggagtggtcacaacgtctggcacctatgtgtccgctattgcccaggcgaaagctagccaggaagggcctcttcccgagatcgaggatgaagtttttaagaagagaaacctgacaatcatggacctgcaccccggatccggcaaaacccgccggtacctccctgccattgtgagagaggccatcaagcgcaaactgcggacacttattctggctccgaccagagtcgtggcctctgaaatggcggaggctctcaaggggatgcccatccggtatcaaacgacagccgttaaaagcgaacataccggcaaggagattgtggatctgatgtgccacgccaccttcacaatgcgcctgctctcccctgtcagagtgcccaattacaacatgatcatcatggacgaggctcattttaccgatcctgccagcattgctgcccggggatatatctctacacgcgtgggcatgggggaagcggccgctattttcatgaccgccacgccccctggatccgtcgaggcttttccgcagagcaatgccgttatccaggacgaagagagagatattcccgaacggtcttggaacagcggctacgactggatcacagatttccctgggaagaccgtgtggtttgtgccctccatcaaatctggaaatgacattgccaactgtcttagaaagaacggcaaacgcgtcatccagctgagccggaagacattcgacaccgagtatcagaagacgaagaataacgattgggactacgtggttaccacagatatttccgagatgggggctaatttcagagcggaccgcgtgatcgatcctcggagatgcctgaagcccgtcattctcaaagacggcccggaacgcgtgatcctggccggacctatgcccgttaccgctgcctctgccgctcagcggagaggccgcattgggagaaaccagaataaggagggagatcagtacatctatatgggccaaccccttaacaatgacgaagatcacgcccattggacagaggcgaaaatgctgctcgacaacatcaatacccctgaggggattatccccgctctgtttgaacctgagcgggaaaagagcgccgccattgatggagagtaccgcctgagaggcgaagctcggaaaacattcgtggagctcatgcgcagaggggaccttccggtctggctgtcctataaggtggccagcgagggctttcagtactctgatcggagatggtgcttcgacggagaacgcaacaatcaggtcctggaggaaaacatggacgtggagatctggaccaaggaaggcgagcggaaaaagctcagaccccgctggctggatgcgcggacgtattccgaccctcttgccctgagagagtttaaagagttcgctgccgggcggcgcagcgtttccggagatctcattctggagatcggcaagctgccccagcacctcacacttagagctcaaaatgccctggacaacctggtgatgctccacaattctgaacaagggggaaaggcttaccggcatgccatggaggaactgcctgataccatcgagacccttatgctgctcgcgctgattgccgtgctgacaggcggcgtcaccctctttttccttagcgggaagggactgggcaaaacatccatcgggctgctctgtgttatggcttctagcgtgctgctttggatggcctccgtggagccccactggattgctgccagcatcattctggaatttttcctcatggtcctgctgatcccggagcctgaccgccagagaacgccccaggataaccaactcgcctatgtggttatcggacttctgtttatgattctgaccgtggctgcgaacgaaatgggcctcctggagacaaccaagaaggaccttgggatcggacatgtcgtggccgagaatcaccaccatgctacaatgctggatattgacctccaccctgcctctgcctggaccctgtacgctgtcgccacgaccatcattacacccatgatgcggcataccatcgaaaacacaaccgcgaatatttccctgacggccatcgctaaccaggccgctatcctcatgggccttgataaaggctggcctattagcaagatggacatcggggtgcccctgctggccctcggatgctactctcaggttaatccgctgacacttaccgcggccgtgctgatgctcgtcgctcactatgccattatcggccctgggctgcaagctaaagccacacgcgaggctcagaagagaaccgccgcgggaattatgaaaaaccccaccgtggatggcatcgttgccatcgacctggaccccgtggtctacgatgctaagttcgaaaagcagctcgggcagattatgcttctgatcctgtgtacatcccaaattctcctgatgcggacgacctgggccctttgcgagagcatcacactggctaccggacctctcacaaccctgtgggaaggctctccgggcaaattttggaatacgacaattgccgtgagcatggccaacatcttccgcgggtcctatctggcgggagctggcctcgccttctctcttatgaagtccctcgggggaggcagacgggggaccggagctcagggcgagaccctgggcgagaaatggaagagacagctcaatcagctgtccaaaagcgaatttaacacatacaagcgctccgggatcatggaggtggaccggtctgaagccaaggagggacttaaaagaggcgaaaccacaaagcatgccgttagccgcgggacggctaaactgcggtggttcgtcgagagaaatctcgtgaagcccgagggaaaagtgattgatctgggctgtgggcgcggaggctggtcctattactgcgccggcctgaagaaggtcaccgaagttaaagggtatacaaagggaggccctgggcacgaggaacccatccctatggcgacctacggatggaacattgtgaaactccactctggccgggacgtgtttttcacaccccctgagaagtgtgatacccttctgtgcgacatcggggaaagctccccgaatcccacgattgaggagggaagaaccctgcgcgtcctcaaaatggtggaaccttggctgcggggcaaccaattttgtatcaagattcttaatccctacatgccttctgttgtggagacactggaacagatgcagagaaaacatggcgggatgctcgtccgcaaccccctgagcagaaattccacccacgagatgtattgggtgagctgcggaacaggcaacatcgtttctgccgtgaacatgacctccagaatgctgctcaatcgcttcacaatggctcatagaaagccgacctacgagcgggatgtcgacctgggggccggaacgcgccacgtggctgtggaacctgagatcgccaaccttgatattatcggccagagaattgaaaatatcaagaacgagcacaaaagcacatggcattatgacgaagataatccctacaagacctgggcgtatcacgggtcttacgaggtcaaaccctccggaagcgcctcttccatggttaacggcgtggtgcggctgctcaccaagccttgggacgtcattcccatggtgacacaaatcgctatgacggacaccacaccttttggccagcagagagttttcaaagagaaggtggatacccggacaccgcgccccaagagagggaccgcccaaatcatggaagtcacagctaaatggctgtggggatttcttagccggaataagaaacctcgcatttgtaccagagaggagttcacgcggaaggtgcgctccaacgccgctatcggcgccgtttttgtggacgagaatcagtggaacagcgcgaaagaagccgtcgaggatgagagattctgggacctggtgcatcgggaacgcgagctccacaagcaggggaagtgcgctacctgcgtttataatatgatgggaaaaagagaaaagaaactgggcgagtttgggaaggccaaaggctctcgggctatttggtacatgtggctgggagcccgcttcctcgagttcgaggccctgggctttatgaacgaggatcattggttcagcagagaaaattccctttctggggtggagggagaaggcctgcacaagctcgggtacatcctgcgggacattagcaagatccccggaggcaacatgtatgcggatgacacagctgggtgggatacccgcatcacagaggacgatcttcagaatgaggccaaaattaccgacatcatggaacctgagcacgccctgctcgctacgtccatttttaagctgacataccaaaacaaagtcgtgagagtccagcggcccgccaagtctggcaccgtgatggatgttatcagcagacgcgaccagcggggatccggccaggtggggacatatggactgaacaccttcacgaatatggaagtccaactcattagacagatggagtctgaaggcatctttagcccgtccgagctggagaacagcaatcttgctgaacgcgtgctggactggctcgagaaacatggggtggaacggctgaagagaatggccatctctggagatgactgtgttgtgaaacctaccgatgaccgcttcgcgacagcccttaccgctctgaacgatatgggcaaggtccggaaggacattccccagtgggagccttccaaagggtggaatgattggcagcaagtgcccttttgcagccaccatttccaccagctcatcatgaaggacggcagagaaattgttgtgccttgtcgcaaccaggatgagctggtcggacgggccagagtgtctcagggcgctgggtggtccctgcgcgagacagcctgcctcggaaaaagctacgcgcaaatgtggcagctgatgtattttcaccggagagaccttcggctggccgctaatgccatctgttccgctgtccccgtgaactgggttccgacctctagaacaacctggagcattcatgcccaccatcagtggatgacgacagaagatatgctctccgtgtggaatcgcgtctggatcgaggaaaacccttggatggaggacaagacccacgtgagctcttgggaagacgttccctacctgggcaaacgggaggatcaatggtgcgggtcccttattggactgaccgctagagccacatgggcgaccaatatccaggtggccatcaaccaggtccgcagactcattggcaatgagaactatctggactacatgacaagcatgaagcggttcaagaatgaatctgatcccgagggggctctgtggtga

SEQ ID NO: 19470 - RNA, 9879 nt, synthetic construct
  misc_feature 1..9879: note = derived and/or modified CDS sequence (opt5) from DENV-1__KM403597__SS-prME
  source 1..9879: mol_type = other RNA
agcgtgaccatgctgctcatgctgcttcccacagctctggctttccacctcacgacccggggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccgcgcattacagaggctgaacccgacgatgtggactgttggtgcaatgccaccgatacgtgggtgacctatggaacatgttcccaaaccggcgagcacagacgggaccgcagatctgtcgccctggctcctcatgtggggctcggactggagacacggaccgaaacgtggatgagctccgagggcgcctggcgccagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaagaccgaggtcacaaaccctgccgttcttcggaaactgtgcattgaagcgaagatctctaataccacgacagactcccgctgtccgacccaaggagaggccaccctcgtggaagaacaagatgctaacttcgtgtgcagacggacatttgtcgaccgcggctggggcaatgggtgtggactgttcggcaaagggagccttctgacctgcgccaagtttaaatgcgtgacaaagctcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaggagaaatcttggctggtccataagcagtggtttcttgacctgcctctcccctggacgtccggggctagcacatcccaagagacctggaatcggcaggatctgctggtgacattcaaaaccgcgcacgccaagaaacaggaagtcgtggttctcggatctcaagagggcgctatgcacaccgccctgacaggggccacggaaattcagaccagcggaacaaccacaatctttgctggccatcttaagtgcagactgaagatggacaaactcaccctgaagggggtgtcctatgtcatgtgtacgggcagcttcaaactggagaaggaagtggccgagacacagcacggaaccgttcttgtgcaggtcaaatacgagggcaccgatgcgccgtgcaagattcctatctctacacaagacgaaaagggggtgacccagaacggacgcctcatcacagctaatcccattgtgacggataaagagaagcctgttaacatcgaaaccgagccgcccttcggcgagtcctatattgtcatcggggccggagaaaaagccctgaagctgagctggtttaaaaagggctctagcattgggaagatgttcgaggctacagcccggggcgctagacgcatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagccggtctacatcccttagcatgacctgtatcgctgtcggcatggtgacactctacctgggggttatggtgcaggccgactctggatgcgtcattaactggaaaggcagagaactgaagtgtgggtccggaatctttgtgaccaacgaggttcacacatggaccgaacaatataaattccaggctgatagccctaagcgcctctccgccgcgattggcaaggcctgggaggagggggtgtgcggcatccggtctgctacgagactggaaaatatcatgtggaaacagattagcaacgagcttaatcatatcctgctcgaaaacgacatgaagtttacagtcgtggtgggagacgccaatggcattctgacccaggggaaaaagatgatccgcccgcaacccatggagcacaaatactcctggaagtcttggggaaaagctaagattatcggcgccgatacccagaacacaaccttcatcattgacgggcctgatacgcccgaatgtcctgacgatcagcgggcctggaatatctgggaggtcgaggactatggatttggcgttttcacaaccaacatttggctgaaacttagagatagctacacacagatgtgcgaccaccgcctcatgtccgctgcgatcaaagatagcaaggccgtgcatgctgacatgggctattggattgaatctgagaaaaatgaaacctggaagctggcccgggcctcctttatcgaggtgaaaacatgtatctggcccagaagccacaccctgtggtctaacggggtcctcgaatccgagatgattatcccgaagatttacggaggccctatcagccaacataattatcggcccgggtacttcacgcagaccgctggaccttggcacctgggcaaacttgagctggatttcaacctctgcgaagggacaaccgtggttgtggacgagcactgcggaaatcgcggcccctctctgagaacaaccacggtcacaggcaaaattatccatgaatggtgttgccggagctgtaccctgcctccccttagatttcgcggggaggatggatgctggtacggcatggagatccggccggtgaaggaaaaagaggaaaacctcgttagatccatggtgagcgccgggtctggagaggtcgactccttcagcctgggcctgctctgtgtgtccattatgatcgaagaggttatgcgctctagatggagccggaagatgctgatgacagggacccttgcgatctttttcctgctcatcatgggacagctgacctggaatgacctgattcgcctttgcatcatggtgggcgctaacgtctccgatagaatgggcatggggacaacgtatctggccctcatggccacctttaaaatgcggcctatgttcgctgtgggactgctctttcgcagactgacatctcgggaggtgcttctgctcaccattggcctgagcctggtcgcctccgttgaacttcccaactctctggaggaactcggggacggactggcgatgggcatcatgatgctcaagctgcttacagatttccaaagccaccagctgtggaccacgctcctgtccctgacatttatcaagaccacccttagcctggactacgcttggaaaacaatggccatggtgctctctattgtgtccctgttccccctctgtctgagcaccacatctcagaagacgacctggcttcctgtcctgctggggtcctttggatgcaaaccgctcacaatgttcctgatcaccgagaataagatttggggccgcaaaagctggccccttaacgaaggcatcatggccgtggggattgtttctatcctgctctccagcctgctcaagaatgatgtgcctctggctggaccccttatcgccggcgggatgctgattgcttgttatgtcatctccggaagctctgccgacctgagcctcgagagagcggccgaggtgtcctgggaagaggaagctgagcattctggcgccagccacaacattctggttgaagtgcaggatgacgggacaatgaagatcaaagatgaggagcgggacgatacccttacgattctgctcaaggctaccctgctcgccgtctccggagtgtaccctatgtctatccccgccacactgtttgtctggtatttctggcagaagaagaaacagcgcagcggcgtgctttgggacacccctagccctcccgaagttgagagagctgtgctggatgacggcatctaccggattctgcagagagggctcctgggacgctctcaggtcggcgtgggggttttccaagacggagtgtttcatacaatgtggcacgtcacccggggcgcggtgcttatgtatcaggggaaaagactggaacccagctgggcctccgtgaaaaaggatctcatcagctacggaggcggctggcgcttccaggggtcttggaatacaggagaggaggttcaggtcattgctgtggaacccggcaagaaccctaaaaatgtgcaaacgacccccgggacatttaagaccccggagggagaagtcggcgccatcgccctggacttcaaacctgggacctccggaagccccattgtgaaccgggagggcaagatcgttggcctctacgggaatggagtggtcacaacgtctggcacctatgtgtccgctattgcccaggcgaaagctagccaggaagggcctctgcccgagatcgaggatgaagtttttaagaagagaaaccttacaatcatggacctgcaccccggatccggcaaaacccgccggtacctgcctgccattgtgagagaggccatcaagcgcaaactccggacactgattcttgctccgaccagagtcgtggcctctgaaatggcggaggctctgaaggggatgcccatccggtatcaaacgacagccgttaaaagcgaacataccggcaaggagattgtggatctcatctgccacgccaccttcacaatgcgcctgctgtcccctgtcagagtgcccaattacaacatgatcattatggacgaggctcattttaccgatcctgccagcatcgctgcccggggatatatttctacacgcgtgggcatgggggaagcggccgctatcttcatgaccgccacgccccctggatccgtcgaggcttttccgcagagcaatgccgttattcaggacgaagagagagatatccccgaacggtcttggaacagcggctacgactggatcacagatttccctgggaagaccgtgtggtttgtgccctccattaaatctggaaatgacatcgccaactgtctcagaaagaacggcaaacgcgtcattcagcttagccggaagacattcgacaccgagtatcagaagacgaagaataacgattgggactacgtggttaccacagatatctccgagatgggggctaatttcagagcggaccgcgtgattgatcctcggagatgcctgaagcccgtcatcctgaaagacggcccggaacgcgtgattctcgccggacctatgcccgttaccgctgcctctgccgctcagcggagaggccgcatcgggagaaaccagaataaggagggagatcagtacatctatatgggccaacccctgaacaatgacgaagatcacgcccattggacagaggcgaaaatgcttctggacaacattaatacccctgaggggatcattcccgctctctttgaacctgagcgggaaaagagcgccgccatcgatggagagtaccgcctgagaggcgaagctcggaaaacattcgtggagctgatgcgcagaggggacctcccggtctggctttcctataaggtggccagcgagggctttcagtactctgatcggagatggtgcttcgacggagaacgcaacaatcaggtcctggaggaaaacatggacgtggagatttggaccaaggaaggcgagcggaaaaagctgagaccccgctggctcgatgcgcggacgtattccgaccctctggcccttagagagtttaaagagttcgctgccgggcggcgcagcgtttccggagatctgatcctcgagatcggcaagctgccccagcacctgacactcagagctcaaaatgcccttgacaacctggtgatgctgcacaattctgaacaagggggaaaggcttaccggcatgccatggaggaactccctgataccattgagaccctgatgcttctggcgctcatcgccgtgctgacaggcggcgtcaccctgtttttcctcagcgggaagggacttggcaaaacatccattgggctgctgtgtgttatggcttctagcgtgctcctgtggatggcctccgtggagccccactggatcgctgccagcattatccttgaatttttcctgatggtcctcctgatcccggagcctgaccgccagagaacgccccaggataaccaactggcctatgtggttattggactcctttttatgatcctgaccgtggctgcgaacgaaatgggcctgctcgagacaaccaagaaggacctggggattggacatgtcgtggccgagaatcaccaccatgctacaatgcttgatatcgacctgcaccctgcctctgcctggaccctctacgctgtcgccacgaccattatcacacccatgatgcggcataccattgaaaacacaaccgcgaatatctccctgacggccatcgctaaccaggccgctattctgatgggcctcgataaaggctggcctatcagcaagatggacattggggtgccccttctggccctgggatgctactctcaggttaatccgctcacactgaccgcggccgtgcttatgctggtcgctcactatgccatcattggccctgggctccaagctaaagccacacgcgaggctcagaagagaaccgccgcgggaatcatgaaaaaccccaccgtggatggcatcgttgccattgacctggaccccgtggtctacgatgctaagttcgaaaagcagctggggcagatcatgctccttattctgtgtacatcccaaatcctgctcatgcggacgacctgggccctgtgcgagagcattacacttgctaccggacctctgacaaccctctgggaaggctctccgggcaaattttggaatacgacaatcgccgtgagcatggccaacatcttccgcgggtcctatctggcgggagctggcctggccttctctctcatgaagtcccttgggggaggcagacgggggaccggagctcagggcgagaccctgggcgagaaatggaagagacagctgaatcagctctccaaaagcgaatttaacacatacaagcgctccgggattatggaggtggaccggtctgaagccaaggagggactgaaaagaggcgaaaccacaaagcatgccgttagccgcgggacggctaaacttcggtggttcgtcgagagaaatctggtgaagcccgagggaaaagtgatcgatctcggctgtgggcgcggaggctggtcctattactgcgccggcctgaagaaggtcaccgaagttaaagggtatacaaagggaggccctgggcacgaggaacccattcctatggcgacctacggatggaacatcgtgaaactgcactctggccgggacgtgtttttcacaccccctgagaagtgtgataccctcctttgcgacattggggaaagctccccgaatcccacgatcgaggagggaagaaccctgcgcgtcctgaaaatggtggaaccttggctccggggcaaccaattttgtattaagatcctgaatccctacatgccttctgttgtggagacacttgaacagatgcagagaaaacatggcgggatgctggtccgcaaccccctcagcagaaattccacccacgagatgtattgggtgagctgcggaacaggcaacatcgtttctgccgtgaacatgacctccagaatgctgctgaatcgcttcacaatggctcatagaaagccgacctacgagcgggatgtcgacctcggggccggaacgcgccacgtggctgtggaacctgagattgccaacctggatatcattggccagagaatcgaaaatattaagaacgagcacaaaagcacatggcattatgacgaagataatccctacaagacctgggcgtatcacgggtcttacgaggtcaaaccctccggaagcgcctcttccatggttaacggcgtggtgcggcttctgaccaagccttgggacgtcatccccatggtgacacaaatcgctatgacggacaccacaccttttggccagcagagagttttcaaagagaaggtggatacccggacaccgcgccccaagagagggaccgcccaaattatggaagtcacagctaaatggctctggggatttctgagccggaataagaaacctcgcatctgtaccagagaggagttcacgcggaaggtgcgctccaacgccgctattggcgccgtttttgtggacgagaatcagtggaacagcgcgaaagaagccgtcgaggatgagagattctgggaccttgtgcatcgggaacgcgagctgcacaagcaggggaagtgcgctacctgcgtttataatatgatgggaaaaagagaaaagaaactcggcgagtttgggaaggccaaaggctctcgggctatctggtacatgtggctgggagcccgcttcctggagttcgaggccctcggctttatgaacgaggatcattggttcagcagagaaaattccctgtctggggtggagggagaaggccttcacaagctggggtacattctccgggacatcagcaagatccccggaggcaacatgtatgcggatgacacagctgggtgggatacccgcattacagaggacgatctgcagaatgaggccaaaatcaccgacattatggaacctgagcacgcccttctggctacgtccatctttaagctcacataccaaaacaaagtcgtgagagtccagcggcccgccaagtctggcaccgtgatggatgttattagcagacgcgaccagcggggatccggccaggtggggacatatggactgaacaccttcacgaatatggaagtccaactgatcagacagatggagtctgaaggcatctttagcccgtccgagctcgagaacagcaatctggctgaacgcgtgcttgactggctggagaaacatggggtggaacggctcaagagaatggccatttctggagatgactgtgttgtgaaacctaccgatgaccgcttcgcgacagccctgaccgctcttaacgatatgggcaaggtccggaaggacatcccccagtgggagccttccaaagggtggaatgattggcagcaagtgcccttttgcagccaccatttccaccagctgattatgaaggacggcagagaaatcgttgtgccttgtcgcaaccaggatgagctcgtcggacgggccagagtgtctcagggcgctgggtggtccctgcgcgagacagcctgcctgggaaaaagctacgcgcaaatgtggcagctcatgtattttcaccggagagacctgcggcttgccgctaatgccatttgttccgctgtccccgtgaactgggttccgacctctagaacaacctggagcatccatgcccaccatcagtggatgacgacagaagatatgctgtccgtgtggaatcgcgtctggattgaggaaaacccttggatggaggacaagacccacgtgagctcttgggaagacgttccctacctcggcaaacgggaggatcaatggtgcgggtccctgatcggacttaccgctagagccacatgggcgaccaatatccaggtggccattaaccaggtccgcagactgatcggcaatgagaactatctcgactacatgacaagcatgaagcggttcaagaatgaatctgatcccgagggggctctgtggtga

SEQ ID NO: 19471 - RNA, 9879 nt, synthetic construct
  misc_feature 1..9879: note = derived and/or modified CDS sequence (opt5) from DENV-1__KM403610__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaaatctctgctttttaagacaagcgccggcgttaatatgtgcaccctgattgcgatggacctcggggaactgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgttgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaagatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacgatccacaccggcgatcagcatcaagtggggaatgagacaaccgaacacggaacaattgctaccatcacgccccaggcccctacctccgagattcagctgacagactacggcgccctcaccctggactgtagcccccggacaggccttgatttcaacgaaatggttctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggtcgtgctcggatctcaagagggcgctatgcacaccgccctgacaggggccacggaaatccagaccagcggaacaaccacaatttttgctggccatcttaaatgcagactgaagatggacaaactcaccctgaagggggtttcctatgtgatgtgtacgggcagcttcaaactggagaaggaagtcgccgagacacagcacggaaccgtgcttgttcaggtgaagtacgagggcaccgatgcgccgtgcaaaatccctatctctacacaagacgaaaagggggtcacccagaacggacggctcattacagctaatcccatcgtgacggataaagagaagcctgtgaacattgaaaccgagccgcccttcggcgagtcctatatcgttattggggccggagaaaaagccctgaagctgagctggtttaagaaaggctctagcatcgggaagatgttcgaggctacagccagaggcgctcgccggatggccatcctcggagacaccgcgtgggattttggctccattgggggagtcttcacatctgtgggcaaactggtgcatcaggtctttgggaccgcctacggagtgcttttcagcggcgtttcctggacgatgaagatcgggattggcatcctgctcacctggctgggactgaatagcagatctacatcccttagcatgacctgtattgctgtgggcatggtcacactctacctgggggtgatggttcaggccgactctggatgcgtgatcaactggaaaggccgcgaactgaagtgtgggtccggaatttttgtcaccaacgaggtgcacacatggaccgaacaatataagttccaggctgatagccctaaacggctctccgccgcgatcggcaaggcctgggaggagggggtttgcggcatcagatctgctacgcgcctggaaaatattatgtggaaacagatcagctccgagcttaaccatattctgctcgaaaatgacatgaagtttacagtggtcgtgggagacgccaacggcatcctgacccaggggaaaaagatgattcggccgcaacccatggagcacaaatactcttggaaaagctggggaaaggctaagatcatcggcgccgatacccagaatacaaccttcattatcgacgggcctgatacgcccgaatgtcctgacgatcagagagcctggaacatttgggaggtggaggactatggatttggcgtcttcacaaccaatatctggctgaaacttcgcgattcctacacacagatgtgcgaccaccggctcatgagcgctgcgattaaagattctaaggccgttcatgctgacatgggctattggatcgaatccgagaaaaacgaaacctggaagctggccagagccagctttatcgaggtgaagacatgtatttggccccgctctcacaccctgtggtccaatggggtgctcgaaagcgagatgatcattccgaaaatctacggaggccctatttctcaacataactatcggcccgggtacttcacgcagaccgctggaccttggcacctgggcaaacttgagctggatttcaatctctgcgaagggacaaccgtcgtggttgacgagcactgcggaaacagaggccccagcctgcggacaaccacggtgacaggcaaaatcatccatgaatggtgttgccgctcctgtaccctgcctccccttagatttagaggggaagatggatgctggtacggcatggagattcggccggtcaaggaaaaagaggaaaatctcgtgcgcagcatggtttctgccgggtccggagaggtggacagcttctccctgggcctgctctgtgtctctatcatgattgaagaggtgatgcggagcagatggtccaagaagatgctgatgacagggacccttgcggtctttttcctgctcatcatgggacagctgacctggaacgacctgattcgcctttgcatcatggtgggcgctaatgtctctgatagaatgggcatggggacaacgtatctggccctcatggccacctttaaaatgcggcctatgttcgctgtgggactgctctttcgcagactgacaagccgggaggtgcttctgctcaccattggcctgtccctggtcgcctctgttgaacttcccaacagcctggaggaactcggggacggactggcgatgggcatcatgatgctcaagctgcttacagatttccaatcccaccagctgtggaccacgctcctgagcctgacatttatcaaaaccaccctttctctggactacgcttggaagacaatggccatggtgctctccattgtgagcctgttccccctctgtctgtctaccacatcccagaaaacgacctggcttcctgtcctgctggggagctttggatgcaagccgctcacaatgttcctgatcaccgagaacaagatttggggccgcaaatcttggccccttaatgaaggcatcatggccgtggggattgtttccatcctgctcagctccctgctcaagaacgatgtgcctctggctggaccccttatcgccggcgggatgctgattgcttgttatgtcatcagcggatctagcgccgacctgtccctcgagagagcggccgaggtgtcttgggaagaggaagctgagcatagcggcgcctcccacaatattctggttgaagtgcaggatgacgggacaatgaaaatcaaggatgaggagcgggacgatacccttacgattctgctcaaagctaccctgctcgccgtctctggagtgtaccctatgagcatccccgccacactgtttgtctggtatttctggcaaaagaaaaagcagcgctccggcgtgctttgggacaccccttctcccccggaagttgagagagctgtgctggatgacggcatctaccggattctgcagcgcgggctcctgggaagaagccaggtcggcgtgggggttttccaagacggagtgtttcatacaatgtggcacgtcacccggggcgcggtgcttatgtatcaggggaagagactggaaccttcctgggccagcgtgaaaaaggatctcatctcttacggaggcggctggcgcttccaggggtcctggaacacaggagaggaggttcaggtcattgctgtggaacccggcaaaaatcctaagaacgtgcaaacgacccccgggacatttaaaaccccggagggagaagtcggcgccatcgccctggacttcaagcctgggaccagcggatctcccattgtgaatcgggagggcaagatcgttggcctctacgggaacggagtggtcacaacgtccggcacctatgtgagcgctattgcccaggcgaaggcttcccaggaagggcctctgcccgagatcgaggatgaagtttttaagaaaagaaatcttacaatcatggacctgcaccccggatctggcaagacccgccggtacctgcctgccattgtgagagaggccatcaaacgcaagctccggacactgattcttgctccgaccagagtcgtggccagcgaaatggcggaggctctgaaggggatgcccatccgctatcaaacgacagccgttaaatccgaacataccggcaaggagattgtggatctcatgtgccacgccaccttcacaatgcggctgctgagccctgtcagagtgcccaactacaatatgatcatcatggacgaggctcattttaccgatcctgcctctattgctgcccggggatatatctccacacgcgtgggcatgggggaagcggccgctattttcatgaccgccacgccccctggaagcgtcgaggcttttccgcagtctaacgccgttatccaggacgaagagagagatattcccgaacggagctggaactccggctacgactggatcacagatttccctgggaaaaccgtgtggtttgtgccctctatcaagagcggaaacgacattgccaattgtctccgcaaaaacggcaagagagtcatccagctttcccggaagacattcgacaccgagtatcagaagacgaagaacaatgattgggactacgtggttaccacagatatttctgagatgggggctaacttcagagcggaccgcgtgatcgatcctcggagatgcctgaaacccgtcattctgaaggacggcccggaacgcgtgatcctcgccggacctatgcccgttaccgctgccagcgccgctcagcggagaggccgcattgggcggaatcagaacaaagagggagatcagtacatctatatgggccaacccctgaataacgacgaagatcacgcccattggacagaggcgaagatgcttctggacaatatcaacacccctgaggggattatccccgctctctttgaacctgagagagaaaagtccgccgccattgatggagagtaccgcctgagaggcgaagctcggaaaacattcgtggagctgatgcgcagaggggacctcccggtctggcttagctataaggtggcctctgagggctttcagtactccgatcggcgctggtgcttcgacggagaaagaaataaccaggtcctggaggaaaatatggacgtggagatctggaccaaagaaggcgagcggaagaaactgagaccccgctggctcgatgcgcggacgtatagcgaccctctggcccttagagagtttaaggagttcgctgccgggcgccggtccgtttctggagatctgattctcgagatcggcaaactgccccagcacctgacactcagagctcaaaacgcccttgacaatctggtgatgctgcacaacagcgaacaagggggaaaggcttaccggcatgccatggaggaactccctgataccatcgagaccctgatgcttctggcgctcattgccgtgctgacaggcggcgtcaccctgtttttcctctccgggaagggacttggcaaaacatctatcgggctgctgtgtgttatggctagctccgtgctcctgtggatggccagcgtggagccccactggattgctgcctctatcattcttgaatttttcctgatggtcctcctgatcccggagcctgaccgccagagaacgccccaggataatcaactggcctatgtggttatcggactcctttttatgattctgaccgtggctgcgaacgaaatgggcctgctcgagacaaccaagaaagacctggggatcggacatgtcgtggccgagaaccaccaccatgctacaatgcttgatattgacctgcaccctgcctccgcctggaccctctacgctgtcgccacgaccatcattacacccatgatgcggcataccatcgaaaatacaaccgcgaacattagcctgacggccatcgctaatcaggccgctatcctgatgggcctcgataagggctggcctatttctaaaatggacatcggggtgccccttctggccctgggatgctactcccaggttaacccgctcacactgaccgcggccgtgcttatgctggtcgctcactatgccattatcggccctgggctccaagctaaggccacacgcgaggctcagaagagaaccgccgcgggaattatgaaaaatcccaccgtggatggcatcgttgccatcgacctggaccccgtggtctacgatgctaagttcgaaaaacagctggggcagattatgctccttatcctgtgtacaagccaaattctgctcatgcggacgacctgggccctgtgcgagtctatcacacttgctaccggacctctgacaaccctctgggaaggcagcccgggcaagttttggaacacgacaattgccgtgtccatggccaatatcttccgcgggtcttatctggcgggagctggcctggccttcagcctcatgaaatcccttgggggaggcagacgggggaccggagctcagggcgagaccctgggcgagaagtggaagcgccagctgaaccagctcagcaaatccgaatttaatacatacaagagatctgggatcatggaggtggaccggagcgaagccaaagagggactgaagagaggcgaaaccacaaaacatgccgtttcccgcgggacggctaaacttcggtggttcgtcgagagaaacctggtgaagcccgagggaaaagtgattgatctcggctgtgggcgcggaggctggtcttattactgcgccggcctgaagaaagtcaccgaagttaaggggtatacaaaaggaggccctgggcacgaggaacccatccctatggcgacctacggatggaatattgtgaagctgcacagcggccgggacgtgtttttcacaccccctgagaaatgtgataccctcctttgcgacatcggggaatcctctccgaaccccacgattgaggagggaagaaccctgcgcgtcctgaagatggtggaaccttggctccggggcaatcaattttgtatcaagattctgaacccctacatgcctagcgttgtggagacacttgaacagatgcagagaaaacatggcgggatgctggtccgcaatcccctctcccggaacagcacccacgagatgtattgggtgtcttgcggaacaggcaatatcgtttccgccgtgaacatgaccagcagaatgctgctgaaccgcttcacaatggctcatcggaagccgacctacgagagagatgtcgacctcggggccggaacgcgccacgtggctgtggaacctgagatcgccaatctggatattatcggccagagaattgaaaacatcaaaaatgagcacaagtctacatggcattatgacgaagataacccctacaaaacctgggcgtatcacgggtcctacgaggtcaagcccagcggatctgcctccagcatggttaatggcgtggtgcggcttctgaccaagccttgggacgtcattcccatggtgacacaaatcgctatgacggacaccacaccttttggccagcagcgcgttttcaaagagaaggtggataccagaacaccgcggcccaaaagagggaccgcccaaatcatggaagtcacagctaagtggctctggggatttctgtcccggaacaaaaagcctcgcatttgtaccagagaggagttcacgcggaaggtgcgcagcaatgccgctatcggcgccgtttttgtggacgagaaccagtggaactctgcgaaagaagccgtcgaggatgagagattctgggaccttgtgcatcgggaacgcgagctgcacaagcaggggaaatgcgctacctgcgtttataacatgatgggaaagagagagaagaagctcggcgagtttgggaaggccaaaggcagccgggctatttggtacatgtggctgggagcccgcttcctggagttcgaggccctcggctttatgaatgaggatcattggttctccagagaaaactctctgagcggggtggagggagaaggccttcacaagctggggtacatcctccgggacatttccaaaatccccggaggcaatatgtatgcggatgacacagctgggtgggatacccgcatcacagaggacgatctgcagaacgaggccaagattaccgacatcatggaacctgagcacgcccttctggctacgtctatttttaaactcacataccaaaataaggtcgtgagagtccagcggcccgccaaaagcggcaccgtgatggatgttatctcccgcagagaccagcggggatctggccaggtggggacatatggactgaacaccttcacgaacatggaagtccaactgattagacagatggagagcgaaggcatctttctcccgtccgagctggagaatagcaaccttgctgaacgcgtgctggactggctcgagaagcatggggtggaacggctgaagagaatggccatctctggagatgactgtgttgtgaaacctaccgatgaccgcttcgcgacagcccttaccgctctgaatgatatgggcaaggtccggaaagacattccccagtgggagccttccaaggggtggaacgattggcagcaagtgcccttttgcagccaccatttccaccagctcatcatgaaagacggcagagaaattgttgtgccttgtcgcaatcaggatgagctggtcggacgggccagagtgtctcagggcgctgggtggtccctgcgcgagacagcctgcctcggaaagagctacgcgcaaatgtggcagctgatgtattttcaccggagagaccttcgcctggccgctaacgccatctgttccgctgtccccgtgaattgggttccgacctctcggacaacctggagcattcatgcccaccatcagtggatgacgacagaagatatgctctccgtgtggaacagagtctggatcgaggaaaatccttggatggaggacaagacccacgtgagctcttgggaagacgttccctacctgggcaaacgggaggatcaatggtgcgggtcccttattggactgaccgctagagccacatgggcgaccaacatccaggtggccatcaatcaggtccgccggctcattggcaacgagaattatctggactacatgacaagcatgaagagattcaaaaacgaatctgatcccgagggggctctgtggtga

SEQ ID NO: 19472 - RNA, 9879 nt, synthetic construct
  misc_feature 1..9879: note = derived and/or modified CDS sequence (opt5) from DENV-1__KM403596__SS-prME
  source 1..9879: mol_type = other RNA
agcgtgaccatgctgctgatgctgcttcccacagctctggctttccacctcacgaccagaggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccccgcatcacagaggctgaacccgacgatgtggactgttggtgcaatgccaccgatacgtgggtgacctatggaacatgttcccaaaccggcgagcacagacgggaccgcagatctgtcgccctggctcctcatgtggggctcggactggagacacggaccgaaacgtggatgagctccgagggcgcctggcgccagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaagaccgaggtcacaaaccctgccgttcttcggaaactgtgcattgaagcgaagatctctaataccacgacagactcccgctgtccgacccaaggagaggccaccctcgtggaagaacaagatgctaacttcgtgtgcagacggacatttgtcgaccgcggctggggcaatgggtgtggactgttcggcaaagggagccttctgacctgcgccaagtttaaatgcgtgacaaagctcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcagcctggactgttctcccagaaccggccttgatttcaacgaaatggtgctgctcacaatgaaggagaaatcctggctggtccataagcagtggtttcttgacctgcctctcccctggaccagcggggcttccacgtctcaagagacatggaatcggcaggatctgctggtgaccttcaaaacagcgcacgccaagaaacaggaagtcgtggttctcggaagccaagagggcgctatgcacaccgccctgaccggggccacagaaattcagacgtccggaaccacaaccatctttgctggccatcttaagtgcagactgaagatggacaaactcacactgaagggggtgagctatgtcatgtgtaccggctctttcaaactggagaaggaagtggccgagacgcagcacggaacagttcttgtgcaggtcaaatacgagggcaccgatgcgccgtgcaagattcctatctccacccaagacgaaaagggggtgacacagaacggacgcctcatcaccgctaatcccattgtgacagataaagagaagcctgttaacatcgaaattgagccgcccttcggcgagagctatatcgtcattggggccggagaaaaagccctgaagctgtcttggtttaaaaagggcagctccatcgggaagatgttcgaggctacggcccggggcgctagacgcatggccatcctcggagacaccgcgtgggattttggctctattgggggagtgttcacaagcgtgggcaaactggtccatcaggtgtttgggaccgcctacggagttcttttctccggcgtgagctggacaatgaagatcgggattggcatcctgctcacctggctgggactcaattctcggtccacgagcctttctatgacctgtattgctgtcggcatggtgacactctacctgggggttatggtgcaggccgactccggatgcgtcatcaactggaaaggcagagaactgaagtgtgggagcggaatttttgtgaccaacgaggttcacacatggaccgaacaatataaattccaggctgattcccctaagcgcctctctgccgcgatcggcaaggcctgggaggagggggtgtgcggcatccggagcgctacaagactggaaaatattatgtggaaacagatctccaacgagcttaatcatattctgctcgaaaacgacatgaagtttaccgtcgtggtgggagacgccaatggcatcctgacgcaggggaaaaagatgattcgcccgcaacccatggagcacaaatactcttggaaaagctggggaaaagctaagatcatcggcgccgatacacagaacaccaccttcattatcgacgggcctgatacacccgaatgtcctgacgatcagcgggcctggaatatttgggaggtcgaggactatggatttggcgttttcaccacgaacatctggctgaaacttagagattcctacacacagatgtgcgaccaccgcctcatgagcgctgcgattaaagattctaaggccgtgcatgctgacatgggctattggatcgaatccgagaaaaatgaaacctggaagctggcccgggccagctttatcgaggtgaaaacatgtatttggcccagatctcacaccctgtggtccaacggggtcctcgaaagcgagatgatcattccgaagatctacggaggccctatttctcaacataattatcggcccgggtacttcacacagaccgctggaccttggcacctgggcaaacttgagctggatttcaacctctgcgaagggacgaccgtggttgtggacgagcactgcggaaatcgcggccccagcctgagaacaaccacagtcaccggcaaaatcatccatgaatggtgttgccggtcctgtacgctgcctccccttagatttcgcggggaggatggatgctggtacggcatggagattcggccggtgaaggaaaaagaggaaaacctcgttagaagcatggtgtctgccgggtccggagaggtcgacagcttctccctgggcctgctctgtgtgtctatcatgattgaagaggttatgcgcagcagatggtcccggaagatgctgatgacagggacccttgcgatctttttcctgctcattatgggacagctgacatggaatgacctgatccgcctttgcattatggtgggcgctaacgtctctgatagaatgggcatggggaccacctatctggccctcatggccacatttaaaatgcggcctatgttcgctgtgggactgctctttcgcagactgacgagccgggaggtgcttctgctcaccatcggcctgtccctggtcgcctctgttgaacttcccaacagcctggaggaactcggggacggactggcgatgggcatcatgatgctcaagctgcttacagatttccaatcccaccagctgtggaccacactcctgagcctgacctttattaagacgacactttctctggactacgcttggaaaaccatggccatggtgctctccatcgtgagcctgttccccctctgtctgtctaccacatcccagaagaccacatggcttcctgtcctgctggggagctttggatgcaaaccgctcacgatgttcctgattaccgagaataagatctggggccgcaaatcttggccccttaacgaaggcattatggccgtggggatcgtttccatcctgctcagctccctgctcaagaatgatgtgcctctggctggaccccttattgccggcgggatgctgatcgcttgttatgtcattagcggatctagcgccgacctgtccctcgagagagcggccgaggtgtcttgggaagaggaagctgagcatagcggcgcctcccacaacatcctggttgaagtgcaggatgacgggacaatgaagattaaagatgaggagcgggacgatacccttacaatcctgctcaaggctaccctgctcgccgtctctggagtgtaccctatgagcatccccgccacgctgtttgtctggtatttctggcagaagaagaaacagcgctccggcgtgctttgggacaccccttctcccccggaagttgagagagctgtgctggatgacggcatttaccggatcctgcagagagggctcctgggacgcagccaggtcggcgtgggggttttccaagacggagtgtttcatacaatgtggcacgtcacccggggcgcggtgcttatgtatcaggggaagagactggaaccttcctgggccagcgtgaaaaaggatctcatttcttacggaggcggctggcgcttccaggggtcctggaatacaggagaggaggttcaggtcatcgctgtggaacccggcaagaaccctaaaaatgtgcaaaccacacccgggacgtttaagaccccggagggagaagtcggcgccattgccctggacttcaaacctgggacaagcggatctcccatcgtgaaccgggagggcaagattgttggcctctacgggaatggagtggtcaccacctccggcacatatgtgagcgctatcgcccaggcgaaggcttcccaggaagggcctctgcccgagatcgaggatgaagtttttaagaagagaaaccttacgattatggacctgcaccccggatctggcaaaacccgccggtacctgcctgccatcgtgagagaggccattaagcgcaaactccggacactgatccttgctccgaccagagtcgtggccagcgaaatggcggaggctctgaaggggatgcccattcggtatcaaacaaccgccgttaaatccgaacatacgggcaaggagatcgtggatctcatgtgccacgccacattcaccatgcgcctgctgagccctgtcagagtgcccaattacaacatgatcattatggacgaggctcattttaccgatcctgcctctatcgctgcccggggatatatttccacacgcgtgggcatgggggaagcggccgctatcttcatgaccgccacaccccctggaagcgtcgaggcttttccgcagtctaatgccgttattcaggacgaagagagagatatccccgaacggagctggaactccggctacgactggatcaccgatttccctgggaagacggtgtggtttgtgccctctattaaaagcggaaatgacatcgccaactgtctcagaaagaacggcaaacgcgtcattcagctttcccggaagacattcgacaccgagtatcagaaaaccaagaataacgattgggactacgtggttaccacggatatctctgagatgggggctaatttcagagcggaccgcgtgattgatcctcggagatgcctgaagcccgtcatcctgaaagacggcccggaacgcgtgattctcgccggacctatgcccgttaccgctgccagcgccgctcagcggagaggccgcatcgggagaaaccagaataaggagggagatcagtacatctatatgggccaacccctgaacaatgacgaagatcacgcccattggacagaggcgaaaatgcttctggacaacattaatacccctgaggggatcattcccgctctctttgaacctgagcgggaaaagtccgccgccatcgatggagagtaccgcctgagaggcgaagctcggaaaacattcgtggagctgatgcgcagaggggacctcccggtctggcttagctataaggtggcctctgagggctttcagtactccgatcggagatggtgcttcgacggagaacgcaacaatcaggtcctggaggaaaacatggacgtggagatttggaccaaggaaggcgagcggaaaaagctgagaccccgctggctcgatgcgcggacatatagcgaccctctggcccttagagagtttaaagagttcgctgccgggcggcgctccgtttctggagatctgatcctcgagatcggcaagctgccccagcacctgaccctcagagctcaaaatgcccttgacaacctggtgatgctgcacaatagcgaacaagggggaaaggcttaccggcatgccatggaggaactccctgatacgattgagacactgatgcttctggcgctcatcgccgtgctgaccggcggcgtcaccctgtttttcctctccgggaagggacttggcaaaacatctattgggctgctgtgtgttatggctagctccgtgctcctgtggatggccagcgtggagccccactggatcgctgcctctattatccttgaatttttcctgatggtcctcctgatcccggagcctgaccgccagagaacaccccaggataaccaactggcctatgtggttattggactcctttttatgatcctgacagtggctgcgaacgaaatgggcctgctcgagacgaccaagaaggacctggggattggacatgtcgtggccgagaatcaccaccatgctacaatgcttgatatcgacctgcaccctgcctccgcctggaccctctacgctgtcgccacaaccattatcacgcccatgatgcggcataccattgaaaacacaaccgcgaatatcagcctgacagccatcgctaaccaggccgctattctgatgggcctcgataaaggctggcctatctctaagatggacattggggtgccccttctggccctgggatgctactcccaggttaatccgctcaccctgacggcggccgtgcttatgctggtcgctcactatgccatcattggccctgggctccaagctaaagccacacgcgaggctcagaagagaaccgccgcgggaatcatgaaaaaccccacagtggatggcatcgttgccattgacctggaccccgtggtctacgatgctaagttcgaaaagcagctggggcagatcatgctccttattctgtgtaccagccaaatcctgctcatgcggaccacatgggccctgtgcgagtctattacgcttgctaccggacctctgacaaccctctgggaaggcagcccgggcaaattttggaatacaaccatcgccgtgtccatggccaacatcttccgcgggtcttatctggcgggagctggcctggccttcagcctcatgaagtcccttgggggaggcagacgggggacgggagctcagggcgagacactgggcgagaaatggaagagacagctgaatcagctcagcaaatccgaatttaacacctacaagcgctctgggattatggaggtggaccggagcgaagccaaggagggactgaaaagaggcgaaaccacaaagcatgccgtttcccgcgggaccgctaaacttcggtggttcgtcgagagaaatctggtgaagcccgagggaaaagtgatcgatctcggctgtgggcgcggaggctggtcttattactgcgccggcctgaagaaggtcacagaagttaaagggtatacgaagggaggccctgggcacgaggaacccattcctatggcgacctacggatggaacatcgtgaaactgcacagcggccgggacgtgtttttcacaccccctgagaagtgtgataccctcctttgcgacattggggaatcctctccgaatcccacaatcgaggagggaagaaccctgcgcgtcctgaaaatggtggaaccttggctccggggcaaccaattttgtattaagatcctgaatccctacatgcctagcgttgtggagacgcttgaacagatgcagagaaaacatggcgggatgctggtccgcaaccccctctcccggaatagcacccacgagatgtattgggtgtcttgcggaacaggcaacatcgtttccgccgtgaacatgaccagcagaatgctgctgaatcgcttcacaatggctcatagaaagccgacctacgagcgggatgtcgacctcggggccggaacacgccacgtggctgtggaacctgagaccgccaacctggatattatcggccagagaattgaaaatatcaagaacgagcacaaatctacgtggcattatgacgaagataatccctacaagacatgggcgtatcacgggtcctacgaggtcaaacccagcggatctgcctccagcatggttaacggcgtggtgcggcttctgaccaagccttgggacgtcattcccatggtgacccaaatcgctatgacagacacgaccccttttggccagcagagagttttcaaagagaaggtggatacacggaccccgcgccccaagagagggacagcccaaatcatggaagtcaccgctaaatggctctggggatttctgtcccggaataagaaacctcgcatttgtacaagagaggagttcacccggaaggtgcgcagcaacgccgctatcggcgccgtttttgtggacgagaatcagtggaactctgcgaaagaagccgtcgaggatgagagattctgggaccttgtgcatcgggaacgcgagctgcacaagcaggggaagtgcgctacgtgcgtttataatatgatgggaaaaagagaaaagaaactcggcgagtttgggaaggccaaaggcagccgggctatttggtacatgtggctgggagcccgcttcctggagttcgaggccctcggctttatgaacgaggatcattggttctccagagaaaattctctgagcggggtggagggagaaggccttcacaagctggggtacatcctccgggacatttccaagatccccggaggcaacatgtatgcggatgacaccgctgggtgggatacacgcatcaccgaggacgatctgcagaatgaggccaaaattacagacatcatggaacctgagcacgcccttctggctacctctatttttaagctcacgtaccaaaacaaagtcgtgagagtccagcggcccgccaagagcggcacagtgatggatgttatctccagacgcgaccagcggggatctggccaggtggggacctatggactgaacacattcaccaatatggaagtccaactgattagacagatggagagcgaaggcatcttttccccgagcgagctcgagaactctaatctggctgaacgcgtgcttgactggctggagaaacatggggtggaacggctcaagagaatggccatctccggagatgactgtgttgtgaaacctacggatgaccgcttcgcgaccgccctgacagctcttaacgatatgggcaaggtccggaaggacattccccagtgggagcctagcaaagggtggaatgattggcagcaagtgcccttttgctctcaccatttccaccagctgatcatgaaggacggcagagaaattgttgtgccttgtcgcaaccaggatgagctcgtcggacgggccagagtgtcccagggcgctgggtggagcctgcgcgagaccgcctgcctgggaaaatcctacgcgcaaatgtggcagctcatgtattttcaccggagagacctgcggcttgccgctaatgccatctgttctgctgtccccgtgaactgggttccgacaagcagaaccacatggtccattcatgcccaccatcagtggatgaccacggaagatatgctgagcgtgtggaatcgcgtctggatcgaggaaaacccttggatggaggacaagacacacgtgtcttcctgggaagacgttccctacctcggcaaacgggaggatcaatggtgcgggagcctgattggacttaccgctagagccacctgggcgacaaatatccaggtggccatcaaccaggtccgcagactgattggcaatgagaactatctcgactacatgacctctatgaagcggttcaagaatgaaagcgatcccgagggggctctgtggtga

SEQ ID NO: 19473 - RNA, 9879 nt, synthetic construct
  misc_feature 1..9879: note = derived and/or modified CDS sequence (opt5) from DENV-1__KM403616__SS-prME
  source 1..9879: mol_type = other RNA
agcgtgaccatgctgctcatgctgcttcccacagctctggctttccacctcacgacccggggcggggagcctcatatgatcgtctccaagcaggaacggggaaagtctctgctttttaagacaagcgctggcgttaacatgtgcaccctgattgcgatggacctcggggagctgtgtgaagatacaatgacctacaaatgcccgcgcatcacagaggctgaacccgacgatgtggactgttggtgcaatgctaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtggtcgtgacggttcacaccggcgatcagcatcaagtggggaatgagacaaccgaacacggaacaatcgctaccatcacgccccaggcccctacctccgagattcagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggttgtgctcggatctcaagagggcgctatgcacaccgccctgacaggggccacggaaatccagaccagcggaacaaccacaatttttgctggccatcttaaatgcagactgaagatggacaaactcaccctgaagggggtctcctatgtgatgtgtacgggcagcttcaaactggagaaggaagttgccgagacacagcacggaaccgtgcttgtccaggtgaagtacgagggcaccgatgcgccgtgcaaaatccctatttctacacaagacgaaaagggggtgacccagaacggacggctcatcacagctaatcccatcgttacggataaagagaagcctgtcaacattgaaaccgagccgcccttcggcgagtcctatatcgtgattggggccggagaaaaagccctgaagctgagctggtttaagaaaggctctagcatcgggaagatgttcgaggctacagccagaggcgctcgccggatggccattctcggagacaccgcgtgggattttggctccatcgggggagtgttcacatctgtcggcaaactggtgcatcaggtttttgggaccgcctacggagtgcttttcagcggcgtctcctggacgatgaagatcgggattggcatcctgctcacctggctgggactgaatagcagatctacatcccttagcatgacctgtattgctgtgggcatggttacactctacctgggggtgatggtccaggccgactctggatgcgtgatcaactggaaaggccgcgaactgaagtgtgggtccggaatttttgttaccaacgaggtgcacacatggaccgaacaatataagttccaggctgatagccctaaacggctctccgccgcgatcggcaaggcctgggaggagggggtctgcggcattagatctgctacgcgcctggaaaatatcatgtggaaacagatcagcaacgagcttaatcatattctgctcgaaaacgacatgaagtttacagtggtggtcggagacgccaatggcatcctgacccaggggaaaaagatgattcggccgcaacccatggagcacaaatactcctggaagtcttggggaaaggctaaaatcattggcgccgatacccagaacacaaccttcatcatcgacgggcctgatacgcccgaatgtcctgacgatcagagagcctggaatatttgggaggttgaggactatggatttggcgtgttcacaaccaacatctggctgaaacttcgcgatagctacacacagatgtgcgaccaccggctcatgtccgctgcgattaaagatagcaaggccgtgcatgctgacatgggctattggatcgaatctgagaaaaatgaaacctggaagctggccagagcctcctttattgaggtcaagacatgtatctggccccgcagccacaccctgtggtctaacggggtgctcgaatccgagatgatcattccgaaaatctacggaggccctattagccaacataattatcggcccgggtacttcacgcagaccgctggaccttggcacctgggcaaacttgagctggatttcaacctctgcgaagggacaaccgttgtggtcgacgagcactgcggaaatagaggcccctctctgcggacaaccacggtgacaggcaaaatcattcatgaatggtgttgccgcagctgtaccctgcctccccttagatttagaggggaagatggatgctggtacggcatggagatcagaccggttaaggaaaaagaggaaaacctcgtgcgctccatggtcagcgccgggtctggagaggtggactccttcagcctgggcctgctctgtgtttccatcatgattgaagaggtgatgcggtctagatggagccgcaagatgctgatgacagggacccttgcggcctttttcctgctcatcatgggacagctgacctggaatgacctgattagactttgcatcatggtcggcgccaacgtgtccgatcggatgggcatggggacaacgtatctggccctcatggctacctttaagatgcgccctatgttcgccgtgggactgctctttagacggctgacatctcgcgaggtccttctgctcaccattggcctgagcctggttgcgtccgtggaacttcccaactctctggaggaactcggggacggactggctatgggcatcatgatgctcaaactgcttacagatttccaaagccaccagctgtggaccacgctcctgtccctgacatttattaagaccacccttagcctggactacgcctggaaaacaatggccatggtgctctctatcgtctccctgttccccctctgtctgagcaccacatctcagaagacgacctggcttcctgtgctgctggggtcctttggatgcaaaccgctcacaatgttcctgatcaccgagaataagatttggggcagaaagagctggccccttaacgaaggcatcatggctgttgggattgtgtctatcctgctctccagcctgctcaaaaatgatgtccctctggccggaccccttattgctggcgggatgctgatcgcctgttatgtgatctccggaagctctgcggacctgagcctcgagcgggccgctgaggtttcctgggaagaggaagccgagcattctggcgctagccacaacattctggtggaagtccaggatgacgggacaatgaagatcaaagatgaggagcgcgacgatacccttacgattctgctcaaggccaccctgctcgccgtgtccggagtctaccctatgtctatccccgctacactgtttgtgtggtatttctggcagaagaagaaacagagaagcggcgttctttgggacacccctagccctcccgaagtggagcgggcggtcctggatgacggcatttaccgcatcctgcagagagggctcctgggacggtctcaggtgggcgttggggtgttccaagacggagtctttcatacaatgtggcacgtgaccagaggcgccgtgcttatgtatcaggggaagcgcctggaacccagctgggcttccgttaagaaagatctcatcagctacggaggcggctggcggttccaggggtcttggaatacaggagaggaggtccaggtgattgccgtggaacccggcaagaaccctaaaaatgtccaaacgacccccgggacatttaagaccccggagggagaagtgggcgccatcgctctggacttcaaacctgggacctccggaagccccattgttaacagagagggcaagatcgtgggcctctacgggaatggagtcgtgacaacgtctggcacctatgtttccgccattgcgcaggctaaggccagccaggaagggcctctgcccgagatcgaggatgaagtgtttaaaaagcgcaaccttacaattatggacctgcaccccggatccggcaaaacccggagatacctgcctgccatcgtccgcgaggctatcaagcggaaactcagaacactgattcttgccccgacccgcgtggttgcgtctgaaatggctgaggccctgaaggggatgcccatccggtatcaaacgacagccgtgaagtccgaacataccggcaaagagattgtcgatctcatgtgccacgctaccttcacaatgagactgctgtcccctgtgcgggtgcccaattacaacatgatcattatggacgaggcccattttaccgatcctgctagcatcgccgcgcgcggatatatctctacaagagtcggcatgggggaagccgctgccattttcatgaccgctacgccccctggatccgttgaggcctttccgcagagcaatgccgtgatccaggacgaagaacgggatattcccgaacgctcttggaacagcggctacgactggatcacagatttccctgggaagaccgtgtggtttgtcccctccattaaatctggaaatgacatcgctaactgtctcagaaagaacggcaaacgggtgatccagcttagcagaaagacattcgacaccgagtatcaaaagacgaaaaataacgattgggactacgttgtgaccacagatatttccgagatgggggcgaatttccgcgccgaccgggtcatcgatcctagacgctgcctgaagcccgtgattctgaaagacggcccggaacgggttatcctcgctggacctatgcccgtgaccgccgcctctgctgcccagagacgcggccggattgggagaaaccagaataaggagggagatcagtacatctatatgggccaacccctgaacaatgacgaagatcacgcgcattggacagaggctaaaatgcttctggacaacattaatacccctgaggggatcatccccgccctctttgaacctgagcgcgaaaagagcgccgctattgatggagagtacagactgcggggcgaagcccgcaagacattcgtcgagctgatgagaagaggggacctcccggtgtggctttcctataaagtcgcgagcgagggctttcagtactctgatcgcagatggtgcttcgacggagaacggaacaatcaggtgctggaggaaaacatggacgttgagatctggaccaaggaaggcgagcgcaagaagctgcgcccccggtggctcgatgccagaacgtattccgaccctctggcccttcgcgagtttaaagagttcgccgctgggcggagaagcgtgtccggagatctgattctcgagatcggcaagctgccccagcacctgacactccgggcccaaaatgctcttgacaacctggtgatgctgcacaattctgaacaagggggaaaagcctaccgccatgcgatggaggaactccctgataccattgagaccctgatgcttctggccctcatcgctgtcctgacaggcggcgttaccctgtttttcctcagcgggaagggacttggcaagacatccatcgggctgctgtgtgtgatggcctctagcgtgctcctgtggatggcttccgtcgagccccactggattgccgccagcatcattcttgaatttttcctgatggtgctcctgatcccggagcctgacagacagcggacgccccaggataaccaactggcttatgttgtgattggactcctttttatgatcctgaccgtcgcggccaacgaaatgggcctgctcgagacaaccaaaaaggacctggggatcggacatgtggtcgctgagaatcaccaccatgccacaatgcttgatattgacctgcaccctgcctctgcttggaccctctacgccgtggcgacgaccatcattacacccatgatgcgccataccatcgaaaacacaaccgccaatatttccctgacggctatcgccaaccaggctgccattctgatgggcctcgataaaggctggcctatcagcaagatggacatcggggttccccttctggcgctgggatgctactctcaggtgaatccgctcacactgaccgccgctgtccttatgctggtggcccactatgctattatcggccctgggctccaagccaaagctacaagagaggcccagaagcggaccgcggccggaattatgaagaaccccaccgttgatggcatcgtggctattgacctggaccccgtcgtgtacgatgccaaattcgaaaagcagctggggcagatcatgctccttatcctgtgtacatcccaaattctgctcatgcgcacgacctgggctctgtgcgagagcatcacacttgccaccggacctctgacaaccctctgggaaggctctccgggcaaattttggaatacgacaattgccgtgagcatggcgaacatcttcagagggtcctatctggctggagccggcctggctttctctctcatgaaaagccttgggggaggccggcgcgggaccggagcccagggcgagaccctgggcgagaaatggaagagacagctgaatcagctctccaagagcgaatttaacacatacaaacggtccgggattatggaggttgacagatctgaagccaaggagggactgaaacgcggcgaaaccacaaagcatgctgtcagccgggggacggccaaacttagatggttcgtggagcgcaatctggtgaagcccgagggaaaggtcatcgatctcggctgtgggcggggaggctggtcctattactgcgcgggcctgaaaaaggttaccgaagtgaaagggtatacaaagggaggccctgggcacgaggaacccatccctatggccacctacggatggaacattgtgaaactgcactctggcagagacgtctttttcacaccccctgagaagtgtgataccctcctttgcgacatcggggaaagctccccgaatcccacgattgaggagggacgcaccctgcgggtgctgaaaatggttgaaccttggctcagaggcaaccaattttgtatcaagattctgaatccctacatgccttctgtggtcgagacacttgaacagatgcagcgcaagcatggcgggatgctggtgcggaaccccctcagcagaaattccacccacgagatgtattgggttagctgcggaacaggcaacatcgtgtctgctgtcaacatgacctcccgcatgctgctgaatcggttcacaatggcccatagaaaaccgacctacgagcgcgatgtggacctcggggctggaacgagacacgtggccgtcgaacctgagattgcgaacctggatatcatcggccagcggattgaaaatatcaagaacgagcacaaaagcacatggcattatgacgaagataatccctacaagacctgggcctatcacgggtcttacgaggttaaaccctccggaagcgcttcttccatggtgaacggcgtggtccgccttctgaccaagccttgggacgtgattcccatggttacacaaatcgccatgacggacaccacaccttttggccagcagagagtgttcaaggagaaagtcgatacccggacaccgagacccaagcgggggaccgctcaaattatggaagtgacagccaaatggctctggggatttctgagccgcaataagaaacctagaatctgtacccgggaggagttcacgcgcaaggttagatccaacgctgccatcggcgcggtgtttgtcgacgagaatcagtggaacagcgccaaggaagctgtggaggatgagcggttctgggaccttgttcatcgcgaaagagagctgcacaaacaggggaagtgcgctacctgcgtgtataatatgatgggaaaacgggaaaagaaactcggcgagtttgggaaggccaagggctctcgcgccatttggtacatgtggctgggagccagattcctggagttcgaggcgctcggctttatgaacgaggatcattggttcagccgggaaaattccctgtctggggtcgagggagaaggccttcacaaactggggtacatcctccgcgacattagcaagatccccggaggcaacatgtatgctgatgacacagccgggtgggataccagaattacagaggacgatctgcagaatgaggccaaaatcaccgacatcatggaacctgagcacgcccttctggccacgtccatttttaagctcacataccaaaacaaagtggtccgggtgcagcgccccgctaagtctggcaccgttatggatgtgatcagcagacgggaccagagaggatccggccaggtcgggacatatggactgaacaccttcacgaatatggaagtgcaactgattcgccagatggagtctgaaggcatctttagcccgtccgagctcgagaacagcaatctggccgaacgggtgcttgactggctggagaaacatggggttgaaagactcaagcgcatggcgatttctggagatgactgtgtggtcaagcctaccgatgaccggttcgccacagctctgaccgcccttaacgatatgggcaaagtgagaaaggacatcccccagtgggagccttccaaagggtggaatgattggcagcaagttcccttttgcagccaccatttccaccagctgatcatgaaggacggccgcgaaattgtggtcccttgtcggaaccaggatgagctcgtgggacgggctcgcgtctctcagggcgccgggtggtccctgcgggagacagcgtgcctgggaaaaagctacgcccaaatgtggcagctcatgtattttcacagacgcgacctgcggcttgctgccaatgctatctgttccgccgtgcccgttaactgggtgccgacctctagaacaacctggagcattcatgctcaccatcagtggatgacgacagaagatatgctgtccgtctggaatcgggtgtggatcgaggaaaacccttggatggaggacaagacccacgttagctcttgggaagacgtgccctacctcggcaagagagaggatcaatggtgcgggtccctgattggacttaccgcccgcgcgacatgggccaccaatatccaggtcgctattaaccaggtgcggagactgatcggcaatgagaactatctcgactacatgacaagcatgaaacgcttcaagaatgaatctgatcccgagggggccctgtggtga

SEQ ID NO: 19474 - RNA, 9879 nt, synthetic construct
  misc_feature 1..9879: note = derived and/or modified CDS sequence (opt5) from DENV-1__KM403617__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtggtcgtgacggttcacaccggcgatcagcatcaagtggggaatgagacaaccgaacacggaacaatcgctaccatcacgccccaggcccctacctccgagattcagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggttgtgctcggatctcaagagggcgctatgcacaccgccctgacaggggccacggaaatccagaccagcggaacaaccacaatttttgctggccatcttaaatgcagactgaagatggacaaactcaccctgaagggggtctcctatgtgatgtgtacgggcagcttcaaactggagaaggaagttgccgagacacagcacggaaccgtgcttgtccaggtgaagtacgagggcaccgatgcgccgtgcaaaatccctatttctacacaagacgaaaagggggtgacccagaacggacggctcatcacagctaatcccatcgttacggataaagagaagcctgtcaacattgaaaccgagccgcccttcggcgagtcctatatcgtgattggggccggagaaaaagccctgaagctgagctggtttaagaaaggctctagcatcgggaagatgttcgaggctacagccagaggcgctcgccggatggccattctcggagacaccgcgtgggattttggctccatcgggggagtgttcacatctgtcggcaaactggtgcatcaggtttttgggaccgcctacggagtgcttttcagcggcgtctcctggacgatgaagatcgggattggcatcctgctcacctggctgggactgaatagcagatctacatcccttagcatgacctgtattgctgtgggcatggttacactctacctgggggtgatggtccaggccgactctggatgcgtgatcaactggaaaggccgcgaactgaagtgtgggtccggaatttttgttaccaacgaggtgcacacatggaccgaacaatataagttccaggctgatagccctaaacggctctccgccgcgatcggcaaggcctgggaggagggggtctgcggcattagatctgctacgcgcctggaaaatatcatgtggaaacagatcagcaacgagcttaatcatattctgctcgaaaacgacatgaagtttacagtggtggtcggagacgccaatggcatcctgacccaggggaaaaagatgattcggccgcaacccatggagcacaaatactcctggaagtcttggggaaaggctaaaatcattggcgccgatacccagaacacaaccttcatcatcgacgggcctgatacgcccgaatgtcctgacgatcagagagcctggaatatttgggaggttgaggactatggatttggcgtgttcacaaccaacatctggctgaaacttcgcgatagctacacacagatgtgcgaccaccggctcatgtccgctgcgattaaagatagcaaggccgtgcatgctgacatgggctattggatcgaatctgagaaaaatgaaacctggaagctggccagagcctcctttattgaggtcaagacatgtatctggccccgcagccacaccctgtggtctaacggggtgctcgaatccgagatgatcattccgaaaatctacggaggccctattagccaacataattatcggcccgggtacttcacgcagaccgctggaccttggcacctgggcaaacttgagctggatttcaacctctgcgaagggacaaccgttgtggtcgacgagcactgcggaaatagaggcccctctctgcggacaaccacggtgacaggcaaaatcattcatgaatggtgttgccgcagctgtaccctgcctccccttagatttagaggggaagatggatgctggtacggcatggagatcagaccggttaaggaaaaagaggaaaacctcgtgcgctccatggtcagcgccgggtctggagaggtggactccttcagcctgggcctgctctgtgtttccatcatgattgaagaggtgatgcggtctagatggagccgcaagatgctgatgacagggacccttgcggtctttttcctgctcatcatgggacagctgacctggaatgacctgattagactttgcatcatggtgggcgctaacgtgtccgatcggatgggcatggggacaacgtatctggccctcatggccacctttaagatgcgccctatgttcgctgtcggactgctctttagacggctgacatctcgcgaggttcttctgctcaccattggcctgagcctggtggcctccgtggaacttcccaactctctggaggaactcggggacggactggcgatgggcatcatgatgctcaaactgcttacagatttccaaagccaccagctgtggaccacgctcctgtccctgacatttattaagaccacccttagcctggactacgcttggaaaacaatggccatggtcctctctatcgtgtccctgttccccctctgtctgagcaccacatctcagaagacgacctggcttcctgttctgctggggtcctttggatgcaaaccgctcacaatgttcctgatcaccgagaataagatttggggcagaaagagctggccccttaacgaaggcatcatggccgtggggattgtctctatcctgctctccagcctgctcaaaaatgatgtgcctctggctggaccccttattgccggcgggatgctgatcgcttgttatgttatctccggaagctctgccgacctgagcctcgagcgggcggccgaggtgtcctgggaagaggaagctgagcattctggcgccagccacaacattctggtcgaagtgcaggatgacgggacaatgaagatcaaagatgaggagcgcgacgatacccttacgattctgctcaaggctaccctgctcgccgtctccggagtgtaccctatgtctatccccgccacactgtttgtttggtatttctggcagaagaagaaacagagaagcggcgtgctttgggacacccctagccctcccgaagtcgagcgggctgtgctggatgacggcatttaccgcatcctgcagagagggctcctgggacggtctcaggttggcgtgggggtcttccaagacggagtgtttcatacaatgtggcacgtgaccagaggcgcggttcttatgtatcaggggaaacgcctggaacccagctgggcctccgtcaagaaagatctcatcagctacggaggcggctggcggttccaggggtcttggaatacaggagaggaggtgcaagtgattgctgtcgaacccggcaagaaccctaaaaatgtgcaaacgacccccgggacatttaagaccccggagggagaagttggcgccatcgccctggacttcaaacctgggacctccggaagccccattgtgaacagagagggcaagatcgtcggcctctacgggaatggagtggttacaacgtctggcacctatgtgtccgctattgcccaggcgaaggctagccaggaagggcctctgcccgagatcgaggatgaagtctttaaaaagcgcaaccttacaattatggacctgcaccccggatccggcaaaacccggagatacctgcctgccatcgtgcgcgaggccatcaagcggaaactcagaacactgattcttgctccgacccgcgttgtggcctctgaaatggcggaggctctgaaggggatgcccatccggtatcaaacgacagccgtcaagagcgaacataccggcaaagagattgtggatctcatgtgccacgccaccttcacaatgagactgctgtcccctgtgcgggtccccaattacaacatgatcattatggacgaggctcattttaccgatcctgccagcatcgctgcccgcggatatatctctacaagagttggcatgggggaagcggccgctattttcatgaccgccacgccccctggatccgtggaggcttttccgcagagcaatgccgtgatccaggacgaagaacgggatattcccgaacgctcttggaacagcggctacgactggatcacagatttccctgggaagaccgtctggtttgtgccctccattaaatctggaaatgacatcgccaactgtctcagaaagaacggcaaacgggttatccagcttagcagaaagacattcgacaccgagtatcaaaagacgaaaaataacgattgggactacgtggtcaccacagatatttccgagatgggggctaatttccgcgcggaccgggtgatcgatcctagacgctgcctgaagcccgttattctgaaagacggcccggaacgggtgatcctcgccggacctatgcccgtcaccgctgcctctgccgctcagagacgcggccggattgggagaaaccagaataaggagggagatcagtacatctatatgggccaacccctgaacaatgacgaagatcacgcccattggacagaggcgaaaatgcttctggacaacattaatacccctgaggggatcatccccgctctctttgaacctgagcgcgaaaagagcgccgccattgatggagagtacagactgcggggcgaagctcgcaagacattcgtggagctgatgagaagaggggacctcccggtctggctttcctataaagtggccagcgagggctttcagtactctgatcgcagatggtgcttcgacggagaacggaacaatcaggttctggaggaaaacatggacgtggagatctggaccaaggaaggcgagcgcaagaagctgcgcccccggtggctcgatgcgagaacgtattccgaccctctggcccttcgcgagtttaaagagttcgctgccgggcggagaagcgtgtccggagatctgattctcgagatcggcaagctgccccagcacctgacactccgggctcaaaatgcccttgacaacctggtcatgctgcacaattctgaacaagggggaaaggcttaccgccatgccatggaggaactccctgataccattgagaccctgatgcttctggcgctcatcgccgttctgacaggcggcgtgaccctgtttttcctcagcgggaagggacttggcaagacatccatcgggctgctgtgtgtgatggcttctagcgtcctcctgtggatggcctccgtggagccccactggattgctgccagcatcattcttgaatttttcctgatggttctcctgatcccggagcctgacagacagcggacgccccaggataaccaactggcctatgtggtcattggactcctttttatgatcctgaccgtggctgcgaacgaaatgggcctgctcgagacaaccaaaaaggacctggggatcggacatgtcgtggccgagaatcaccaccatgctacaatgcttgatattgacctgcaccctgcctctgcctggaccctctacgctgttgccacgaccatcattacacccatgatgcgccataccatcgaaaacacaaccgcgaatatttccctgacggccatcgctaaccaggccgctattctgatgggcctcgataaaggctggcctatcagcaagatggacatcggggtgccccttctggccctgggatgctactctcaggtcaatccgctcacactgaccgcggccgtgcttatgctggttgctcactatgccattatcggccctgggctccaagctaaagccacaagagaggctcagaagcggaccgccgcgggaattatgaagaaccccaccgtggatggcatcgtcgccattgacctggaccccgtggtgtacgatgctaaattcgaaaagcagctggggcagatcatgctccttatcctgtgtacatcccaaattctgctcatgcgcacgacctgggccctgtgcgagagcatcacacttgctaccggacctctgacaaccctctgggaaggctctccgggcaaattttggaatacgacaattgccgttagcatggccaacatcttcagagggtcctatctggcgggagctggcctggccttctctctcatgaagtcccttgggggaggccggcgcgggaccggagctcagggcgagaccctgggcgagaaatggaagagacagctgaatcagctctccaagagcgaatttaacacatacaaacggtccgggattatggaggtcgacagatctgaagccaaggagggactgaaacgcggcgaaaccacaaagcatgccgtgagccgggggacggctaaacttagatggttcgtggagcgcaatctggtcaagcccgagggaaaggttatcgatctcggctgtgggcggggaggctggtcctattactgcgccggcctgaaaaaggtgaccgaagtgaaagggtatacaaagggaggccctgggcacgaggaacccatccctatggcgacctacggatggaacattgtcaaactgcactctggcagagacgtgtttttcacaccccctgagaagtgtgataccctcctttgcgacatcggggaaagctccccgaatcccacgattgaggagggacgcaccctgcgggttctgaaaatggtggaaccttggctcagaggcaaccaattttgtatcaagattctgaatccctacatgccttctgtcgtggagacacttgaacagatgcagcgcaagcatggcgggatgctggttcggaaccccctcagcagaaattccacccacgagatgtattgggtgagctgcggaacaggcaacatcgtctctgccgtgaacatgacctcccgcatgctgctgaatcggttcacaatggctcatagaaaaccgacctacgagcgcgatgtggacctcggggccggaacgagacacgtcgctgttgaacctgagattgccaacctggatatcatcggccagcggattgaaaatatcaagaacgagcacaaaagcacatggcattatgacgaagataatccctacaagacctgggcgtatcacgggtcttacgaggtgaaaccctccggaagcgcctcttccatggtgaacggcgtcgtgcgccttctgaccaagccttgggacgttattcccatggtgacacaaatcgctatgacggacaccacaccttttggccagcagagagtcttcaaggagaaagtggatacccggacaccgagacccaagcgggggaccgcccaaattatggaagttacagctaaatggctctggggatttctgagccgcaataagaaacctagaatctgtacccgggaggagttcacgcgcaaggtgagatccaacgccgctatcggcgccgtctttgtggacgagaatcagtggaacagcgcgaaggaagccgttgaggatgagcggttctgggaccttgtgcatcgcgaaagagagctgcacaaacaggggaagtgcgctacctgcgtctataatatgatgggaaaacgggaaaagaaactcggcgagtttgggaaggccaagggctctcgcgctatttggtacatgtggctgggagccagattcctggagttcgaggccctcggctttatgaacgaggatcattggttcagccgggaaaattccctgtctggggtggagggagaaggccttcacaaactggggtacatcctccgcgacattagcaagatccccggaggcaacatgtatgcggatgacacagctgggtgggataccagaattacagaggacgatctgcagaatgaggccaaaatcaccgacatcatggaacctgagcacgcccttctggctacgtccatttttaagctcacataccaaaacaaagtcgtgcgggttcagcgccccgccaagtctggcaccgtgatggatgtcatcagcagacgggaccagagaggatccggccaggtggggacatatggactgaacaccttcacgaatatggaagtgcaactgattcgccagatggagtctgaaggcatctttagcccgtccgagctcgagaacagcaatctggctgaacgggttcttgactggctggagaaacatggggtggaaagactcaagcgcatggccatttctggagatgactgtgtcgtgaagcctaccgatgaccggttcgcgacagccctgaccgctcttaacgatatgggcaaagttagaaaggacatcccccagtgggagccttccaaagggtggaatgattggcagcaagtgcccttttgcagccaccatttccaccagctgatcatgaaggacggccgcgaaattgtcgtgccttgtcggaaccaggatgagctcgtcggacgggcccgcgtgtctcagggcgctgggtggtccctgcgggagacagcctgcctgggaaaaagctacgcgcaaatgtggcagctcatgtattttcacagacgcgacctgcggcttgccgctaatgccatctgttccgctgttcccgtgaactgggtcccgacctctagaacaacctggagcattcatgcccaccatcagtggatgacgacagaagatatgctgtccgtgtggaatcgggtttggatcgaggaaaacccttggatggaggacaagacccacgtgagctcttgggaagacgtcccctacctcggcaagagagaggatcaatggtgcgggtccctgattggacttaccgctcgcgccacatgggcgaccaatatccaggtggccattaaccaggtgcggagactgatcggcaatgagaactatctcgactacatgacaagcatgaaacgcttcaagaatgaatctgatcccgagggggctctgtggtga

SEQ ID NO: 19475 - RNA, 9879 nt, synthetic construct
  misc_feature 1..9879: note = derived and/or modified CDS sequence (opt5) from DENV-1__KM403635__SS-prME
  source 1..9879: mol_type = other RNA
agcgtgaccatgctgctcatgctgcttcccaccgctctggctttccacctcacgacccggggcggggagcctcatatgatcgtctccaagcaggaacggggaaaatctctgctttttaagacaagcgctggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcgcgtcccaagagacatggaatcgccaggatctgctggtgaccttcaaaacagcccacgctaagaagcaggaagtcgtggttctcggatctcaagagggcgccatgcacaccgccctgaccggggctacagaaattcagacgagcggaaccacaaccatctttgccggccatcttaaatgcagactgaagatggacaaactcacactgaagggggtgtcctatgtcatgtgtaccggcagcttcaaactggagaaggaagtggcggagacgcagcacggaacagttcttgtgcaggtcaagtacgagggcaccgatgctccgtgcaaaattcctatctctacccaagacgaaaagggggtgacacagaacggacggctcatcaccgccaatcccattgtgacagataaagagaagcctgttaacatcgaaacggagccgcccttcggcgagtcctatattgtcatcggggccggagaaaaagctctgaagctgagctggtttaagaaaggctctagcattgggaagatgttcgaggccaccgctagaggcgcccgccggatggcgatcctcggagacacagcctgggattttggctccatcgggggagtgttcacctctgtgggcaaactggtccatcaggtgtttgggacagcttacggagttcttttcagcggcgtgtcctggaccatgaagattgggatcggcattctgctcacgtggctgggactgaatagcagatctacctcccttagcatgacatgtatcgccgtcggcatggtgaccctctacctgggggttatggtgcaggctgactctggatgcgtcattaactggaaaggccgcgaactgaagtgtgggtccggaatctttgtgacaaacgaggttcacacctggacagaacaatataagttccaggccgatagccctaaacggctctccgcggccattggcaaggcttgggaggagggggtgtgcggcatcagatctgccacccgcctggaaaatatcatgtggaaacagattagcaacgagcttaatcatatcctgctcgaaaacgacatgaagtttacggtcgtggtgggagacgctaatggcattctgacacaggggaaaaagatgatccggccgcaacccatggagcacaaatactcctggaagtcttggggaaaggccaaaattatcggcgccgatacccagaacaccacattcatcattgacgggcctgatacccccgaatgtcctgacgatcagagagcttggaatatctgggaggtcgaggactatggatttggcgttttcacgacaaacatttggctgaaacttcgcgatagctacacccagatgtgcgaccaccggctcatgtccgcggccatcaaagatagcaaggctgtgcatgccgacatgggctattggattgaatctgagaaaaatgaaacatggaagctggccagagcttcctttatcgaggtgaagacctgtatctggccccgcagccacacactgtggtctaacggggtcctcgaatccgagatgattatcccgaaaatttacggaggccctatcagccaacataattatcggcccgggtacttcacccagacggccggaccttggcacctgggcaaacttgagctggatttcaacctctgcgaagggaccacagtggttgtggacgagcactgcggaaatagaggcccctctctgcggaccacaaccgtcacgggcaaaattatccatgaatggtgttgccgcagctgtacactgcctccccttagatttagaggggaagatggatgctggtacggcatggagatcagaccggtgaaggaaaaagaggaaaacctcgttcgctccatggtgagcgcggggtctggagaggtcgactccttcagcctgggcctgctctgtgtgtccattatgatcgaagaggttatgcggtctagatggagccgcaagatgctgatgaccgggacacttgctgtgtttttcctgctcattatgggacagctgacctggaatgacctgatcagactttgcattatggtcggcgccaacgtgtccgatcggatgggcatggggaccacatatctggccctcatggctacgtttaagatgcgccctatgttcgccgtgggactgctctttagacggctgacctctcgcgaggtccttctgctcacaatcggcctgagcctggttgcgtccgtggaacttcccaactctctggaggaactcggggacggactggctatgggcattatgatgctcaaactgcttaccgatttccaaagccaccagctgtggacaaccctcctgtccctgacgtttatcaagacaacccttagcctggactacgcctggaaaaccatggccatggtgctctctatcgtctccctgttccccctctgtctgagcacaacctctcagaagacaacgtggcttcctgtgctgctggggtcctttggatgcaaaccgctcaccatgttcctgattacagagaataagatctggggcagaaagagctggccccttaacgaaggcattatggctgttgggatcgtgtctattctgctctccagcctgctcaaaaatgatgtccctctggccggaccccttatcgctggcgggatgctgatcgcctgttatgtgatttccggaagctctgcggacctgagcctcgagcgggccgctgaggtttcctgggaagaggaagccgagcattctggcgctagccacaacatcctggtggaagtccaggatgacgggaccatgaagattaaagatgaggagcgcgacgatacacttaccatcctgctcaaggccacgctgctcgccgtgtccggagtctaccctatgtctattcccgctaccctgtttgtgtggtatttctggcagaagaagaaacagagaagcggcgttctttgggacacacctagccctcccgaagtggagcgggcggtcctggatgacggcatctaccgcatcctgcagagagggctcctgggacggtctcaggtgggcgttggggtgttccaagacggagtctttcataccatgtggcacgtgacaagaggcgccgtgcttatgtatcaggggaagcgcctggaacccagctgggcttccgttaagaaagatctcattagctacggaggcggctggcggttccaggggtcttggaataccggagaggaggtccaggtgatcgccgtggaacccggcaagaaccctaaaaatgtccaaacaacgcccgggacctttaagacaccggagggagaagtgggcgccattgctctggacttcaaacctgggacctccggaagccccatcgttaacagagagggcaagattgtgggcctctacgggaatggagtcgtgaccacatctggcacgtatgtttccgccatcgcgcaggctaaggccagccaggaagggcctctgcccgagattgaggatgaagtgtttaaaaagcgcaaccttaccatcatggacctgcaccccggatccggcaaaacacggagatacctgcctgccatcgtccgcgaggctattaagcggaaactcagaaccctgatccttgccccgacacgcgtggttgcgtctgaaatggctgaggccctgaaggggatgcccattcggtatcaaaccacggccgtgaagtccgaacatacaggcaaagagatcgtcgatctcatgtgccacgctaccttcaccatgagactgctgtcccctgtgcgggtgcccaattacaacatgattatcatggacgaggcccattttacagatcctgctagcatcgccgcgcgcggatatatttctaccagagtcggcatgggggaagccgctgccatcttcatgacagctacaccccctggatccgttgaggcctttccgcagagcaatgccgtgattcaggacgaagaacgggatatccccgaacgctcttggaacagcggctacgactggattacggatttccctgggaagacagtgtggtttgtcccctccatcaaatctggaaatgacatcgctaactgtctcagaaagaacggcaaacgggtgattcagcttagcagaaagaccttcgacacagagtatcaaaagaccaaaaataacgattgggactacgttgtgacgaccgatatctccgagatgggggcgaatttccgcgccgaccgggtcattgatcctagacgctgcctgaagcccgtgatcctgaaagacggcccggaacgggttattctcgctggacctatgcccgtgacagccgcctctgctgcccagagacgcggccggatcgggagaaaccagaataaggagggagatcagtacatttatatgggccaacccctgaacaatgacgaagatcacgcgcattggaccgaggctaaaatgcttctggacaacatcaatacacctgaggggatcattcccgccctctttgaacctgagcgcgaaaagagcgccgctatcgatggagagtacagactgcggggcgaagcccgcaagaccttcgtcgagctgatgagaagaggggacctcccggtgtggctttcctataaagtcgcgagcgagggctttcagtactctgatcgcagatggtgcttcgacggagaacggaacaatcaggtgctggaggaaaacatggacgttgagatttggacaaaggaaggcgagcgcaagaagctgcgcccccggtggctcgatgccagaacctattccgaccctctggcccttcgcgagtttaaagagttcgccgctgggcggagaagcgtgtccggagatctgatcctcgagattggcaagctgccccagcacctgacgctccgggcccaaaatgctcttgacaacctggtgatgctgcacaattctgaacaagggggaaaagcctaccgccatgcgatggaggaactccctgatacaatcgagaccctgatgcttctggccctcatcgctgtcctgaccggcggcgttacactgtttttcctcagcgggaagggacttggcaagacctccattgggctgctgtgtgtgatggcctctagcgtgctcctgtggatggcttccgtcgagccccactggatcgccgccagcattatccttgaatttttcctgatggtgctcctgattccggagcctgacagacagcggacaccccaggataaccaactggcttatgttgtgatcggactcctttttatgatcctgacggtcgcggccaacgaaatgggcctgctcgagaccaccaagaaggacctggggattggacatgtggtcgctgagaatcaccaccatgccaccatgcttgatatcgacctgcaccctgcctctgcttggacactctacgccgtggcgaccacgattatcacccccatgatgcgccatacaattgaaaacaccacagccaatatctccctgaccgctattgccaaccaggctgccatcctgatgggcctcgataaaggctggcctatcagcaagatggacattggggttccccttctggcgctgggatgctactctcaggtgaatccgctcacgctgacagccgctgtccttatgctggtggcccactatgctatcattggccctgggctccaagccaaagctaccagagaggcccagaagcggacagcggccggaatcatgaagaaccccaccgttgatggcattgtggctatcgacctggaccccgtcgtgtacgatgccaaattcgaaaagcagctggggcagatcatgctccttattctgtgtacctcccaaatcctgctcatgcgcacaacgtgggctctgtgcgagagcattacccttgccacaggacctctgaccacactctgggaaggctctccgggcaaattttggaataccacgatcgccgtgagcatggcgaacattttcagagggtcctatctggctggagccggcctggctttctctctcatgaaaagccttgggggaggccggcgcgggacaggagcccagggcgagaccctgggcgagaaatggaagagacagctgaatcagctctccaagagcgaatttaacacctacaaacggtccgggatcatggaggttgacagatctgaagccaaggagggactgaaacgcggcgaaacaaccaagcatgctgtcagccgggggacagccaaacttagatggttcgtggagcgcaatctggtgaagcccgagggaaaggtcatcgatctcggctgtgggcggggaggctggtcctattactgcgcgggcctgaaaaaggttacggaagtgaaagggtataccaagggaggccctgggcacgaggaacccattcctatggccacatacggatggaacatcgtgaaactgcactctggcagagacgtctttttcacaccccctgagaagtgtgataccctcctttgcgacattggggaaagctccccgaatcccaccatcgaggagggacgcacgctgcgggtgctgaaaatggttgaaccttggctcagaggcaaccaattttgtattaagatcctgaatccctacatgccttctgtggtcgagacccttgaacagatgcagcgcaagcatggcgggatgctggtgcggaaccccctcagcagaaattccacacacgagatgtattgggttagctgcggaaccggcaacattgtgtctgctgtcaacatgacatcccgcatgctgctgaatcggttcaccatggcccatagaaaaccgacatacgagcgcgatgtggacctcggggctggaaccagacacgtggccgtcgaacctgagatcgcgaacctggatatcattggccagcggatcgaaaatattaagaacgagcacaaaagcacgtggcattatgacgaagataatccctacaagacatgggcctatcacgggtcttacgaggttaaaccctccggaagcgcttcttccatggtgaacggcgtggtccgccttctgaccaagccttgggacgtgatccccatggttacccaaattgccatgacagacacgaccccttttggccagcagagagtgttcaaggagaaagtcgatacacggaccccgagacccaagcgggggacagctcaaatcatggaagtgaccgccaaatggctctggggatttctgagccgcaataagaaacctagaatctgtacacgggaggagttcacccgcaaggttagatccaacgctgccattggcgcggtgtttgtcgacgagaatcagtggaacagcgccaaggaagctgtggaggatgagcggttctgggaccttgttcatcgcgaaagagagctgcacaaacaggggaagtgcgccacgtgcgtgtataatatgatgggaaaacgggaaaagaaactcggcgagtttgggaaggctaagggctctcgcgccatctggtacatgtggctgggagccagattcctggagttcgaggcgctcggctttatgaacgaggatcattggttcagccgggaaaattccctgtctggggtcgagggagaaggccttcacaaactggggtacattctccgcgacatcagcaagattcccggaggcaacatgtatgctgatgacaccgccgggtgggatacaagaatcaccgaggacgatctgcagaatgaggccaaaatcacagacattatggaacctgagcacgcccttctggccacctccatctttaagctcacgtaccaaaacaaagtggtccgggtgcagcgccccgctaagtctggcacagttatggatgtgattagcagacgggaccagagaggatccggccaggtcgggacctatggactgaacacattcaccaatatggaagtgcaactgatccgccagatggagtctgaaggcatttttagcccgtccgagctcgagaacagcaatctggccgaacgggtgcttgactggctggagaaacatggggttgaaagactcaagcgcatggcgatctctggagatgactgtgtggtcaagcctacggatgaccggttcgccaccgctctgacagcccttaacgatatgggcaaagtgagaaaggacatcccccagtgggagccttccaaagggtggaatgattggcagcaagttcccttttgcagccaccatttccaccagctgattatgaaggacggccgcgaaatcgtggtcccttgtcggaaccaggatgagctcgtgggacgggctcgcgtctctcagggcgccgggtggtccctgcgggagaccgcgtgcctgggaaaaagctacgcccaaatgtggcagctcatgtattttcacagacgcgacctgcggcttgctgccaatgctatttgttccgccgtgcccgttaactgggtgccgacatctagaaccacatggagcatccatgctcaccatcagtggatgaccacggaagatatgctgtccgtctggaatcgggtgtggattgaggaaaacccttggatggaggacaagacacacgttagctcttgggaagacgtgccctacctcggcaagagagaggatcaatggtgcgggtccctgatcggacttaccgcccgcgcgacctgggccacaaatattcaggtcgctatcaaccaggtgcggagactggtgggcaatgagaactatctcgactacatgaccagcatgaaacgcttcaagaatgaatctgatcccgagggggccctgtggtga

SEQ ID NO: 19476 - RNA, 9879 nt, synthetic construct
  misc_feature 1..9879: note = derived and/or modified CDS sequence (opt5) from DENV-1__KM403621__SS-prME
  source 1..9879: mol_type = other RNA
agcgtgaccatgctgctcatgctgcttcccacagccctggctttccacctcacgacccggggcggggagcctcatatgattgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaagcgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgagagctttccgcagtctaatgctgtgattcaggacgaagaacgggatatccccgaacgcagctggaactccggctacgactggattacagatttccctgggaagaccgtgtggtttgtcccctctatcaaaagcggaaatgacatcgccaactgtctcagaaagaacggcaaacgggtgattcagctttccagaaagacattcgacaccgagtatcaaaagacgaaaaataacgattgggactacgttgtgaccacagatatctctgagatgggggccaatttccgcgctgaccgggtcattgatcctagacgctgcctgaagcccgtgatcctgaaagacggcccggaacgggttattctcgcgggacctatgcccgtgaccgccgctagcgccgcccagagacgcggccggatcgggagaaaccagaataaggagggagatcagtacatttatatgggccaacccctgaacaatgacgaagatcacgctcattggacagaggccaaaatgcttctggacaacatcaatacccctgaggggatcattcccgcgctctttgaacctgagcgcgaaaagtccgctgccatcgatggagagtacagactgcggggcgaagcccgcaagacattcgtcgagctgatgagaagaggggacctcccggtgtggcttagctataaagtcgcttctgagggctttcagtactccgatcgcagatggtgcttcgacggagaacggaacaatcaggtgctggaggaaaacatggacgttgagatttggaccaaggaaggcgagcgcaagaagctgcgcccccggtggctcgatgccagaacgtatagcgaccctctggcgcttcgcgagtttaaagagttcgccgctgggcggagatccgtgtctggagatctgatcctcgagattggcaagctgccccagcacctgacactccgggcccaaaatgctcttgacaacctggtgatgctgcacaatagcgaacaagggggaaaagcctaccgccatgctatggaggaactccctgataccatcgagaccctgatgcttctggccctcatcgcggtcctgacaggcggcgttaccctgtttttcctctccgggaagggacttggcaagacatctattgggctgctgtgtgtgatggccagctccgtgctcctgtggatggctagcgtcgagccccactggatcgccgcttctattatccttgaatttttcctgatggtgctcctgattccggagcctgacagacagcggacgccccaggataaccaactggcctatgttgtgatcggactcctttttatgatcctgaccgtcgccgctaacgaaatgggcctgctcgagacaaccaaaaaggacctggggattggacatgtggtcgcggagaatcaccaccatgccacaatgcttgatatcgacctgcaccctgcttccgcctggaccctctacgccgtggctacgaccattatcacacccatgatgcgccataccattgaaaacacaaccgccaatatcagcctgacggcgattgccaaccaggctgccatcctgatgggcctcgataaaggctggcctatctctaagatggacattggggttccccttctggctctgggatgctactcccaggtgaatccgctcacactgaccgccgcggtccttatgctggtggcccactatgctatcattggccctgggctccaagccaaagctacaagagaggcccagaagcggaccgctgccggaatcatgaagaaccccaccgttgatggcattgtggcgatcgacctggaccccgtcgtgtacgatgccaaattcgaaaagcagctggggcagatcatgctccttattctgtgtacaagccaaatcctgctcatgcgcacgacctgggctctgtgcgagtctattacacttgccaccggacctctgacaaccctctgggaaggcagcccgggcaaattttggaatacgacaatcgctgtgtccatggccaacattttcagagggtcttatctggccggagcgggcctggctttcagcctcatgaagtcccttgggggaggccggcgcgggaccggagcccagggcgagaccctgggcgagaaatggaagagacagctgaatcagctcagcaagtccgaatttaacacatacaaacggtctgggatcatggaggttgacagaagcgaagctaaggagggactgaaacgcggcgaaaccacaaagcatgccgtctcccgggggacggccaaacttagatggttcgtggagcgcaatctggtgaagcccgagggaaaggtcatcgatctcggctgtgggcggggaggctggtcttattactgcgctggcctgaaaaaggttaccgaagtgaaagggtatacaaagggaggccctgggcacgaggaacccattcctatggccacctacggatggaacatcgtgaaactgcacagcggcagagacgtctttttcacaccccctgagaagtgtgataccctcctttgcgacattggggaatcctctccgaatcccacgatcgaggagggacgcaccctgcgggtgctgaaaatggttgaaccttggctcagaggcaaccaattttgtattaagatcctgaatccctacatgcctagcgtggtcgagacacttgaacagatgcagcgcaagcatggcgggatgctggtgcggaaccccctctccagaaatagcacccacgagatgtattgggtttcttgcggaacaggcaacattgtgtccgcggtcaacatgaccagccgcatgctgctgaatcggttcacaatggcccatagaaaaccgacctacgagcgcgatgtggacctcggggctggaacgagacacgtggccgtcgaacctgagatcgctaacctggatatcattggccagcggatcgaaaatattaagaacgagcacaaatctacatggcattatgacgaagataatccctacaagacctgggcctatcacgggtcctacgaggttaaacccagcggatctgcgtccagcatggtgaacggcgtggtccgccttctgaccaagccttgggacgtgatccccatggttacacaaattgccatgacggacaccacaccttttggccagcagagagtgttcaaggagaaagtcgatacccggacaccgagacccaagcgggggaccgctcaaatcatggaagtgacagccaaatggctctggggatttctgtcccgcaataagaaacctagaatctgtacccgggaggagttcacgcgcaaggttagaagcaacgctgccattggcgctgtgtttgtcgacgagaatcagtggaactctgccaaggaagcggtggaggatgagcggttctgggaccttgttcatcgcgaaagagagctgcacaaacaggggaagtgcgctacctgcgtgtataatatgatgggaaaacgggaaaagaaactcggcgagtttgggaaggccaagggcagccgcgccatctggtacatgtggctgggagctagattcctggagttcgaggccctcggctttatgaacgaggatcattggttctcccgggaaaattctctgagcggggtcgagggagaaggccttcacaaactggggtacattctccgcgacatctccaagattcccggaggcaacatgtatgccgatgacacagcggggtgggataccagaatcacagaggacgatctgcagaatgaggctaaaatcaccgacattatggaacctgagcacgcccttctggccacgtctatctttaagctcacataccaaaacaaagtggtccgggtgcagcgccccgctaagagcggcaccgttatggatgtgatttccagacgggaccagagaggatctggccaggtcgggacatatggactgaacaccttcacgaatatggaagtgcaactgatccgccagatggagagcgaaggcatcttttccccgagcgagctcgagaactctaatctggccgaacgggtgcttgactggctggagaaacatggggttgaaagactcaagcgcatggctatctccggagatgactgtgtggtcaagcctaccgatgaccggttcgccacagcgctgaccgcccttaacgatatgggcaaagtgagaaaggacatcccccagtgggagcctagcaaagggtggaatgattggcagcaagttcccttttgctctcaccatttccaccagctgattatgaaggacggccgcgaaatcgtggtcccttgtcggaaccaggatgagctcgtgggacgggctcgcgtctcccagggcgccgggtggagcctgcgggagacagcttgcctgggaaaatcctacgcccaaatgtggcagctcatgtattttcacagacgcgacctgcggcttgcggccaatgctatttgttctgccgtgcccgttaactgggtgccgaccagcagaacaacctggtccatccatgctcaccatcagtggatgacgacagaagatatgctgagcgtctggaatcgggtgtggattgaggaaaacccttggatggaggacaagacccacgtttcttcctgggaagacgtgccctacctcggcaagagagaggatcaatggtgcgggagcctgatcggacttaccgcccgcgctacatgggccaccaatattcaggtcgcgatcaaccaggtgcggagactgatcggcaatgagaactatctcgactacatgacatctatgaaacgcttcaagaatgaaagcgatcccgagggggccctgtggtga

SEQ ID NO: 19477 - RNA, 9879 nt, synthetic construct
  misc_feature 1..9879: note = derived and/or modified CDS sequence (opt5) from DENV-1__KM403623__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgccatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagaacaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaagggggtgtcctatgtcatgtgtacgggcagcttcaaactggagaaggaagtggccgagacacagcacggaaccgttctggtgcaggtcaagtacgagggcaccgatgcgccgtgcaaaattcctatctctacacaagacgaaaagggggtgacccagaacggacggcttatcacagctaatcccattgtgacggataaagagaagcctgttaacatcgaaaccgagccgccctttggcgagtcctatattgtcatcggggccggagaaaaagccctcaagctgagctggttcaagaaaggctctagcattgggaagatgtttgaggctacagccagaggcgctcgccggatggccatcctgggagacaccgcgtgggatttcggctccatcgggggagtgtttacatctgtgggcaaactcgtccatcaggtgttcgggaccgcctacggagttctgtttagcggcgtgtcctggacgatgaagattgggatcggcattcttctgacctggctcggactgaatagcagatctacatccctgagcatgacctgtatcgctgtcggcatggtgacactttacctcggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctgtccgccgcgattggcaaggcctgggaggagggggtgtgcggcatcagatctgctacgcgcctcgaaaatatcatgtggaaacagattagcaacgagctgaatcatatccttctggaaaacgacatgaagttcacagtcgtggtgggagacgccaatggcattctcacccaggggaaaaagatgatccggccgcaacccatggagcacaaatactcctggaagtcttggggaaaggctaaaattatcggcgccgatacccagaacacaacctttatcattgacgggcctgatacgcccgaatgtcctgacgatcagagagcctggaatatctgggaggtcgaggactatggattcggcgtttttacaaccaacatttggctgaagctgcgcgatagctacacacagatgtgcgaccaccggcttatgtccgctgcgatcaaagatagcaaggccgtgcatgctgacatgggctattggattgaatctgagaaaaatgaaacctggaagctcgccagagcctccttcatcgaggtgaagacatgtatctggccccgcagccacaccctgtggtctaacggggtcctggaatccgagatgattatcccgaaaatttacggaggccctatcagccaacataattatcggcccgggtacttcacgcagaccgctggaccttggcacctcggcaagctggagcttgattttaacctgtgcgaagggacaaccgtggttgtggacgagcactgcggaaatagaggcccctctctccggacaaccacggtcacaggcaaaattatccatgaatggtgttgccgcagctgtaccctgcctcccctgagattcagaggggaagatggatgctggtacggcatggagatcagaccggtgaaggaaaaagaggaaaaccttgttcgctccatggtgagcgccgggtctggagaggtcgactcctttagcctcggcctgctgtgtgtgtccattatgatcgaagaggttatgcggtctagatggagccgcaagatgctcatgacagggaccctggcggtgttctttcttctgattatgggacagctcacctggaatgacctgatcagactgtgcattatggtcggcgctaacgtgtccgatcggatgggcatggggacaacgtatcttgccctgatggccaccttcaagatgcgccctatgtttgctgtgggactcctgttcagacggctcacatctcgcgaggtcctgcttctgaccatcggcctcagcctggttgcctccgtggaactgcccaactctcttgaggaactgggggacggactcgcgatgggcattatgatgctgaaactcctgacagattttcaaagccaccagctttggaccacgctgctctccctgacattcatcaagaccaccctgagccttgactacgcttggaaaacaatggccatggtgctgtctatcgtctccctctttcccctgtgtctcagcaccacatctcagaagacgacctggctgcctgtgcttctggggtccttcggatgcaaaccgctgacaatgtttctcattaccgagaataagatctggggcagaaagagctggcccctgaacgaaggcattatggccgttgggatcgtgtctattcttctgtccagcctcctgaaaaatgatgtccctctcgctggacccctgatcgccggcgggatgcttatcgcttgttatgtgatttccggaagctctgccgacctgagcctggagcgggcggccgaggtttcctgggaagaggaagctgagcattctggcgccagccacaacatcctcgtggaagtccaggatgacgggacaatgaagattaaagatgaggagcgcgacgataccctgacgatccttctgaaggctaccctcctggccgtgtccggagtctaccctatgtctattcccgccacactcttcgtgtggtatttctggcagaaaaagaaacagagaagcggcgttctgtgggacacccctagccctcccgaagtggagcgggctgtccttgatgacggcatctaccgcatcctgcagagagggctgctcggacggtctcaggtgggcgttggggtgtttcaagacggagtcttccatacaatgtggcacgtgaccagaggcgcggtgctgatgtatcaggggaagcgccttgaacccagctgggcctccgttaagaaagatctgattagctacggaggcggctggcggtttcaggggtcttggaatacaggagaggaggtccaggtgatcgctgtggaacccggcaagaaccctaaaaatgtccaaacgacccccgggacattcaagaccccggagggagaagtgggcgccattgccctcgactttaaacctgggacctccggaagccccatcgttaacagagagggcaagattgtgggcctgtacgggaatggagtcgtgacaacgtctggcacctatgtttccgctatcgcccaggcgaaggctagccaggaagggcctctccccgagattgaggatgaagtgttcaaaaagcgcaacctgacaatcatggaccttcaccccggatccggcaaaacccggagatacctgcctgccatcgtccgcgaggccattaagcggaaactgagaacactcatcctggctccgacccgcgtggttgcctctgaaatggcggaggctcttaaggggatgcccattcggtatcaaacgacagccgtgaagtccgaacataccggcaaagagatcgtcgatctgatgtgccacgccacctttacaatgagactcctgtcccctgtgcgggtgcccaattacaacatgattatcatggacgaggctcatttcaccgatcctgccagcatcgctgcccgcggatatatttctacaagagtcggcatgggggaagcggccgctatctttatgaccgccacgccccctggatccgttgagagcttcccgcagtctaatgctgtgattcaggacgaggaacgggatatccccgaacgcagctggaactccggctacgactggattacagattttcctgggaagaccgtgtggttcgtcccctctatcaaaagcggaaatgacatcgccaactgtctgagaaagaacggcaaacgggtgattcagctctccagaaagacattcgacaccgagtatcaaaagacgaaaaataacgattgggactacgttgtgaccacagatatctctgagatgggggccaattttcgcgctgaccgggtcattgatcctagacgctgccttaagcccgtgatcctgaaagacggcccggaacgggttattctggcgggacctatgcccgtgaccgccgctagcgccgcccagagacgcggccggatcgggagaaaccagaataaggagggagatcagtacatttatatgggccaacccctcaacaatgacgaagatcacgctcattggacagaggccaaaatgctgcttgacaacatcaatacccctgaggggatcattcccgcgctgttcgaacctgagcgcgaaaagtccgctgccatcgatggagagtacagactccggggcgaagcccgcaagacatttgtcgagctgatgagaagaggggacctgccggtgtggctcagctataaagtcgcttctgagggcttccagtactccgatcgcagatggtgctttgacggagaacggaacaatcaggtgcttgaggaaaacatggacgttgagatttggaccaaggaaggcgagcgcaaaaagctgcgcccccggtggctggatgccagaacgtatagcgaccctctcgcgctgcgcgagttcaaagaatttgccgctgggcggagatccgtgtctggagatcttatcctggagattggcaagctcccccagcacctgacactgcgggcccaaaatgctctcgacaaccttgtgatgctgcacaatagcgaacaagggggaaaagcctaccgccatgctatggaggaactgcctgataccatcgagaccctcatgctgcttgccctgatcgcggtcctcacaggcggcgttaccctgttctttctgtccgggaagggactcggcaagacatctattgggcttctgtgtgtgatggccagctccgtgctgctctggatggctagcgtcgagccccactggatcgccgcttctattatcctggagttctttcttatggtgctgctcattccggagcctgacagacagcggacgccccaggataaccaactggcctatgttgtgatcggactcctgttcatgatccttaccgtcgccgctaacgaaatgggcctgctggagacaaccaaaaaggacctcgggattggacatgtggtcgcggagaatcaccaccatgccacaatgctggatatcgaccttcaccctgcttccgcctggaccctgtacgccgtggctacgaccattatcacacccatgatgcgccataccattgaaaacacaaccgccaatatcagcctcacggcgattgccaaccaggctgccatcctgatgggcctggataaaggctggcctatctctaagatggacattggggttcccctccttgctctgggatgctactcccaggtgaatccgctgacactcaccgccgcggtcctgatgcttgtggcccactatgctatcattggccctgggctgcaagccaaagctacaagagaggcccagaagcggaccgctgccggaatcatgaagaaccccaccgttgatggcattgtggcgatcgacctcgaccccgtcgtgtacgatgccaaatttgaaaagcagctggggcagatcatgctgctcattctttgtacaagccaaatcctgctgatgcgcacgacctgggctctctgcgagtctattacactggccaccggacctcttacaaccctgtgggaaggcagcccgggcaaattctggaatacgacaatcgctgtgtccatggccaacattttcagagggtcttatctcgccggagcgggcctggcttttagcctgatgaagtccctcgggggaggccggcgcgggaccggagcccagggcgagacccttggcgagaaatggaagagacagctgaatcagctgagcaagtccgagttcaacacatacaaacggtctgggatcatggaggttgacagaagcgaagctaaggagggactcaaacgcggcgaaaccacaaagcatgccgtctcccgggggacggccaaactgagatggtttgtggagcgcaatcttgtgaagcccgagggaaaggtcatcgatctgggctgtgggcggggaggctggtcttattactgcgctggcctcaaaaaggttaccgaagtgaaagggtatacaaagggaggccctgggcacgaggaacccattcctatggccacctacggatggaacatcgtgaaactgcacagcggcagagacgtcttctttacaccccctgagaagtgtgataccctgctctgcgacattggggaatcctctccgaatcccacgatcgaggagggacgcacccttcgggtgctgaaaatggttgaaccttggctgagaggcaaccaattctgtattaagatcctcaatccctacatgcctagcgtggtcgagacactggaacagatgcagcgcaagcatggcgggatgcttgtgcggaaccccctgtccagaaatagcacccacgagatgtattgggtttcttgcggaacaggcaacattgtgtccgcggtcaacatgaccagccgcatgctcctgaatcggtttacaatggcccatagaaaaccgacctacgagcgcgatgtggacctgggggctggaacgagacacgtggccgtcgaacctgagatcgctaacctcgatatcattggccagcggatcgaaaatattaagaacgagcacaaatctacatggcattatgacgaagataatccctacaagacctgggcctatcacgggtcctacgaggttaaacccagcggatctgcgtccagcatggtgaacggcgtggtccgcctgcttaccaagccttgggacgtgatccccatggttacacaaattgccatgacggacaccacacctttcggccagcagagagtgtttaaggagaaagtcgatacccggacaccgagacccaagcgggggaccgctcaaatcatggaagtgacagccaaatggctgtggggattcctctcccgcaataagaaacctagaatctgtacccgggaggaatttacgcgcaaggttagaagcaacgctgccattggcgctgtgttcgtcgacgagaatcagtggaactctgccaaggaagcggtggaggatgagcggttttgggacctggttcatcgcgaaagagagcttcacaaacaggggaagtgcgcgacctgcgtgtataatatgatgggaaaacgggaaaagaaactgggcgagttcgggaaggctaagggcagccgcgccatctggtacatgtggctcggagctagattcctggaatttgaggccctgggcttcatgaacgaggatcattggttttcccgggaaaattctctcagcggggtcgagggagaaggcctgcacaaacttgggtacattctgcgcgacatctccaagattcccggaggcaacatgtatgccgatgacacagcggggtgggataccagaatcacagaggacgatctccagaatgaggctaaaatcaccgacattatggaacctgagcacgccctgcttgccacgtctatcttcaagctgacataccaaaacaaagtggtccgggtgcagcgccccgctaagagcggcaccgttatggatgtgatttccagacgggaccagagaggatctggccaggtcgggacatatggactcaacacctttacgaatatggaagtgcaactgatccgccagatggagagcgaaggcattttctccccgagcgagctggagaactctaatctcgccgaacgggtgctggactggcttgagaaacatggggttgaaagactgaagcgcatggctatctccggagatgactgtgtggtcaagcctaccgatgaccggtttgccacagcgctcaccgccctgaacgatatgggcaaagtgagaaaggacatcccccagtgggagcctagcaaagggtggaatgattggcagcaagttcccttctgctctcaccattttcaccagcttattatgaaggacggccgcgaaatcgtggtcccttgtcggaaccaggatgagctggtgggacgggctcgcgtctcccagggcgccgggtggagcctccgggagacagcttgcctgggaaaatcctacgcccaaatgtggcagctgatgtatttccacagacgcgacctccggctggcggccaatgctatttgttctgccgtgcccgttaactgggtgccgaccagcagaacaacctggtccatccatgctcaccatcagtggatgacgacagaagatatgcttagcgtctggaatcgggtgtggattgaggaaaacccttggatggaggacaagacccacgtttcttcctgggaagacgtgccctacctgggcaagagagaggatcaatggtgcgggagcctcatcggactgaccgcccgcgctacatgggccaccaatattcaggtcgcgatcaaccaggtgcggagacttatcggcaatgagaactatctggactacatgacatctatgaaacgctttaagaatgaaagcgatcccgagggggccctctggtga

SEQ ID NO: 19478 - RNA, 9879 nt, synthetic construct
  misc_feature 1..9879: note = derived and/or modified CDS sequence (opt5) from DENV-1__KM403575__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaagtctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaaacgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccaaggaaggcgagcgcaagaagctgcgcccccggtggctcgatgcgagaacgtattccgaccctctggcccttcgcgagtttaaagagttcgctgccgggcggagaagcgtgtccggagatctgatcctcgagattggcaagctgccccagcacctgacactccgggctcaaaatgcccttgacaacctggtgatgctgcacaattctgaacaagggggaaaggcttaccgccatgccatggaggaactccctgataccatcgagaccctgatgcttctggcgctcatcgccgtcctgacaggcggcgttaccctgtttttcctcagcgggaagggacttggcaagacatccattgggctgctgtgtgtgatggcttctagcgtgctcctgtggatggcctccgtcgagccccactggatcgctgccagcattatccttgaatttttcctgatggtgctcctgattccggagcctgacagacagcggacgccccaggataaccaactggcctatgttgtgatcggactcctttttatgatcctgaccgtcgctgcgaacgaaatgggcctgctcgagacaaccaaaaaggacctggggattggacatgtggtcgccgagaatcaccaccatgctacaatgcttgatatcgacctgcaccctgcctctgcctggaccctctacgctgtggccacgaccattatcacacccatgatgcgccataccattgaaaacacaaccgcgaatatctccctgacggccattgctaaccaggccgctatcctgatgggcctcgataaaggctggcctatcagcaagatggacattggggttccccttctggccctgggatgctactctcaggtgaatccgctcacactgaccgcggccgtccttatgctggtggctcactatgccatcattggccctgggctccaagctaaagccacaagagaggctcagaagcggaccgccgcgggaatcatgaagaaccccaccgttgatggcattgtggccatcgacctggaccccgtcgtgtacgatgctaaattcgaaaagcagctggggcagatcatgctccttattctgtgtacatcccaaatcctgctcatgcgcacgacctgggccctgtgcgagagcattacacttgctaccggacctctgacaaccctctgggaaggctctccgggcaaattttggaatacgacaatcgccgtgagcatggccaacattttcagagggtcctatctggcgggagctggcctggccttctctctcatgaaaagccttgggggaggccggcgcgggaccggagctcagggcgagaccctgggcgagaaatggaagagacagctgaatcagctctccaagagcgaatttaacacatacaaacggtccgggatcatggaggttgacagatctgaagccaaggagggactgaaacgcggcgaaaccacaaagcatgccgtcagccgggggacggctaaacttagatggttcgtggagcgcaatctggtgaagcccgagggaaaggtcatcgatctcggctgtgggcggggaggctggtcctattactgcgccggcctgaaaaaggttaccgaagtgaaagggtatacaaagggaggccctgggcacgaggaacccattcctatggcgacctacggatggaacatcgtgaaactgcactctggcagagacgtctttttcacaccccctgagaagtgtgataccctcctttgcgacattggggaaagctccccgaatcccacgatcgaggagggacgcaccctgcgggtgctgaaaatggttgaaccttggctcagaggcaaccaattttgtattaagatcctgaatccctacatgccttctgtggtcgagacacttgaacagatgcagcgcaagcatggcgggatgctggtgcggaaccccctcagcagaaattccacccacgagatgtattgggttagctgcggaacaggcaacattgtgtctgccgtcaacatgacctcccgcatgctgctgaatcggttcacaatggctcatagaaaaccgacctacgagcgcgatgtggacctcggggccggaacgagacacgtggctgtcgaacctgagatcgccaacctggatatcattggccagcggatcgaaaatattaagaacgagcacaaaagcacatggcattatgacgaagataatccctacaagacctgggcgtatcacgggtcttacgaggttaaaccctccggaagcgcctcttccatggtgaacggcgtggtccgccttctgaccaagccttgggacgtgatccccatggttacacaaattgctatgacggacaccacaccttttggccagcagagagtgttcaaggagaaagtcgatacccggacaccgagacccaagcgggggaccgcccaaatcatggaagtgacagctaaatggctctggggatttctgagccgcaataagaaacctagaatctgtacccgggaggagttcacgcgcaaggttagatccaacgccgctattggcgccgtgtttgtcgacgagaatcagtggaacagcgcgaaggaagccgtggaggatgagcggttctgggaccttgttcatcgcgaaagagagctgcacaaacaggggaagtgcgctacctgcgtgtataatatgatgggaaaacgggaaaagaaactcggcgagtttgggaaggccaagggctctcgcgctatctggtacatgtggctgggagccagattcctggagttcgaggccctcggctttatgaacgaggatcattggttcagccgggaaaattccctgtctggggtcgagggagaaggccttcacaaactggggtacattctccgcgacatcagcaagattcccggaggcaacatgtatgcggatgacacagctgggtgggataccagaatcacagaggacgatctgcagaatgaggccaaaatcaccgacattatggaacctgagcacgcccttctggctacgtccatctttaagctcacataccaaaacaaagtggtccgggtgcagcgccccgccaagtctggcaccgttatggatgtgattagcagacgggaccagagaggatccggccaggtcgggacatatggactgaacaccttcacgaatatggaagtgcaactgatccgccagatggagtctgaaggcatttttagcccgtccgagctcgagaacagcaatctggctgaacgggtgcttgactggctggagaaacatggggttgaaagactcaagcgcatggccatctctggagatgactgtgtggtcaagcctaccgatgaccggttcgcgacagccctgaccgctcttaacgatatgggcaaagtgagaaaggacatcccccagtgggagccttccaaagggtggaatgattggcagcaagttcccttttgcagccaccatttccaccagctgattatgaaggacggccgcgaaatcgtggtcccttgtcggaaccaggatgagctcgtgggacgggcccgcgtctctcagggcgctgggtggtccctgcgggagacagcctgcctgggaaaaagctacgcgcaaatgtggcagctcatgtattttcacagacgcgacctgcggcttgccgctaatgccatttgttccgctgtgcccgttaactgggtgccgacctctagaacaacctggagcatccatgcccaccatcagtggatgacgacagaagatatgctgtccgtctggaatcgggtgtggattgaggaaaacccttggatggaggacaagacccacgttagctcttgggaagacgtgccctacctcggcaagagagaggatcaatggtgcgggtccctgatcggacttaccgctcgcgccacatgggcgaccaatattcaggtcgccatcaaccaggtgcggagactgatcggcaatgagaactatctcgactacatgacaagcatgaaacgcttcaagaatgaatctgatcccgagggggctctgtggtga

SEQ ID NO: 19479 - RNA, 9879 nt, synthetic construct
  misc_feature 1..9879: note = derived and/or modified CDS sequence (opt5) from DENV-1__KM403586__SS-prME
  source 1..9879: mol_type = other RNA
tccgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagaacaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgaggtgcagctgacagactacggcgccctgaccctcgactgtagcccccggacaggcctggattttaacgaaatggtccttctgaccatgaaggagaaatcttggctcgtgcataagcagtggttcctggaccttcctctgccctggacgtccggggctagcacatcccaagagacctggaatcgccaggatctcctggtcacatttaaaaccgcgcacgccaagaagcaggaagtggttgtgctgggatctcaagagggcgctatgcacaccgccctcacaggggccacggaaatccagaccagcggaacaaccacaattttcgctggccatctgaaatgcagacttaagatggacaaactgaccctcaagggggtctcctatgtgatgtgtacgggcagcttcaaactggagaaggaagttgccgagacacagcacggaaccgtgctggtccaggtgaagtacgagggcaccgatgcgccgtgcaaaatccctatttctacacaagacgaaaagggggtgacccagaacggacggcttatcacagctaatcccatcgttacggataaagagaagcctgtcaacattgaaaccgagccgccctttggcgagtcctatatcgtgattggggccggagaaaaagccctcaagctgagctggttcaagaaaggctctagcatcgggaagatgtttgaggctacagccagaggcgctcgccggatggccattctgggagacaccgcgtgggatttcggctccatcgggggagtgtttacatctgtcggcaaactcgtgcatcaggttttcgggaccgcctacggagtgctgtttagcggcgtctcctggacgatgaagatcgggattggcatccttctgacctggctcggactgaatagcagatctacatccctgagcatgacctgtattgctgtgggcatggttacactttacctcggggtgatggtccaggccgactctggatgcgtgatcaactggaaaggccgcgaactgaagtgtgggtccggaattttcgttaccaacgaggtgcacacatggaccgaacaatataagtttcaggctgatagccctaaacggctgtccgccgcgatcggcaaggcctgggaggagggggtctgcggcattagatctgctacgcgcctcgaaaatatcatgtggaaacagatcagcaacgagctgaatcatattcttctggaaaacgacatgaagttcacagtggtggtcggagacgcctacggcatcctcacccaggggaaaaagatgattcggccgcaacccatggagcacaaatattcctggaagtcttggggaaaggctaaaatcattggcgccgatacccagaatacaacctttatcatcgacgggcctgatacgcccgaatgtcctgacgatcagagagcctggaacatttgggaggttgaggactacggattcggcgtgtttacaaccaatatctggctgaagctgcgcgatagctatacacagatgtgcgaccaccggcttatgtccgctgcgattaaagatagcaaggccgtgcatgctgacatgggctactggatcgaatctgagaaaaacgaaacctggaagctcgccagagcctccttcattgaggtcaagacatgtatctggccccgcagccacaccctgtggtctaatggggtgctggaatccgagatgatcattccgaaaatctatggaggccctattagccaacataactaccggcccgggtacttcacgcagaccgctggaccttggcacctcggcaagctggagcttgattttaatctgtgcgaagggacaaccgttgtggtcgacgagcactgcggaaacagaggcccctctctccggacaaccacggtgacaggcaaaatcattcatgaatggtgttgccgcagctgtaccctgcctcccctgagattcagaggggaagatggatgctggtatggcatggagatccggccggttaaggaaaaagaggaaaatcttgtgcgctccatggtcagcgccgggtctggagaggtggactcctttagcctcggcctgctgtgtgtttccatcatgattgaagaggtgatgcggtctagatggagccgcaagatgctcatgacagggaccctggcggtcttctttcttctgatcatgggacagctcacctggaacgacctgattagactgtgcatcatggtgggcgctaatgtgtccgatcggatgggcatggggacaacgtaccttgccctgatggccaccttcaagatgcgccctatgtttgctgtcggactcctgttcagacggctcacatctcgcgaggttctgcttctgaccattggcctcagcctggtggcctccgtggaactgcccaactctcttgaggaactgggggacggactcgcgatgggcatcatgatgctgaaactcctgacagattttcaaagccaccagctttggaccacgctgctctccctgacattcattaagaccaccctgagccttgactatgcttggaaaacaatggccatggtcctgtctatcgtgtccctctttcccctgtgtctcagcaccacatctcagaagacgacctggctgcctgttcttctggggtccttcggatgcaaaccgctgacaatgtttctcatcaccgagaacaagatttggggcagaaagagctggcccctgaatgaaggcatcatggccgtggggattgtctctatccttctgtccagcctcctgaaaaacgatgtgcctctcgctggacccctgattgccggcgggatgcttatcgcttgttacgttatctccggaagctctgccgacctgagcctggagcgggcggccgaggtgtcctgggaagaggaagctgagcattctggcgccagccacaatattctcgtcgaagtgcaggatgacgggacaatgaagatcaaagatgaggagcgcgacgataccctgacgattcttctgaaggctaccctcctggccgtctccggagtgtatcctatgtctatccccgccacactcttcgtttggtacttctggcagaagaagaaacagagaagcggcgtgctgtgggacacccctagccctcccgaagtcgagcgggctgtgcttgatgacggcatttatcgcatcctgcagagagggctgctcggacggtctcaggttggcgtgggggtctttcaagacggagtgttccatacaatgtggcacgtgaccagaggcgcggttctgatgtaccaggggaaacgccttgaacccagctgggcctccgtcaagaaagatctgatcagctacggaggcggctggcggtttcaggggtcttggaacacaggagaggaggtgcaagtgattgctgtcgaacccggcaagaatcctaaaaacgtgcaaacgacccccgggacattcaagaccccggagggagaagttggcgccatcgccctcgactttaaacctgggacctccggaagccccattgtgaatagagagggcaagatcgtcggcctgtatgggaacggagtggttacaacgtctggcacctacgtgtccgctattgcccaggcgaaggctagccaggaagggcctctccccgagatcgaggatgaagtcttcaaaaagcgcaatctgacaattatggaccttcaccccggatccggcaaaacccggagatatctgcctgccatcgtgcgcgaggccatcaagcggaaactgagaacactcattctggctccgacccgcgttgtggcctctgaaatggcggaggctcttaaggggatgcccatccggtaccaaacgacagccgtcaagagcgaacataccggcaaagagattgtggatctgatgtgccacgccacctttacaatgagactcctgtcccctgtgcgggtccccaactataatatgatcattatggacgaggctcatttcaccgatcctgccagcatcgctgcccgcggatacatctctacaagagttggcatgggggaagcggccgctatttttatgaccgccacgccccctggatccgtggaggctttcccgcagagcaacgccgtgatccaggacgaagaacgggatattcccgaacgctcttggaatagcggctatgactggatcacagattttcctgggaagaccgtctggttcgtgccctccattaaatctggaaacgacatcgccaattgtctgagaaagaacggcaaacgggttatccagctcagcagaaagacattcgacaccgagtaccaaaagacgaaaaacaatgattgggactacgtggtcaccacagatatttccgagatgggggctaactttcgcgcggaccgggtgatcgatcctagacgctgccttaagcccgttattctgaaagacggcccggaacgggtgatcctggccggacctatgcccgtcaccgctgcctctgccgctcagagacgcggccggattgggagaaatcagaacaaggagggagatcagtatatctacatgggccaacccctcaataacgacgaagatcacgcccattggacagaggcgaaaatgctgcttgacaatattaacacccctgaggggatcatccccgctctgttcgaacctgagcgcgaaaagagcgccgccattgatggagagtatagactccggggcgaagctcgcaagacatttgtggagctgatgagaagaggggacctgccggtctggctctcctacaaagtggccagcgagggcttccagtattctgatcgcagatggtgctttgacggagaacggaataaccaggttcttgaggaaaatatggacgtggagatctggaccaaggaaggcgagcgcaaaaagctgcgcccccggtggctggatgcgagaacgtactccgaccctctcgccctgcgcgagttcaaagaatttgctgccgggcggagaagcgtgtccggagatcttattctggagatcggcaagctcccccagcacctgacactgcgggctcaaaacgccctcgacaatcttgtcatgctgcacaactctgaacaagggggaaaggcttatcgccatgccatggaggaactgcctgataccattgagaccctcatgctgcttgcgctgatcgccgttctcacaggcggcgtgaccctgttctttctgagcgggaagggactcggcaagacatccatcgggcttctgtgtgtgatggcttctagcgtcctgctctggatggcctccgtggagccccactggattgctgccagcatcattctggagttctttcttatggttctgctcatcccggagcctgacagacagcggacgccccaggataatcaactggcctacgtggtcattggactcctgttcatgatccttaccgtggctgcgaacgaaatgggcctgctggagacaaccaaaaaggacctcgggatcggacatgtcgtggccgagaaccaccaccatgctacaatgctggatattgaccttcaccctgcctctgcctggaccctgtacgctgttgccacgaccatcattacacccatgatgcgccataccatcgaaaatacaaccgcgaacatttccctcacggccatcgctaatcaggccgctattctgatgggcctggataaaggctggcctatcagcaagatggacatcggggtgcccctccttgccctgggatgctattctcaggtcaacccgctgacactcaccgcggccgtgctgatgcttgttgctcactacgccattatcggccctgggctgcaagctaaagccacaagagaggctcagaagcggaccgccgcgggaattatgaagaatcccaccgtggatggcatcgtcgccattgacctcgaccccgtggtgtatgatgctaaatttgaaaagcagctggggcagatcatgctgctcatcctttgtacatcccaaattctgctgatgcgcacgacctgggccctctgcgagagcatcacactggctaccggacctcttacaaccctgtgggaaggctctccgggcagattctggaacacgacaattgccgttagcatggccaatatcttccgggggtcctacctcgcgggagctggcctggccttttctctgatgaaaagcctcgggggaggccgcagagggaccggagctcagggcgagacccttggcgagaagtggaaacggcagctgaaccagctgtccaagagcgagttcaatacatataagagatccgggattatggaggtcgaccgctctgaagccaaagagggaatgaagcggggcgaaaccacaaaacatgccgtgagcagagggacggctaagctccgctggtttgtggagcggaacctggtcaaacccgagggaaaggttatcgatcttggctgtgggagaggaggctggtcctactattgcgccggcctgaagaaagtgaccgaagtgaaggggtacacaaaaggaggccctgggcacgaggaacccatccctatggcgacctacggatggaatattgtcaagctccactctggccgcgacgtgttctttacaccccctgagaaatgtgataccctgctgtgcgacatcggggaaagctccccgaaccccacgattgaggagggacggaccctcagagttcttaagatggtggaaccttggctgcgcggcaatcaattctgtatcaaaattctgaacccctatatgccttctgtcgtggagacactcgaacagatgcagcggaagcatggcgggatgctggttagaaatccccttagccgcaactccacccacgagatgtactgggtgagctgcggaacaggcaatatcgtctctgccgtgaacatgacctcccggatgctgctcaacagatttacaatggctcatcgcaagccgacctatgagagagatgtggacctgggggccggaacgcggcacgtcgctgttgaacctgagattgccaatctggatatcatcggccagcgcattgaaaacatcaaaaatgagcacaagagcacatggcattacgacgaagataacccctataaaacctgggcgtaccacgggtcttatgaggtgaagccctccggaagcgcctcttccatggtgaatggcgtcgtgagactcctgaccaaaccttgggacgttattcccatggtgacacaaatcgctatgacggacaccacacctttcggccagcagcgggtctttaaggagaaggtggataccagaacaccgcggcccaaacgcgggaccgcccaaattatggaagttacagctaagtggctttggggattcctgagcagaaacaaaaagcctcggatctgtacccgcgaggaatttacgagaaaagtgcggtccaatgccgctatcggcgccgtcttcgtggacgagaaccagtggaatagcgcgaaggaagccgttgaggatgagcgcttttgggacctcgtgcatagagaacgggagctgcacaagcaggggaaatgcgctacctgcgtctacaacatgatgggaaagcgcgagaagaaacttggcgagttcgggaaagccaaaggctctagagctatttggtacatgtggctgggagcccggttcctcgaatttgaggccctgggcttcatgaatgaggatcattggtttagccgcgaaaactccctgtctggggtggagggagaaggcctccacaagctggggtatatccttagagacattagcaaaatccccggaggcaatatgtacgcggatgacacagctgggtgggatacccggattacagaggacgatctgcagaacgaggccaagatcaccgacatcatggaacctgagcacgccctcctggctacgtccattttcaaacttacatatcaaaataaggtcgtgcgcgttcagagacccgccaaatctggcaccgtgatggatgtcatcagccggagagaccagcgcggatccggccaggtggggacatacggactgaacacctttacgaacatggaagtgcaactcattcggcagatggagtctgaaggcatcttcagcccgtccgagctggagaatagcaacctggctgaaagagttctcgactggctggagaagcatggggtggaacgccttaaacggatggccatttctggagatgactgtgtcgtgaagcctaccgatgacagatttgcgacagccctgaccgctctcaatgatatgggcaaggttcgcaaagacatcccccagtgggagccttccaaggggtggaacgattggcagcaagtgcccttctgcagccaccattttcaccagctgatcatgaaagacggccgggaaattgtcgtgccttgtagaaatcaggatgagcttgtcggacgcgcccgggtgtctcagggcgctgggtggtccctgagagagacagcctgcctcggaaagagctatgcgcaaatgtggcagctgatgtacttccaccgccgggacctgagactcgccgctaacgccatctgttccgctgttcccgtgaattgggtcccgacctctcggacaacctggagcattcatgcccaccatcagtggatgacgacagaagatatgctgtccgtgtggaacagagtttggatcgaggaaaatccttggatggaggacaaaacccacgtgagctcttgggaagacgtcccctatcttggcaagcgcgaggatcaatggtgcgggtccctgattggactcaccgctcgggccacatgggcgaccaacatccaggtggccattaatcaggtgagacgcctgatcggcaacgagaattaccttgactacatgacaagcatgaagagatttaaaaacgaatctgatcccgagggggctctgtggtga

SEQ ID NO: 19480 - RNA, 9879 nt, synthetic construct
  misc_feature 1..9879: note = derived and/or modified CDS sequence (opt5) from DENV-1__KM403602__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaaatctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaagatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccattaccctcgactgtagcccccggacaggcctggatttcaacgaaatggtgcttctgaccatgaaggagaaatcttggctcgtccataagcagtggtttctggaccttcctctgccctggacgtccggggctagcacatcccaagagacctggaatcgccaggatctcctggtgacattcaaaaccgcgcacgccaagaagcaggaagtcgtggttctgggatctcaagagggcgctatgcacaccgccctcacaggggccacggaaatccagaccagcggaacaaccacaatttttgctggccatctgaaatgcagacttaagatggacaaactgaccctcaagggggtgtcctatgtcatgtgtacgggcagcttcaaactggagaaggaagtggccgagacacagcacggaaccgttctggtgcaggtcaagtacgagggcaccgatgcgccgtgcaaaatccctatctctacacaagacgaaaagggggtgacccagaacggacggcttattacagctaatcccatcgtgacggataaagagaagcctgttaacattgaaaccgagccgcccttcggcgagtcctatatcgtcattggggccggagaaaaagccctcaagctgagctggtttaagaaaggctctagcatcgggaagatgttcgaggctacagccagaggcgctcgccggatggccatcctgggagacaccgcgtgggattttggctccattgggggagtgttcacatctgtgggcaaactcgtccatcaggtgtttgggaccgcctacggagttctgttcagcggcgtgtcctggacgatgaagatcgggattggcatccttctgacctggctcggactgaatagcagatctacatccctgagcatgacctgtattgctgtcggcatggtgacactttacctcggggttatggtgcaggccgactctggatgcgtcatcaactggaaaggccgcgaactgaagtgtgggtccggaatttttgtgaccaacgaggttcacacatggaccgaacaatataagttccaggctgatagccctaaacggctgtccgccgcgatcggcaaggcctgggaggagggggtgtgcggcatcagatctgctacgcgcctcgaaaatattatgtggaaacagatcagctccgagctgaaccatattcttctggaaaatgacatgaagtttacagtcgtggtgggagacgccaacggcatcctcacccaggggaaaaagatgattcggccgcaacccatggagcacaaatactcttggaaaagctggggaaaggctaaaatcatcggcgccgatacccagaatacaaccttcattatcgacgggcctgatacgcccgaatgtcctgacgatcagagagcctggaacatttgggaggtcgaggactatggatttggcgttttcacaaccaatatctggctgaagctgcgcgattcctacacacagatgtgcgaccaccggcttatgagcgctgcgattaaagattctaaggccgtgcatgctgacatgggctattggatcgaatccgagaaaaacgaaacctggaagctcgccagagccagctttatcgaggtgaagacatgtatttggccccgctctcacaccctgtggtccaatggggtcctggaaagcgagatgatcattccgaaaatctacggaggccctatttctcaacataactatcggcccgggtacttcacgcagaccgctggaccttggcacctcggcaagctggagcttgatttcaatctgtgcgaagggacaaccgtggttgtggacgagcactgcggaaacagaggccccagcctccggacaaccacggtcacaggcaaaatcatccatgaatggtgttgccgctcctgtaccctgcctcccctgagatttagaggggaagatggatgctggtacggcatggagattcggccggtgaaggaaaaagaggaaaatcttgttcgcagcatggtgtctgccgggtccggagaggtcgacagcttctccctcggcctgctgtgtgtgtctatcatgattgaagaggttatgcggagcagatggtccaagaagatgctcatgacagggaccctggcggtgtttttccttctgatcatgggacagctcacctggaacgacctgattcgcctgtgcatcatggtcggcgctaatgtgtctgatagaatgggcatggggacaacgtatcttgccctgatggccacctttaaaatgcggcctatgttcgctgtgggactcctgtttcgcagactcacaagccgggaggtcctgcttctgaccattggcctctccctggttgcctctgtggaactgcccaacagccttgaggaactgggggacggactcgcgatgggcatcatgatgctgaagctcctgacagatttccaatcccaccagctttggaccacgctgctcagcctgacatttatcaaaaccaccctgtctcttgactacgcttggaagacaatggccatggtgctgtccattgtcagcctcttccccctgtgtctctctaccacatcccagaaaacgacctggctgcctgtgcttctggggagctttggatgcaagccgctgacaatgttcctcatcaccgagaacaagatttggggccgcaaatcttggcccctgaatgaaggcatcatggccgttgggattgtgtccatccttctgagctccctcctgaagaacgatgtccctctcgctggacccctgatcgccggcgggatgcttattgcttgttatgtgatcagcggatctagcgccgacctgtccctggagagagcggccgaggtttcttgggaagaggaagctgagcatagcggcgcctcccacaatattctcgtggaagtccaggatgacgggacaatgaaaatcaaggatgaggagcgggacgataccctgacgattcttctgaaagctaccctcctggccgtgtctggagtctaccctatgagcatccccgccacactctttgtgtggtatttctggcaaaagaaaaagcagcgctccggcgttctgtgggacaccccttctcccccggaagtggagagagctgtccttgatgacggcatctaccggattctgcagcgcgggctgctcggaagaagccaggtgggcgttggggtgttccaagacggagtctttcatacaatgtggcacgtgacccggggcgcggtgctgatgtatcaggggaagagacttgaaccttcctgggccagcgttaaaaaggatctgatctcttacggaggcggctggcgcttccaggggtcctggaacacaggagaggaggtccaggtgattgctgtggaacccggcaaaaatcctaagaacgtccaaacgacccccgggacatttaaaaccccggagggagaagtgggcgccatcgccctcgacttcaagcctgggaccagcggatctcccattgttaatcgggagggcaagatcgtgggcctgtacgggaacggagtcgtgacaacgtccggcacctatgttagcgctattgcccaggcgaaggcttcccaggaagggcctctccccgagatcgaggatgaagtgtttaagaaaagaaatctgacaatcatggaccttcaccccggatctggcaagacccgccggtacctgcctgccattgtcagagaggccatcaaacgcaagctgcggacactcattctggctccgaccagagtggttgccagcgaaatggcggaggctcttaaggggatgcccatccgctatcaaacgacagccgtgaaatccgaacataccggcaaggagattgtcgatctgatgtgccacgccaccttcacaatgcggctcctgagccctgtgagagtgcccaactacaatatgatcatcatggacgaggctcattttaccgatcctgcctctattgctgcccggggatatatctccacacgcgtcggcatgggggaagcggccgctattttcatgaccgccacgccccctggaagcgttgaggcttttccgcagtctaacgccgtgatccaggacgaagagagagatattcccgaacggagctggaactccggctacgactggatcacagatttccctgggaaaaccgtgtggtttgtcccctctatcaagagcggaaacgacattgccaattgtctgcgcaaaaacggcaagagagtgatccagctctcccggaagacattcgacaccgagtatcagaagacgaagaacaatgattgggactacgttgtgaccacagatatttctgagatgggggctaacttcagagcggaccgcgtcatcgatcctcggagatgccttaaacccgtgattctgaaggacggcccggaacgcgttatcctggccggacctatgcccgtgaccgctgccagcgccgctcagcggagaggccgcattgggcggaatcagaacaaagagggagatcagtacatctatatgggccaacccctcaataacgacgaagatcacgcccattggacagaggcgaagatgctgcttgacaatatcaacacccctgaggggattatccccgctctgtttgaacctgagagagaaaagtccgccgccattgatggagagtaccgcctcagaggcgaagctcggaaaacattcgtcgagctgatgcgcagaggggacctgccggtgtggctcagctataaggtcgcctctgagggctttcagtactccgatcggcgctggtgcttcgacggagaaagaaataaccaggtgcttgaggaaaatatggacgttgagatctggaccaaagaaggcgagcggaagaaactgagaccccgctggctggatgcgcggacgtatagcgaccctctcgccctgagagagtttaaggagttcgctgccgggcgccggtccgtgtctggagatcttattctggagatcggcaaactcccccagcacctgacactgagagctcaaaacgccctcgacaatcttgtgatgctgcacaacagcgaacaagggggaaaggcttaccggcatgccatggaggaactgcctgataccatcgagaccctcatgctgcttgcgctgattgccgtcctcacaggcggcgttaccctgtttttcctgtccgggaagggactcggcaaaacatctatcgggcttctgtgtgtgatggctagctccgtgctgctctggatggccagcgtcgagccccactggattgctgcctctatcattctggaatttttccttatggtgctgctcatcccggagcctgaccgccagagaacgccccaggataatcaactggcctatgttgtgatcggactgctctttatgattcttaccgtcgctgcgaacgaaatgggcctgctggagacaaccaagaaagacctcgggatcggacatgtggtcgccgagaaccaccaccatgctacaatgctggatattgaccttcaccctgcctccgcctggaccctgtacgctgtggccacgaccatcattacacccatgatgcggcataccatcgaaaatacaaccgcgaacattagcctcacggccatcgctaatcaggccgctatcctgatgggcctggataagggctggcctatttctaaaatggacatcggggttcccctccttgccctgggatgctactcccaggtgaacccgctgacactcaccgcggccgtcctgatgcttgtggctcactatgccattatcggccctgggctgcaagctaaggccacacgcgaggctcagaagagaaccgccgcgggaattatgaaaaatcccaccgttgatggcatcgtggccatcgacctcgaccccgtcgtgtacgatgctaagttcgaaaaacagctggggcagattatgctgctcatcctttgtacaagccaaattctgctgatgcggacgacctgggccctctgcgagtctatcacactggctaccggacctcttacaaccctgtgggaaggcagcccgggcaagttttggaacacgacaattgccgtgtccatggccaatatcttccgcgggtcttatctcgcgggagctggcctggccttcagcctgatgaaatccctcgggggaggcagacgggggaccggagctcagggcgagacccttggcgagaagtggaagcgccagctgaaccagctgagcaaatccgaatttaatacatacaagagatctgggatcatggaggttgaccggagcgaagccaaagagggactcaagagaggcgaaaccacaaaacatgccgtctcccgcgggacggctaagctgcggtggttcgtggagagaaaccttgtgaagcccgagggaaaagtcattgatctgggctgtgggcgcggaggctggtcttattactgcgccggcctcaagaaagttaccgaagtgaaggggtatacaaaaggaggccctgggcacgaggaacccatccctatggcgacctacggatggaatattgtgaagctgcacagcggccgggacgtctttttcacaccccctgagaaatgtgataccctgctctgcgacatcggggaatcctctccgaaccccacgattgaggagggaagaacccttcgcgtgctgaagatggttgaaccttggctgcggggcaatcaattttgtatcaagattctcaacccctacatgcctagcgtggtcgagacactggaacagatgcagagaaaacatggcgggatgcttgtgcgcaatcccctgtcccggaacagcacccacgagatgtattgggtttcttgcggaacaggcaatatcgtgtccgccgtcaacatgaccagcagaatgctcctgaaccgcttcacaatggctcatcggaagccgacctacgagagagatgtggacctgggggccggaacgcgccacgtggctgtcgaacctgagatcgccaatctcgatattatcggccagagaattgaaaacatcaaaaatgagcacaagtctacatggcattatgacgaagataacccctacaaaacctgggcgtatcacgggtcctacgaggttaagcccagcggatctgcctccagcatggtgaatggcgtggtccggctgcttaccaagccttgggacgtgattcccatggttacacaaatcgctatgacggacaccacaccttttggccagcagcgcgtgttcaaagagaaggtcgataccagaacaccgcggcccaaaagagggaccgcccaaatcatggaagtgacagctaagtggctgtggggatttctctcccggaacaaaaagcctcgcatttgtaccagagaggagttcacgcggaaggttcgcagcaatgccgctatcggcgccgtgtttgtcgacgagaaccagtggaactctgcgaaagaagccgtggaggatgagagattctgggacctggttcatcgggaacgcgagcttcacaagcaggggaaatgcgctacctgcgtgtataacatgatgggaaagagagagaagaaactgggcgagtttgggaaggccaaaggcagccgggctatttggtacatgtggctcggagcccgcttcctggagttcgaggccctgggctttatgaatgaggatcattggttctccagagaaaactctctcagcggggtcgagggagaaggcctgcacaaacttgggtacatcctgcgggacatttccaaaatccccggaggcaatatgtatgcggatgacacagctgggtgggatacccgcatcacagaggacgatctccagaacgaggccaagattaccgacatcatggaacctgagcacgccctgcttgctacgtctatttttaaactgacataccaaaataaggtggtcagagtgcagcggcccgccaaaagcggcaccgttatggatgtgatctcccgcagagaccagcggggatctggccaggtcgggacatatggactcaacaccttcacgaacatggaagtgcaactgattagacagatggagagcgaaggcatcttttccccgagcgagctggaaaattctaacctcgctgaacgcgtgctggactggcttgagaagcatggggttgaacggctgaagagaatggccatctccggagatgactgtgtggtcaaacctaccgatgaccgcttcgcgacagccctcaccgctctgaatgatatgggcaaggtgcggaaagacattccccagtgggagcctagcaaggggtggaacgattggcagcaagttcccttttgctctcaccatttccaccagcttatcatgaaagacggcagagaaattgtggtcccttgtcgcaatcaggatgagctggtgggacgggccagagtctcccagggcgctgggtggagcctccgcgagacagcctgcctgggaaagtcctacgcgcaaatgtggcagctgatgtattttcaccggagagacctccgcctggccgctaacgccatctgttctgctgtgcccgttaattgggtgccgaccagccggacaacctggtccattcatgcccaccatcagtggatgacgacagaagatatgcttagcgtctggaacagagtgtggatcgaggaaaatccttggatggaggacaagacccacgtttcttcctgggaagacgtgccctacctgggcaaacgggaggatcaatggtgcgggagcctcattggactgaccgctagagccacatgggcgaccaacatccaggtcgccatcaatcaggtgcgccggcttattggcaacgagaattatctggactacatgacatctatgaagagattcaaaaacgaaagcgatcccgagggggctctctggtga

SEQ ID NO: 19481 - RNA, 9879 nt, synthetic construct
  misc_feature 1..9879: note = derived and/or modified CDS sequence (opt5) from DENV-1__KM403582__SS-prME
  source 1..9879: mol_type = other RNA
agcgtgaccatgctgctcatgctgcttcccaccgctctggctttccacctcacgacccggggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggaccgcagatctgtcgccctggctcctcatgtggggctcggactggagacacggaccgaaacgtggatgagctccgagggcgcctggcgccagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaagaccgaggtcacaaaccctgccgttcttcggaaactgtgcattgaagcgaagatctctaataccacgacagactcccgctgtccgacccaaggagaggccaccctcgtggaagaacaagatgctaacttcgtgtgcagacggacatttgtcgaccgcggctggggcaatgggtgtggactgttcggcaaagggagccttctgacctgcgccaagtttaaatgcgtgacaaagctcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaggagaaatcttggctggtccataagcagtggtttcttgacctgcctctcccctggacgtccggggctagcacatcccaagagacctggaatcggcaggatctgctggtgacattcaaaaccgcgcacgccaagaaacaggaagtcgtggttctcggatctcaagagggcgctatgcacaccgccctgacaggggccacggaaattcagaccagcggaacaaccacaatctttgctggccatcttaagtgcagactgaagatggacaaactcaccctgaagggggtgtcctatgtcatgtgtacgggcagcttcaaactggagaaggaagtggccgagacacagcacggaaccgttcttgtgcaggtcaaatacgagggcaccgatgcgccgtgcaagattcctatctctacacaagacgaaaagggggtgacccagaacggacgcctcatcacagctaatcccattgtgacggataaagagaagcctgttaacatcgaaaccgagccgcccttcggcgagtcctatattgtcatcggggccggagaaaaagccctgaagctgagctggtttaaaaagggctctagcattgggaagatgttcgaggctacagcccggggcgctagacgcatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagccggtctacatcccttagcatgacctgtatcgctgtcggcatggtgacactctacctgggggttatggtgcaggccgactctggatgcgtcattaactggaaaggcagagaactgaagtgtgggtccggaatctttgtgaccaacgaggttcacacatggaccgaacaatataaattccaggctgatagccctaagcgcctctccgccgcgattggcaaggcctgggaggagggggtgtgcggcatccggtctacgacaagactggaaaatatcatgtggaaacagattagcaacgagcttaatcatatcctgctcgaaaacgacatgaagtttaccgtcgtggtgggagacgctaatggcattctgacccaggggaaaaagatgatccgcccgcaacccatggagcacaaatactcctggaagtcttggggaaaagccaagattatcggcgctgatacacagaacaccacgttcatcattgacgggcctgatacacccgaatgtcctgacgatcagcgggcctggaatatctgggaggtcgaggactatggatttggcgttttcaccacaaacatttggctgaaacttagagatagctacacccagatgtgcgaccaccgcctcatgtccgccgctatcaaagatagcaaggcggtgcatgccgacatgggctattggattgaatctgagaaaaatgaaacatggaagctggctcgggcctcctttatcgaggtgaaaacctgtatctggcccagaagccacacgctgtggtctaacggggtcctcgaatccgagatggtgattccgaagatctacggaggccctattagccaacataattatcggcccgggtacttcacccagacagccggaccttggcacctgggcaaacttgagctggatttcaacctctgcgaagggaccacagttgtggtcgacgagcactgcggaaatcgcggcccctctctgagaaccacgacagtgaccggcaaaatcattcatgaatggtgttgccggagctgtacactgcctccccttagatttcgcggggaggatggatgctggtacggcatggagatccggccggttaaggaaaaagaggaaaacctcgtgagatccatggtcagcgctgggtctggagaggtggactccttcagcctgggcctgctctgtgtttccatcatgattgaagaggtgatgcgctctagatggagccggaagatgctgatgaccgggacccttgccatctttttcctgctcattatgggacagctgacatggaatgacctgatccgcctttgcattatggtcggcgcgaacgtgtccgatagaatgggcatggggacgacctatctggctctcatggccacatttaaaatgcggcctatgttcgccgtgggactgctctttcgcagactgacctctcgggaggtccttctgctcacaatcggcctgagcctggttgcttccgtggaacttcccaactctctggaggaactcggggacggactggccatgggcattatgatgctcaagctgcttaccgatttccaaagccaccagctgtggacgacactcctgtccctgacctttatcaagaccacacttagcctggactacgcgtggaaaaccatggctatggtgctctctatcgtctccctgttccccctctgtctgagcacaacgtctcagaagaccacatggcttcctgtgctgctggggtcctttggatgcaaaccgctcaccatgttcctgattacagagaataagatctggggccgcaaaagctggccccttaacgaaggcattatggccgttgggatcgtgtctattctgctctccagcctgctcaagaatgatgtccctctggccggaccccttatcgctggcgggatgctgatcgcctgttatgtgatttccggaagctctgctgacctgagcctcgagagagccgcggaggtttcctgggaagaggaagccgagcattctggcgctagccacaacatcctggtggaagtccaggatgacgggaccatgaagattaaagatgaggagcgggacgatacgcttaccatcctgctcaaggccacactgctcgctgtgtccggagtctaccctatgtctattcccgccaccctgtttgtgtggtatttctggcagaagaagaaacagcgcagcggcgttctttgggacacacctagccctcccgaagtggagagagccgtcctggatgacggcatctaccggatcctgcagagagggctcctgggacgctctcaggtgggcgttggggtgttccaagacggagtctttcataccatgtggcacgtgacacggggcgctgtgcttatgtatcaggggaagagactggaacccagctgggcgtccgttaaaaaggatctcattagctacggaggcggctggcgcttccaggggtcttggaatacgggagaggaggtccaggtgatcgccgtggaacccggcaagaaccctaaaaatgtccaaaccacacccgggacctttaagaccccggagggagaagtgggcgctattgccctggacttcaaacctgggacatccggaagccccatcgttaaccgggagggcaagattgtgggcctctacgggaatggagtcgtgacgacctctggcacatatgtttccgccatcgctcaggccaaagcgagccaggaagggcctctgcccgagattgaggatgaagtgtttaagaagagaaaccttaccatcatggacctgcaccccggatccggcaaaacacgccggtacctgcctgctatcgtcagagaggccattaagcgcaaactccggaccctgatccttgccccgacgagagtggttgcttctgaaatggccgaggcgctgaaggggatgcccattcggtatcaaacaaccgctgtgaaaagcgaacataccggcaaggagatcgtcgatctcatgtgccacgccacattcaccatgcgcctgctgtcccctgtgagagtgcccaattacaacatgattatcatggacgaggcccattttacagatcctgctagcatcgccgctcggggatatatttctacccgcgtcggcatgggggaagccgcggccatcttcatgacggctacaccccctggatccgttgaggcctttccgcagagcaatgctgtgattcaggacgaagagagagatatccccgaacggtcttggaacagcggctacgactggattaccgatttccctgggaagacagtgtggtttgtcccctccatcaaatctggaaatgacatcgccaactgtctcagaaagaacggcaaacgcgtgattcagcttagccggaagaccttcgacacggagtatcagaagaccaagaataacgattgggactacgttgtgacaaccgatatctccgagatgggggccaatttcagagctgaccgcgtcattgatcctcggagatgcctgaagcccgtgatcctgaaagacggcccggaacgcgttattctcgcgggacctatgcccgtgacagccgcttctgccgcccagcggagaggccgcatcgggagaaaccagaataaggagggagatcagtacatttatatgggccaacccctgaacaatgacgaagatcacgctcattggaccgaggccaaaatgcttctggacaacatcaatacacctgaggggatcattcccgcgctctttgaacctgagcgggaaaagagcgctgccatcgatggagagtaccgcctgagaggcgaagcccggaaaaccttcgtcgagctgatgcgcagaggggacctcccggtgtggctttcctataaggtcgctagcgagggctttcagtactctgatcggagatggtgcttcgacggagaacgcaacaatcaggtgctggaggaaaacatggacgttgagatttggacgaaggaaggcgagcggaaaaagctgagaccccgctggctcgatgcccggacatattccgaccctctggcgcttagagagtttaaagagttcgccgctgggcggcgcagcgtgtccggagatctgatcctcgagattggcaagctgccccagcacctgaccctcagagcccaaaatgctcttgacaacctggtgatgctgcacaattctgaacaagggggaaaagcctaccggcatgctatggaggaactccctgataccatcgagacactgatgcttctggccctcatcgcggtcctgaccggcggcgttacactgtttttcctcagcgggaagggacttggcaaaacgtccattgggctgctgtgtgtgatggcctctagcgtgctcctgtggatggcttccgtcgagccccactggatcgccgctagcattatccttgaatttttcctgatggtgctcctgattccggagcctgaccgccagagaacaccccaggataaccaactggcctatgttgtgatcggactcctttttatgatcctgacagtcgccgctaacgaaatgggcctgctcgagaccacaaagaaggacctggggattggacatgtggtcgcggagaatcaccaccatgccaccatgcttgatatcgacctgcaccctgcttctgcctggacgctctacgccgtggctaccacaattatcacccccatgatgcggcatacaattgaaaacaccacggccaatatctccctgacagcgattgccaaccaggctgccatcctgatgggcctcgataaaggctggcctatcagcaagatggacattggggttccccttctggctctgggatgctactctcaggtgaatccgctcaccctgacagccgcggtccttatgctggtggcccactatgctatcattggccctgggctccaagccaaagctacccgcgaggcccagaagagaaccgctgccggaatcatgaaaaaccccacagttgatggcattgtggcgatcgacctggaccccgtcgtgtacgatgccaagttcgaaaagcagctggggcagatcatgctccttattctgtgtacgtcccaaatcctgctcatgcggaccacatgggctctgtgcgagagcattacccttgccacaggacctctgaccacgctctgggaaggctctccgggcaaattttggaatacaaccatcgctgtgagcatggccaacattttccgcgggtcctatctggccggagcgggcctggctttctctctcatgaagtcccttgggggaggcagacgggggaccggagcccagggcgagacactgggcgagaaatggaagagacagctgaatcagctctccaaaagcgaatttaacacctacaagcgctccgggatcatggaggttgaccggtctgaagctaaggagggactgaaaagaggcgaaacaacgaagcatgccgtcagccgcgggaccgccaaacttcggtggttcgtggagagaaatctggtgaagcccgagggaaaagtcatcgatctcggctgtgggcgcggaggctggtcctattactgcgctggcctgaagaaggttacagaagtgaaagggtataccaagggaggccctgggcacgaggaacccattcctatggccacatacggatggaacatcgtgaaactgcactctggccgggacgtctttttcacgccccctgagaagtgtgataccctcctttgcgacattggggaaagctccccgaatcccaccatcgaggagggaagaacactgcgcgtgctgaaaatggttgaaccttggctccggggcaaccaattttgtattaagatcctgaatccctacatgccttctgtggtcgagacccttgaacagatgcagagaaaacatggcgggatgctggtgcgcaaccccctcagcagaaattccacacacgagatgtattgggttagctgcggaaccggcaacattgtgtctgcggtcaacatgacatccagaatgctgctgaatcgcttcaccatggcccatagaaagccgacgtacgagcgggatgtggacctcggggctggaacacgccacgtggccgtcgaacctgagaccgctaacctggatatcatcggccagagaattgaaaatatcaagaacgagcacaaaagcacctggcattatgacgaagataatccctacaagacatgggcctatcacgggtcttacgaggttaaaccctccggaagcgcgtcttccatggtgaacggcgtggtccggcttctgacgaagccttgggacgtgattcccatggttacccaaatcgccatgacagacaccacaccttttggccagcagagagtgttcaaagagaaggtcgatacccggacaccgcgccccaagagagggaccgctcaaattatggaagtgacggccaaatggctctggggatttctgagccggaataagaaacctcgcatctgtaccagagaggagttcacacggaaggttcgctccaacgctgccatcggcgctgtgtttgtcgacgagaatcagtggaacagcgccaaagaagcggtggaggatgagagattctgggaccttgttcatcgggaacgcgagctgcacaagcaggggaagtgcgctacctgcgtgtataatatgatgggaaaaagagaaaagaaactcggcgagtttgggaaggccaaaggctctcgggccatttggtacatgtggctgggagctcgcttcctggagttcgaggccctcggctttatgaacgaggatcattggttcagcagagaaaattccctgtctggggtcgagggagaaggccttcacaagctggggtacatcctccgggacattagcaagatccccggaggcaacatgtatgccgatgacacagcggggtgggatacccgcattacggaggacgatctgcagaatgaggctaaaatcacagacatcatggaacctgagcacgcccttctggccacctccatttttaagctcacataccaaaacaaagtggtcagagtgcagcggcccgctaagtctggcaccgttatggatgtgatcagcagacgcgaccagcggggatccggccaggtcgggacgtatggactgaacaccttcacaaatatggaagtgcaactgattagacagatggagtctgaaggcatctttagcccgtccgagctcgagaacagcaatctggccgaacgcgtgcttgactggctggagaaacatggggttgaacggctcaagagaatggctatttctggagatgactgtgtggtcaaacctaccgatgaccgcttcgccacagcgctgaccgcccttaacgatatgggcaaggtgcggaaggacatcccccagtgggagccttccaaagggtggaatgattggcagcaagttcccttttgcagccaccatttccaccagctgatcatgaaggacggcagagaaattgtggtcccttgtcgcaaccaggatgagctcgtgggacgggctagagtctctcagggcgccgggtggtccctgcgcgagacagcttgcctgggaaaaagctacgcccaaatgtggcagctcatgtattttcaccggagagacctgcggcttgcggccaatgctatctgttccgccgtgcccgttaactgggtgccgacctctagaacgacatggagcattcatgctcaccatcagtggatgaccaccgaagatatgctgtccgtctggaatcgcgtgtggatcgaggaaaacccttggatggaggacaagacacacgttagctcttgggaagacgtgccctacctcggcaaacgggaggatcaatggtgcgggtccctgattggacttaccgccagagctacatgggccacgaatatccaggtcgcgattaaccaggtgcgcagactgatcggcaatgagaactatctcgactacatgaccagcatgaagcggttcaagaatgaatctgatcccgagggggccctgtggtga

SEQ ID NO: 19482 - RNA, 9879 nt, synthetic construct
  misc_feature 1..9879: note = derived and/or modified CDS sequence (opt5) from DENV-1__KM403577__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagaacaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaagggggtgtcctatgtcatgtgtacgggcagcttcaaactggagaaggaagtggccgagacacagcacggaaccgttctggtgcaggtcaagtacgagggcaccgatgcgccgtgcaaaattcctatctctacacaagacgaaaagggggtgacccagaacggacggcttatcacagctaatcccattgtgacggataaagagaagcctgttaacatcgaaaccgagccgccctttggcgagtcctatattgtcatcggggccggagaaaaagccctcaagctgagctggttcaagaaaggctctagcattgggaagatgtttgaggctacagccagaggcgctcgccggatggccatcctgggagacaccgcgtgggatttcggctccatcgggggagtgtttacatctgtgggcaaactcgtccatcaggtgttcgggaccgcctacggagttctgtttagcggcgtgtcctggacgatgaagattgggatcggcattcttctgacctggctcggactgaatagcagatctacatccctgagcatgacctgtatcgctgtcggcatggtgacactttacctcggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctgtccgccgcgattggcaaggcctgggaggagggggtgtgcggcatcagatctgctacgcgcctcgaaaatatcatgtggaaacagattagcaacgagctgaatcatatccttctggaaaacgacatgaagttcacagtcgtggtgggagacgccaatggcattctcacccaggggaaaaagatgatccggccgcaacccatggagcacaaatactcctggaagtcttggggaaaggctaaaattatcggcgccgatacccagaacacaacctttatcattgacgggcctgatacgcccgaatgtcctgacgatcagagagcctggaatatctgggaggtcgaggactatggattcggcgtttttacaaccaacatttggctgaagctgcgcgatagctacacacagatgtgcgaccaccggcttatgtccgctgcgatcaaagatagcaaggccgtgcatgctgacatgggctattggattgaatctgagaaaaatgaaacctggaagctcgccagagcctccttcatcgaggtgaagacatgtatctggccccgcagccacaccctgtggtctaacggggtcctggaatccgagatgattatcccgaaaatttacggaggccctatcagccaacataattatcggcccgggtacttcacgcagaccgctggaccttggcacctcggcaagctggagcttgattttaacctgtgcgaagggacaaccgtggttgtggacgagcactgcggaaatagaggcccctctctccggacaaccacggtcacaggcaaaattatccatgaatggtgttgccgcagctgtaccctgcctcccctgagattcagaggggaagatggatgctggtacggcatggagatcagaccggtgaaggaaaaagaggaaaaccttgttcgctccatggtgagcgccgggtctggagaggtcgactcctttagcctcggcctgctgtgtgtgtccattatgatcgaagaggttatgcggtctagatggagccgcaagatgctcatgacagggaccctggcggtgttctttcttctgattatgggacagctcacctggaatgacctgatcagactgtgcattatggtcggcgctaacgtgtccgatcggatgggcatggggacaacgtatcttgccctgatggccaccttcaagatgcgccctatgtttgctgtgggactcctgttcagacggctcacatctcgcgaggtcctgcttctgaccatcggcctcagcctggttgcctccgtggaactgcccaactctcttgaggaactgggggacggactcgcgatgggcattatgatgctgaaactcctgacagattttcaaagccaccagctttggaccacgctgctctccctgacattcatcaagaccaccctgagccttgactacgcttggaaaacaatggccatggtgctgtctatcgtctccctctttcccctgtgtctcagcaccacatctcagaagacgacctggctgcctgtgcttctggggtccttcggatgcaaaccgctgacaatgtttctcattaccgagaataagatctggggcagaaagagctggcccctgaacgaaggcattatggccgttgggatcgtgtctattcttctgtccagcctcctgaaaaatgatgtccctctcgctggacccctgatcgccggcgggatgcttatcgcttgttatgtgatttccggaagctctgccgacctgagcctggagcgggcggccgaggtttcctgggaagaggaagctgagcattctggcgccagccacaacatcctcgtggaagtccaggatgacgggacaatgaagattaaagatgaggagcgcgacgataccctgacgatccttctgaaggctaccctcctggccgtgtccggagtctaccctatgtctattcccgccacactcttcgtgtggtatttctggcagaagaagaaacagagaagcggcgttctgtgggacacccctagccctcccgaagtggagcgggctgtccttgatgacggcatctaccgcatcctgcagagagggctgctcggacggtctcaggtgggcgttggggtgtttcaagacggagtcttccatacaatgtggcacgtgaccagaggcgcggtgctgatgtatcaggggaaacgccttgaacccagctgggcctccgttaagaaagatctgattagctacggaggcggctggcggtttcaggggtcttggaatacaggagaggaggtccaggtgatcgctgtggaacccggcaagaaccctaaaaatgtccaaacgacccccgggacattcaagaccccggagggagaagtgggcgccattgccctcgactttaaacctgggacctccggaagccccatcgttaacagagagggcaagattgtgggcctgtacgggaatggagtcgtgacaacgtctggcacctatgtttccgctatcgcccaggcgaaggctagccaggaagggcctctccccgagattgaggatgaagtgttcaaaaagcgcaacctgacaatcatggaccttcaccccggatccggcaaaacccggagatacctgcctgccatcgtccgcgaggccattaagcggaaactgagaacactcatcctggctccgacccgcgtggttgcctctgaaatggcggaggctcttaaggggatgcccattcggtatcaaacgacagccgtgaagtccgaacataccggcaaagagatcgtcgatctgatgtgccacgccacctttacaatgagactcctgtcccctgtgcgggtgcccaattacaacatgattatcatggacgaggctcatttcaccgatcctgccagcatcgctgcccgcggatatatttctacaagagtcggcatgggggaagcggccgctatctttatgaccgccacgccccctggatccgttgaggctttcccgcagagcaatgccgtgattcaggacgaggaacgggatatccccgaacgctcttggaacagcggctacgactggattacagattttcctgggaagaccgtgtggttcgtcccctccatcaaatctggaaatgacatcgccaactgtctgagaaagaacggcaaacgggtgattcagctcagcagaaagacattcgacaccgagtatcaaaagacgaaaaataacgattgggactacgttgtgaccacagatatctccgagatgggggctaattttcgcgcggaccgggtcattgatcctagacgctgccttaagcccgtgatcctgaaagacggcccggaacgggttattctggccggacctatgcccgtgaccgctgcctctgccgctcagagacgcggccggatcgggagaaaccagaataaggagggagatcagtacatttatatgggccaacccctcaacaatgacgaagatcacgcccattggacagaggcgaaaatgctgcttgacaacatcaatacccctgaggggatcattcccgctctgttcgaacctgagcgcgaaaagagcgccgccatcgatggagagtacagactccggggcgaagctcgcaagacatttgtcgagctgatgagaagaggggacctgccggtgtggctctcctataaagtcgccagcgagggcttccagtactctgatcgcagatggtgctttgacggagaacggaacaatcaggtgcttgaggaaaacatggacgttgagatttggaccaaggaaggcgagcgcaaaaagctgcgcccccggtggctggatgcgagaacgtattccgaccctctcgccctgcgcgagttcaaagaatttgctgccgggcggagaagcgtgtccggagatcttatcctggagattggcaagctcccccagcacctgacactgcgggctcaaaatgccctcgacaaccttgtgatgctgcacaattctgaacaagggggaaaggcttaccgccatgccatggaggaactgcctgataccatcgagaccctcatgctgcttgcgctgatcgccgtcctcacaggcggcgttaccctgttctttctgagcgggaagggactcggcaagacatccattgggcttctgtgtgtgatggcttctagcgtgctgctctggatggcctccgtcgagccccactggatcgctgccagcattatcctggagttctttcttatggtgctgctcattccggagcctgacagacagcggacgccccaggataaccaactggcctatgttgtgatcggactcctgttcatgatccttaccgtcgctgcgaacgaaatgggcctgctggagacaaccaaaaaggacctcgggattggacatgtggtcgccgagaatcaccaccatgctacaatgctggatatcgaccttcaccctgcctctgcctggaccctgtacgctgtggccacgaccattatcacacccatgatgcgccataccattgaaaacacaaccgcgaatatctccctcacggccattgctaaccaggccgctatcctgatgggcctggataaaggctggcctatcagcaagatggacattggggttcccctccttgccctgggatgctactctcaggtgaatccgctgacactcaccgcggccgtcctgatgcttgtggctcactatgccatcattggccctgggctgcaagctaaagccacaagagaggctcagaagcggaccgccgcgggaatcatgaagaaccccaccgttgatggcattgtggccatcgacctcgaccccgtcgtgtacgatgctaaatttgaaaagcagctggggcagatcatgctgctcattctttgtacatcccaaatcctgctgatgcgcacgacctgggccctctgcgagagcattacactggctaccggacctcttacaaccctgtgggaaggctctccgggcaaattctggaatacgacaatcgccgtgagcatggccaacattttcagagggtcctatctcgcgggagctggcctggccttttctctgatgaaaagcctcgggggaggccggcgcgggaccggagctcagggcgagacccttggcgagaaatggaagagacagctgaatcagctgtccaagagcgagttcaacacatacaaacggtccgggatcatggaggttgacagatctgaagccaaggagggactcaaacgcggcgaaaccacaaagcatgccgtcagccgggggacggctaaactgagatggtttgtggagcgcaatcttgtgaagcccgagggaaaggtcatcgatctgggctgtgggcggggaggctggtcctattactgcgccggcctcaaaaaggttaccgaagtgaaagggtatacaaagggaggccctgggcacgaggaacccattcctatggcgacctacggatggaacatcgtgaaactgcactctggcagagacgtcttctttacaccccctgagaagtgtgataccctgctctgcgacattggggaaagctccccgaatcccacgatcgaggagggacgcacccttcgggtgctgaaaatggttgaaccttggctgagaggcaaccaattctgtattaagatcctcaatccctacatgccttctgtggtcgagacactggaacagatgcagcgcaagcatggcgggatgcttgtgcggaaccccctgagcagaaattccacccacgagatgtattgggttagctgcggaacaggcaacattgtgtctgccgtcaacatgacctcccgcatgctcctgaatcggtttacaatggctcatagaaaaccgacctacgagcgcgatgtggacctgggggccggaacgagacacgtggctgtcgaacctgagatcgccaacctcgatatcattggccagcggatcgaaaatattaagaacgagcacaaaagcacatggcattatgacgaagataatccctacaagacctgggcgtatcacgggtcttacgaggttaaaccctccggaagcgcctcttccatggtgaacggcgtggtccgcctgcttaccaagccttgggacgtgatccccatggttacacaaattgctatgacggacaccacacctttcggccagcagagagtgtttaaggagaaagtcgatacccggacaccgagacccaagcgggggaccgcccaaatcatggaagtgacagctaaatggctgtggggattcctcagccgcaataagaaacctagaatctgtacccgggaggaatttacgcgcaaggttagatccaacgccgctattggcgccgtgttcgtcgacgagaatcagtggaacagcgcgaaggaagccgtggaggatgagcggttttgggacctggttcatcgcgaaagagagcttcacaaacaggggaagtgcgctacctgcgtgtataatatgatgggaaaacgggaaaagaaactgggcgagttcgggaaggccaagggctctcgcgctatctggtacatgtggctcggagccagattcctggaatttgaggccctgggcttcatgaacgaggatcattggtttagccgggaaaattccctctctggggtcgagggagaaggcctgcacaaacttgggtacattctgcgcgacatcagcaagattcccggaggcaacatgtatgcggatgacacagctgggtgggataccagaatcacagaggacgatctccagaatgaggccaaaatcaccgacattatggaacctgagcacgccctgcttgctacgtccatcttcaagctgacataccaaaacaaagtggtccgggtgcagcgccccgccaagtctggcaccgttatggatgtgattagcagacgggaccagagaggatccggccaggtcgggacatatggactcaacacctttacgaatatggaagtgcaactgatccgccagatggagtctgaaggcattttcagcccgtccgagctggagaacagcaatctcgctgaacgggtgctggactggcttgagaaacatggggttgaaagactgaagcgcatggccatctctggagatgactgtgtggtcaagcctaccgatgaccggtttgcgacagccctcaccgctctgaacgatatgggcaaagtgagaaaggacatcccccagtgggagccttccaaagggtggaatgattggcagcaagttcccttctgcagccaccattttcaccagcttattatgaaggacggccgcgaaatcgtggtcccttgtcggaaccaggatgagctggtgggacgggcccgcgtctctcagggcgctgggtggtccctccgggagacagcctgcctgggaaaaagctacgcgcaaatgtggcagctgatgtatttccacagacgcgacctccggctggccgctaatgccatttgttccgctgtgcccgttaactgggtgccgacctctagaacaacctggagcatccatgcccaccatcagtggatgacgacagaagatatgctttccgtctggaatcgggtgtggattgaggaaaacccttggatggaggacaagacccacgttagctcttgggaagacgtgccctacctgggcaagagagaggatcaatggtgcgggtccctcatcggactgaccgctcgcgccacatgggcgaccaatattcaggtcgccatcaaccaggtgcggagacttatcggcaatgagaactatctggactacatgacaagcatgaaacgctttaagaatgaatctgatcccgagggggctctctggtga

SEQ ID NO: 19483 - RNA, 9879 nt, synthetic construct
  misc_feature 1..9879: note = derived and/or modified CDS sequence (opt5) from DENV-1__KM403631__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctatcaacattgaaaccgagccgcccttcggcgagtcctatatcgttattggggccggagaaaaagccctgaagctgagctggtttaagaaaggctctagcatcgggaagatgttcgaggctacagccagaggcgctcgccggatggccatcctcggagacaccgcgtgggattttggctccattgggggagtcttcacatctgtgggcaaactggtgcatcaggtctttgggaccgcctacggagtgcttttcagcggcgtttcctggacgatgaagatcgggattggcatcctgctcacctggctgggactgaatagcagatctacatcccttagcatgacctgtattgctgtgggcatggtcacactctacctgggggtgatggttcaggccgactctggatgcgtgatcaactggaaaggccgcgaactgaagtgtgggtccggaatttttgtcaccaacgaggtgcacacatggaccgaacaatataagttccaggctgatagccctaaacggctctccgccgcgatcggcaaggcctgggaggagggggtttgcggcatcagatctgctacgcgcctggaaaatattatgtggaaacagatcagcaacgagcttaatcatattctgctcgaaaacgacatgaagtttacagtggtcgtgggagacgccaatggcatcctgacccaggggaaaaagatgattcggccgcaacccatggagcacaaatactcctggaagtcttggggaaaggctaaaatcatcggcgccgatacccagaacacaaccttcattatcgacgggcctgatacgcccgaatgtcctgacgatcagagagcctggaatatttgggaggtggaggactatggatttggcgtcttcacaaccaacatctggctgaaacttcgcgatagctacacacagatgtgcgaccaccggctcatgtccgctgcgattaaagatagcaaggccgttcatgctgacatgggctattggatcgaatctgagaaaaatgaaacctggaagctggccagagcctcctttatcgaggtgaagacatgtatttggccccgcagccacaccctgtggtctaacggggtgctcgaatccgagatgatcattccgaaaatctacggaggccctattagccaacataattatcggcccgggtacttcacgcagaccgctggaccttggcacctgggcaaacttgagctggatttcaacctctgcgaagggacaaccgtcgtggttgacgagcactgcggaaatagaggcccctctctgcggacaaccacggtgacaggcaaaatcatccatgaatggtgttgccgcagctgtaccctgcctccccttagatttagaggggaagatggatgctggtacggcatggagattagaccggtcaaggaaaaagaggaaaacctcgtgcgctccatggttagcgccgggtctggagaggtggactccttcagcctgggcctgctctgtgtctccatcatgattgaagaggtgatgcggtctagatggagccgcaagatgctgatgacagggacccttgcggtctttttcctgctcatcatgggacagctgacctggaatgacctgattagactttgcatcatggtgggcgctaacgtctccgatcggatgggcatggggacaacgtatctggccctcatggccacctttaagatgcgccctatgttcgctgtgggactgctctttagacggctgacatctcgcgaggtgcttctgctcaccattggcctgagcctggtcgcctccgttgaacttcccaactctctggaggaactcggggacggactggcgatgggcatcatgatgctcaaactgcttacagatttccaaagccaccagctgtggaccacgctcctgtccctgacatttatcaagaccacccttagcctggactacgcttggaaaacaatggccatggtgctctctattgtgtccctgttccccctctgtctgagcaccacatctcagaagacgacctggcttcctgtcctgctggggtcctttggatgcaaaccgctcacaatgttcctgatcaccgagaataagatttggggcagaaagagctggccccttaacgaaggcatcatggccgtggggattgtttctatcctgctctccagcctgctcaaaaatgatgtgcctctggctggaccccttatcgccggcgggatgctgattgcttgttatgtcatctccggaagctctgccgacctgagcctcgagcgggcggccgaggtgtcctgggaagaggaagctgagcattctggcgccagccacaacattctggttgaagtgcaggatgacgggacaatgaagatcaaagatgaggagcgcgacgatacccttacgattctgctcaaggctaccctgctcgccgtctccggagtgtaccctatgtctatccccgccacactgtttgtctggtatttctggcagaagaagaaacagagaagcggcgtgctttgggacacccctagccctcccgaagttgagcgggctgtgctggatgacggcatctaccgcattctgcagagagggctcctgggacggtctcaggtcggcgtgggggttttccaagacggagtgtttcatacaatgtggcacgtcaccagaggcgcggtgcttatgtatcaggggaaacgcctggaacccagctgggcctccgtgaagaaagatctcatcagctacggaggcggctggcggttccaggggtcttggaatacaggagaggaggttcaggtcattgctgtggaacccggcaagaaccctaaaaatgtgcaaacgacccccgggacatttaagaccccggagggagaagtcggcgccatcgccctggacttcaaacctgggacctccggaagccccattgtgaacagagagggcaagatcgttggcctctacgggaatggagtggtcacaacgtctggcacctatgtgtccgctattgcccaggcgaaggctagccaggaagggcctctgcccgagatcgaggatgaagtttttaaaaagcgcaaccttacaatcatggacctgcaccccggatccggcaaaacccggagatacctgcctgccattgtgcgcgaggccatcaagcggaaactcagaacactgattcttgctccgacccgcgtcgtggcctctgaaatggcggaggctctgaaggggatgcccatccggtatcaaacgacagccgttaagagcgaacataccggcaaagagattgtggatctcatgtgccacgccaccttcacaatgagactgctgtcccctgtccgggtgcccaattacaacatgatcatcatggacgaggctcattttaccgatcctgccagcattgctgcccgcggatatatctctacaagagtgggcatgggggaagcggccgctattttcatgaccgccacgccccctggatccgtcgaggcttttccgcagagcaatgccgttatccaggacgaagaacgggatattcccgaacgctcttggaacagcggctacgactggatcacagatttccctgggaagaccgtgtggtttgtgccctccatcaaatctggaaatgacattgccaactgtctcagaaagaacggcaaacgggtcatccagcttagcagaaagacattcgacaccgagtatcaaaagacgaaaaataacgattgggactacgtggttaccacagatatttccgagatgggggctaatttccgcgcggaccgggtgatcgatcctagacgctgcctgaagcccgtcattctgaaagacggcccggaacgggtgatcctcgccggacctatgcccgttaccgctgcctctgccgctcagagacgcggccggattgggagaaaccagaataaggagggagatcagtacatctatatgggccaacccctgaacaatgacgaagatcacgcccattggacagaggcgaaaatgcttctggacaacatcaatacccctgaggggattatccccgctctctttgaacctgagcgcgaaaagagcgccgccattgatggagagtacagactgcggggcgaagctcgcaagacattcgtggagctgatgagaagaggggacctcccggtctggctttcctataaagtggccagcgagggctttcagtactctgatcgcagatggtgcttcgacggagaacggaacaatcaggtcctggaggaaaacatggacgtggagatctggaccaaggaaggcgagcgcaagaagctgcgcccccggtggctcgatgcgagaacgtattccgaccctctggcccttcgcgagtttaaagagttcgctgccgggcggagaagcgtttccggagatctgattctcgagatcggcaagctgccccagcacctgacactccgggctcaaaatgcccttgacaacctggtgatgctgcacaattctgaacaagggggaaaggcttaccgccatgccatggaggaactccctgataccatcgagaccctgatgcttctggcgctcattgccgtgctgacaggcggcgtcaccctgtttttcctcagcgggaagggacttggcaagacatccatcgggctgctgtgtgttatggcttctagcgtgctcctgtggatggcctccgtggagccccactggattgctgccagcatcattcttgaatttttcctgatggtcctcctgatcccggagcctgacagacagcggacgccccaggataaccaactggcctatgtggttatcggactcctttttatgattctgaccgtggctgcgaacgaaatgggcctgctcgagacaaccaaaaaggacctggggatcggacatgtcgtggccgagaatcaccaccatgctacaatgcttgatattgacctgcaccctgcctctgcctggaccctctacgctgtcgccacgaccatcattacacccatgatgcgccataccatcgaaaacacaaccgcgaatatttccctgacggccatcgctaaccaggccgctatcctgatgggcctcgataaaggctggcctattagcaagatggacatcggggtgccccttctggccctgggatgctactctcaggttaatccgctcacactgaccgcggccgtgcttatgctggtcgctcactatgccattatcggccctgggctccaagctaaagccacaagagaggctcagaagcggaccgccgcgggaattatgaagaaccccaccgtggatggcatcgttgccatcgacctggaccccgtggtctacgatgctaaattcgaaaagcagctggggcagattatgctccttatcctgtgtacatcccaaattctgctcatgcgcacgacctgggccctgtgcgagagcatcacacttgctaccggacctctgacaaccctctgggaaggctctccgggcaaattttggaatacgacaattgccgtgagcatggccaacatcttcagagggtcctatctggcgggagctggcctggccttctctctcatgaagtcccttgggggaggccggcgcgggaccggagctcagggcgagaccctgggcgagaaatggaagagacagctgaatcagctctccaagagcgaatttaacacatacaaacggtccgggatcatggaggtggacagatctgaagccaaggagggactgaaacgcggcgaaaccacaaagcatgccgttagccgggggacggctaaacttagatggttcgtcgagcgcaatctggtgaagcccgagggaaaggtgattgatctcggctgtgggcggggaggctggtcctattactgcgccggcctgaaaaaggtcaccgaagttaaagggtatacaaagggaggccctgggcacgaggaacccatccctatggcgacctacggatggaacattgtgaaactgcactctggcagagacgtgtttttcacaccccctgagaagtgtgataccctcctttgcgacatcggggaaagctccccgaatcccacgattgaggagggacgcaccctgcgggtcctgaaaatggtggaaccttggctcagaggcaaccaattttgtatcaagattctgaatccctacatgccttctgttgtggagacacttgaacagatgcagcgcaagcatggcgggatgctggtccggaaccccctcagcagaaattccacccacgagatgtattgggtgagctgcggaacaggcaacatcgtttctgccgtgaacatgacctcccgcatgctgctgaatcggttcacaatggctcatagaaaaccgacctacgagcgcgatgtcgacctcggggccggaacgagacacgtggctgtggaacctgagatcgccaacctggatattatcggccagcggattgaaaatatcaagaacgagcacaaaagcacatggcattatgacgaagataatccctacaagacctgggcgtatcacgggtcttacgaggtcaaaccctccggaagcgcctcttccatggttaacggcgtggtgcgccttctgaccaagccttgggacgtcattcccatggtgacacaaatcgctatgacggacaccacaccttttggccagcagagagttttcaaggagaaagtggatacccggacaccgagacccaagcgggggaccgcccaaatcatggaagtcacagctaaatggctctggggatttctgagccgcaataagaaacctagaatttgtacccgggaggagttcacgcgcaaggtgagatccaacgccgctatcggcgccgtttttgtggacgagaatcagtggaacagcgcgaaggaagccgtcgaggatgagcggttctgggaccttgtgcatcgcgaaagagagctgcacaaacaggggaagtgcgctacctgcgtttataatatgatgggaaaacgggaaaagaaactcggcgagtttgggaaggccaagggctctcgcgctatttggtacatgtggctgggagccagattcctggagttcgaggccctcggctttatgaacgaggatcattggttcagccgggaaaattccctgtctggggtggagggagaaggccttcacaaactggggtacatcctccgcgacattagcaagatccccggaggcaacatgtatgcggatgacacagctgggtgggataccagaatcacagaggacgatctgcagaatgaggccaaaattaccgacatcatggaacctgagcacgcccttctggctacgtccatttttaagctcacataccaaaacaaagtcgtgcgggtccagcgccccgccaagtctggcaccgtgatggatgttatcagcagacgggaccagagaggatccggccaggtggggacatatggactgaacaccttcacgaatatggaagtccaactgattcgccagatggagtctgaaggcatctttagcccgtccgagctcgagaacagcaatctggctgaacgggtgcttgactggctggagaaacatggggtggaaagactcaagcgcatggccatctctggagatgactgtgttgtgaagcctaccgatgaccggttcgcgacagccctgaccgctcttaacgatatgggcaaagtcagaaaggacattccccagtgggagccttccaaagggtggaatgattggcagcaagtgcccttttgcagccaccatttccaccagctgatcatgaaggacggccgcgaaattgttgtgccttgtcggaaccaggatgagctcgtcggacgggcccgcgtgtctcagggcgctgggtggtccctgcgggagacagcctgcctgggaaaaagctacgcgcaaatgtggcagctcatgtattttcacagacgcgacctgcggcttgccgctaatgccatctgttccgctgtccccgtgaactgggttccgacctctagaacaacctggagcattcatgcccaccatcagtggatgacgacagaagatatgctgtccgtgtggaatcgggtctggatcgaggaaaacccttggatggaggacaagacccacgtgagctcttgggaagacgttccctacctcggcaagagagaggatcaatggtgcgggtccctgattggacttaccgctcgcgccacatgggcgaccaatatccaggtggccatcaaccaggtccggagactgattggcaatgagaactatctcgactacatgacaagcatgaaacgcttcaagaatgaatctgatcccgagggggctctgtggtga

SEQ ID NO: 19484 - RNA, 9879 nt, synthetic construct
  misc_feature 1..9879: note = derived and/or modified CDS sequence (opt5) from DENV-1__KM403632__SS-prME
  source 1..9879: mol_type = other RNA
agcgtgaccatgctgctcatgctgcttcccacagctctggctttccacctcacgaccagaggcggggaacctcatatgatcgtgtccaagcaggaacggggaaaatctctgctttttaagacaagcgccggcgttaacatgtgcaccctgattgcgatggacctcggggaactgtgtgaagatacaatgacctacaaatgcccgcgcatcacagaagctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttcggtgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccgcacaggccttgatttcaacgaaatggtgctgctcaccatgaaagagaagtcttggctggtccataaacagtggtttcttgacctgcctctcccctggacgtccggggctagcacatcccaagagacctggaatagacaggatctgctggtgacattcaagaccgcgcacgccaaaaagcaggaagtcgtggttctcggatctcaagagggcgctatgcacaccgccctgacaggggccacggaaattcagaccagcggaacaaccacaatctttgctggccatcttaagtgccggctgaaaatggacaagctcaccctgaaaggggtgtcctatgtcatgtgtacgggcagcttcaagctggagaaagaagtggccgagacacagcacggaaccgttcttgtgcaggtcaagtacgagggcaccgatgcgccgtgcaagattcctatctctacacaagacgaaaaaggggtgacccagaacggaagactcatcacagctaatcccattgtgacggataaggagaaacctgttaacatcgaaaccgagccgcccttcggcgagtcctatattgtcatcggggccggagaaaaggccctgaaactgagctggtttaagaagggctctagcattgggaaaatgttcgaggctacagcccgcggcgctcggagaatggccatcctcggagacaccgcgtgggattttggctccatcgggggagtgttcacatctgtgggcaagctggtccatcaggtgtttgggaccgcctacggagttcttttcagcggcgtgtcctggacgatgaaaattgggatcggcattctgctcacctggctgggactgaatagccgctctacatcccttagcatgacctgtatcgctgtcggcatggtgacactctacctgggggttatggtgcaggccgactctggatgcgtcattaactggaagggccgggaactgaaatgtgggtccggaatctttgtgaccaacgaggttcacacatggaccgaacaatataagttccaggctgatagccctaagagactctccgccgcgattggcaaagcctgggaggagggggtgtgcggcatccgctctgctacgcggctggaaaatatcatgtggaagcagattagcaacgagcttaatcatatcctgctcgaaaacgacatgaaatttacagtcgtggtgggagacgccaatggcattctgacccaggggaagaaaatgatcagaccgcaacccatggagcacaagtactcctggaaatcttggggaaaggctaagattatcggcgccgatacccagaacacaaccttcatcattgacgggcctgatacgcccgaatgtcctgacgatcagcgcgcctggaatatctgggaggtcgaggactatggatttggcgttttcacaaccaacatttggctgaaacttcgggatagctacacacagatgtgcgaccacagactcatgtccgctgcgatcaaggatagcaaagccgtgcatgctgacatgggctattggattgaatctgagaagaatgaaacctggaaactggcccgcgcctcctttatcgaggtgaagacatgtatctggccccggagccacaccctgtggtctaacggggtcctcgaatccgagatgattatcccgaagatttacggaggccctatcagccaacataattatagacccgggtacttcacgcagaccgctggaccttggcacctgggcaaacttgagctggatttcaacctctgcgaagggacaaccgtggttgtggacgagcactgcggaaatcggggcccctctctgcgcacaaccacggtcacaggcaagattatccatgaatggtgttgcagaagctgtaccctgcctccccttcggtttagaggggaggatggatgctggtacggcatggagatccgcccggtgaaagaaaaggaggaaaacctcgttcggtccatggtgagcgccgggtctggagaggtcgactccttcagcctgggcctgctctgtgtgtccattatgatcgaagaggttatgagatctcgctggagcagaaaaatgctgatgacagggacccttgcggtgtttttcctgctcattatgggacagctgacctggaatgacctgatccggctttgcattatggtcggcgctaacgtgtccgatcgcatgggcatggggacaacgtatctggccctcatggccacctttaagatgagacctatgttcgctgtgggactgctctttcggcgcctgacatctagagaggtccttctgctcaccatcggcctgagcctggttgcctccgtggaacttcccaactctctggaggaactcggggacggactggcgatgggcattatgatgctcaagctgcttacagatttccaaagccaccagctgtggaccacgctcctgtccctgacatttatcaaaaccacccttagcctggactacgcttggaagacaatggccatggtgctctctatcgtctccctgttccccctctgtctgagcaccacatctcagaaaacgacctggcttcctgtgctgctggggtcctttggatgcaagccgctcacaatgttcctgattaccgagaataaaatctggggccggaagtcctggccccttaacgaaggcattatggccgttgggatcgtgtctattctgctctccagcctgctcaagaatgatgtccctctggctggaccccttatcgccggcgggatgctgatcgcttgttatgtgatttccggaagctctgccgacctgagcctcgagcgcgcggccgaggtttcctgggaagaggaagctgagcattctggcgccagccacaacatcctggtggaagtccaggatgacgggacaatgaaaattaaggatgaggagagagacgatacccttacgatcctgctcaaagctaccctgctcgccgtgtccggagtctaccctatgtctattcccgccacactgtttgtgtggtatttctggcaaaagaaaaagcagcggagcggcgttctttgggacacccctagccctcccgaagtggagcgcgctgtcctggatgacggcatctacagaatcctgcagcgggggctcctgggaagatctcaggtgggcgttggggtgttccaagacggagtctttcatacaatgtggcacgtgacccgcggcgcggtgcttatgtatcaggggaaacggctggaacccagctgggcctccgttaagaaggatctcattagctacggaggcggctggagattccaggggtcttggaatacaggagaggaggtccaggtgatcgctgtggaacccggcaaaaaccctaagaatgtccaaacgacccccgggacatttaaaaccccggagggagaagtgggcgccattgccctggacttcaagcctgggacctccggaagccccatcgttaaccgcgagggcaaaattgtgggcctctacgggaatggagtcgtgacaacgtctggcacctatgtttccgctatcgcccaggcgaaggctagccaggaagggcctctgcccgagattgaggatgaagtgtttaagaaacggaaccttacaatcatggacctgcaccccggatccggcaagaccagacgctacctgcctgccatcgtccgggaggccattaaaagaaagctccgcacactgatccttgctccgacccgggtggttgcctctgaaatggcggaggctctgaaagggatgcccattagatatcaaacgacagccgtcaagagcgaacataccggcaaggagatcgtcgatctcatgtgccacgccaccttcacaatgcggctgctgtcccctgtgcgcgtgcccaattacaacatgattatcatggacgaggctcattttaccgatcctgccagcatcgctgccagaggatatatttctacacgggtcggcatgggggaagcggccgctatcttcatgaccgccacgccccctggatccgttgaggcttttccgcagagcaatgccgtgattcaggacgaagaacgcgatatccccgaaagatcttggaacagcggctacgactggattacagatttccctgggaaaaccgtgtggtttgtcccctccatcaagtctggaaatgacatcgccaactgtctccggaaaaacggcaagagagtgattcagcttagccgcaaaacattcgacaccgagtatcaaaagacgaagaataacgattgggactacgttgtgaccacagatatctccgagatgggggctaatttccgggcggacagagtcattgatcctcgccggtgcctgaaacccgtgatcctgaaggacggcccggaaagagttattctcgccggacctatgcccgtgaccgctgcctctgccgctcagcgccggggcagaatcgggcgcaaccagaataaagagggagatcagtacatttatatgggccaacccctgaacaatgacgaagatcacgcccattggacagaggcgaagatgcttctggacaacatcaatacccctgaggggatcattcccgctctctttgaacctgagagagaaaagagcgccgccatcgatggagagtaccggctgcgcggcgaggctagaaagacattcgtcgagctgatgcggcgcggggacctcccggtgtggctttcctataaggtcgccagcgagggctttcagtactctgatagacggtggtgcttcgacggagaaagaaacaatcaggtgctggaggaaaacatggacgttgagatttggaccaaagaaggcgagcgcaagaaactgcggcccagatggctcgatgcgcgcacgtattccgaccctctggcccttcgggagtttaaggagttcgctgccgggagacggagcgtgtccggagatctgatcctcgagattggcaaactgccccagcacctgacactccgcgctcaaaatgcccttgacaacctggtgatgctgcacaattctgaacaagggggaaaggcttacagacatgccatggaggaactccctgataccatcgagaccctgatgcttctggcgctcatcgccgtcctgacaggcggcgttaccctgtttttcctcagcgggaaaggacttggcaagacatccattgggctgctgtgtgtgatggcttctagcgtgctcctgtggatggcctccgtcgagccccactggatcgctgccagcattatccttgaatttttcctgatggtgctcctgattccggagcctgaccggcagcgcacgccccaggataaccaactggcctatgttgtgatcggactcctttttatgatcctgaccgtcgctgcgaacgaaatgggcctgctcgagacaaccaagaaagacctggggattggacatgtggtcgccgagaatcaccaccatgctacaatgcttgatatcgacctgcaccctgcctctgcctggaccctctacgctgtggccacgaccattatcacacccatgatgagacataccattgaaaacacaaccgcgaatatctccctgacggccattgctaaccaggccgctatcctgatgggcctcgataagggctggcctatcagcaaaatggacattggggttccccttctggccctgggatgctactctcaggtgaatccgctcacactgaccgcggccgtccttatgctggtggctcactatgccatcattggccctgggctccaagctaaggccacacgggaggctcagaaacgcaccgccgcgggaatcatgaagaaccccaccgttgatggcattgtggccatcgacctggaccccgtcgtgtacgatgctaagttcgaaaaacagctggggcagatcatgctccttattctgtgtacatcccaaatcctgctcatgagaacgacctgggccctgtgcgagagcattacacttgctaccggacctctgacaaccctctgggaaggctctccgggcaagttttggaatacgacaatcgccgtgagcatggccaacattttccgggggtcctatctggcgggagctggcctggccttctctctcatgaaaagccttgggggaggccgcagagggaccggagctcagggcgagaccctgggcgagaagtggaaacggcagctgaatcagctctccaagagcgaatttaacacatacaagagatccgggatcatggaggttgaccgctctgaagccaaagagggactgaagcggggcgaaaccacaaaacatgccgtcagcagagggacggctaaacttcgctggttcgtggagcggaatctggtgaaacccgagggaaaggtcatcgatctcggctgtgggagaggaggctggtcctattactgcgccggcctgaagaaagttaccgaagtgaaggggtatacaaaaggaggccctgggcacgaggaacccattcctatggcgacctacggatggaacatcgtgaagctgcactctggccgcgacgtctttttcacaccccctgagaaatgtgataccctcctttgcgacattggggaaagctccccgaatcccacgatcgaggagggacggaccctgagagtgctgaagatggttgaaccttggctccgcggcaaccaattttgtattaaaatcctgaatccctacatgccttctgtggtcgagacacttgaacagatgcagcggaagcatggcgggatgctggtgagaaaccccctcagccgcaattccacccacgagatgtattgggttagctgcggaacaggcaacattgtgtctgccgtcaacatgacctcccggatgctgctgaatagattcacaatggctcatcgcaagccgacctacgagagagatgtggacctcggggccggaacgcggcacgtggctgtcgaacctgagatcgccaacctggatatcattggccagcgcatcgaaaatattaaaaacgagcacaagagcacatggcattatgacgaagataatccctacaaaacctgggcgtatcacgggtcttacgaggttaagccctccggaagcgcctcttccatggtgaacggcgtggtcagacttctgaccaaaccttgggacgtgatccccatggttacacaaattgctatgacggacaccacaccttttggccagcagcgggtgttcaaggagaaggtcgataccagaacaccgcggcccaaacgcgggaccgcccaaatcatggaagtgacagctaagtggctctggggatttctgagcagaaataaaaagcctcggatctgtacccgcgaggagttcacgagaaaagttcggtccaacgccgctattggcgccgtgtttgtcgacgagaatcagtggaacagcgcgaaggaagccgtggaggatgagcgcttctgggaccttgttcatagagaacgggagctgcacaagcaggggaaatgcgctacctgcgtgtataatatgatgggaaagcgcgagaaaaagctcggcgagtttgggaaagccaagggctctagagctatctggtacatgtggctgggagcccggttcctggagttcgaggccctcggctttatgaacgaggatcattggttcagccgcgaaaattccctgtctggggtcgagggagaaggccttcacaagctggggtacattctcagagacatcagcaaaattcccggaggcaacatgtatgcggatgacacagctgggtgggatacccggatcacagaggacgatctgcagaatgaggccaagatcaccgacattatggaacctgagcacgcccttctggctacgtccatctttaaactcacataccaaaacaaggtggtccgcgtgcagagacccgccaaatctggcaccgttatggatgtgattagccggagagaccagcgcggatccggccaggtcgggacatatggactgaacaccttcacgaatatggaagtgcaactgatccggcagatggagtctgaaggcatttttagcccgtccgagctcgagaacagcaatctggctgaaagagtgcttgactggctggagaagcatggggttgaacgcctcaaacggatggccatctctggagatgactgtgtggtcaagcctaccgatgacagattcgcgacagccctgaccgctcttaacgatatgggcaaggtgcgcaaagacatcccccagtgggagccttccaaggggtggaatgattggcagcaagttcccttttgcagccaccatttccaccagctgattatgaaagacggccgggaaatcgtggtcccttgtagaaaccaggatgagctcgtgggacgcgcccgggtctctcagggcgctgggtggtccctgagagagacagcctgcctgggaaagagctacgcgcaaatgtggcagctcatgtattttcaccgccgggacctgagacttgccgctaatgccatttgttccgctgtgcccgttaactgggtgccgacctctcggacaacctggagcatccatgcccaccatcagtggatgacgacagaagatatgctgtccgtctggaatagagtgtggattgaggaaaacccttggatggaggacaaaacccacgttagctcttgggaagacgtgccctacctcggcaagcgcgaggatcaatggtgcgggtccctgatcggacttaccgctcgggccacatgggcgaccaatattcaggtcgccatcaaccaggtgagacgcctgatcggcaatgagaactatctcgactacatgacaagcatgaagagattcaaaaatgaatctgatcccgagggggctctgtggtga

SEQ ID NO: 19485 - RNA, 9879 nt, synthetic construct
  misc_feature 1..9879: note = derived and/or modified CDS sequence (opt5) from DENV-1__KM403583__SS-prME
  source 1..9879: mol_type = other RNA
agcgtgaccatgctgctcatgctgcttcccacagctctggctttccacctcacgacccggggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccgcgcattacagaggctgaacccgacgatgtggactgttggtgcaatgccaccgatacgtgggtgacctatggaacatgttcccaaaccggcgagcacagacgggaccgcagatctgtcgccctggctcctcatgtggggctcggactggagacacggaccgaaacgtggatgagctccgagggcgcctggcgccagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaagaccgaggtcacaaaccctgccgttcttcggaaactgtgcattgaagcgaagatctctaataccacgacagactcccgctgtccgacccaaggagaggccaccctcgtggaagaacaagatgctaacttcgtgtgcagacggacatttgtcgaccgcggctggggcaatgggtgtggactgttcggcaaagggagccttctgacctgcgccaagtttaaatgcgtgacaaagctcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaggagaaatcttggctggtccataagcagtggtttcttgacctgcctctcccctggacgtccggggctagcacatcccaagagacctggaatcggcaggatctgctggtgacattcaaaaccgcgcacgccaagaaacaggaagtcgtggttctcggatctcaagagggcgctatgcacaccgccctgacaggggccacggaaattcagaccagcggaacaaccacaatctttgctggccatcttaagtgcagactgaagatggacaaactcaccctgaagggggtgtcctatgtcatgtgtacgggcagcttcaaactggagaaggaagtggccgagacacagcacggaaccgttcttgtgcaggtcaaatacgagggcaccgatgcgccgtgcaagattcctatctctacacaagacgaaaagggggtgacccagaacggacgcctcatcacagctaatcccattgtgacggataaagagaagcctgttaacatcgaaaccgagccgcccttcggcgagtcctatattgtcatcggggccggagaaaaagccctgaagctgagctggtttaaaaagggctctagcattgggaagatgttcgaggctacagcccggggcgctagacgcatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagccggtctacatcccttagcatgacctgtatcgctgtcggcatggtgacactctacctgggggttatggtgcaggccgactctggatgcgtcattaactggaaaggcagagaactgaagtgtgggtccggaatctttgtgaccaacgaggttcacacatggaccgaacaatataaattccaggctgatagccctaagcgcctctccgccgcgattggcaaggcctgggaggagggggtgtgcggcatccggtctgctacgagactggaaaatatcatgtggaaacagattagcaacgagcttaatcatatcctgctcgaaaacgacatgaagtttacagtcgtggtgggagacgccaatggcattctgacccaggggaaaaagatgatccgcccgcaacccatggagcacaaatactcctggaagtcttggggaaaagctaagattatcggcgccgatacccagaacacaaccttcatcattgacgggcctgatacgcccgaatgtcctgacgatcagcgggcctggaatatctgggaggtcgaggactatggatttggcgttttcacaaccaacatttggctgaaacttagagatagctacacacagatgtgcgaccaccgcctcatgtccgctgcgatcaaagatagcaaggccgtgcatgctgacatgggctattggattgaatctgagaaaaatgaaacctggaagctggcccgggcctcctttatcgaggtgaaaacatgtatctggcccagaagccacaccctgtggtctaacggggtcctcgaatccgagatgattatcccgaagatttacggaggccctatcagccaacataattatcggcccgggtacttcacgcagaccgctggaccttggcacctgggcaaacttgagctggatttcaacctctgcgaagggacaaccgtggttgtggacgagcactgcggaaatcgcggcccctctctgagaacaaccacggtcacaggcaaaattatccatgaatggtgttgccggagctgtaccctgcctccccttagatttcgcggggaggatggatgctggtacggcatggagatccggccggtgaaggaaaaagaggaaaacctcgttagatccatggtgagcgccgggtctggagaggtcgactccttcagcctgggcctgctctgtgtgtccattatgatcgaagaggttatgcgctctagatggagccggaagatgctgatgacagggacccttgcgatctttttcctgctcatcatgggacagctgacctggaatgacctgattcgcctttgcatcatggtgggcgctaacgtctccgatagaatgggcatggggacaacgtatctggccctcatggccacctttaaaatgcggcctatgttcgctgtgggactgctctttcgcagactgacatctcgggaggtgcttctgctcaccattggcctgagcctggtcgcctccgttgaacttcccaactctctggaggaactcggggacggactggcgatgggcatcatgatgctcaagctgcttacagatttccaaagccaccagctgtggaccacgctcctgtccctgacatttatcaagaccacccttagcctggactacgcttggaaaacaatggccatggtgctctctattgtgtccctgttccccctctgtctgagcaccacatctcagaagacgacctggcttcctgtcctgctggggtcctttggatgcaaaccgctcacaatgttcctgatcaccgagaataagatttggggccgcaaaagctggccccttaacgaaggcatcatggccgtggggattgtttctatcctgctctccagcctgctcaagaatgatgtgcctctggctggaccccttatcgccggcgggatgctgattgcttgttatgtcatctccggaagctctgccgacctgagcctcgagagagcggccgaggtgtcctgggaagaggaagctgagcattctggcgccagccacaacattctggttgaagtgcaggatgacgggacaatgaagatcaaagatgaggagcgggacgatacccttacgattctgctcaaggctaccctgctcgccgtctccggagtgtaccctatgtctatccccgccacactgtttgtctggtatttctggcagaagaagaaacagcgcagcggcgtgctttgggacacccctagccctcccgaagttgagagagctgtgctggatgacggcatctaccggattctgcagagagggctcctgggacgctctcaggtcggcgtgggggttttccaagacggagtgtttcatacaatgtggcacgtcacccggggcgcggtgcttatgtatcaggggaaaagactggaacccagctgggcctccgtgaaaaaggatctcatcagctacggaggcggctggcgcttccaggggtcttggaatacaggagaggaggttcaggtcattgctgtggaacccggcaagaaccctaaaaatgtgcaaacgacccccgggacatttaagaccccggagggagaagtcggcgccatcgccctggacttcaaacctgggacctccggaagccccattgtgaaccgggagggcaagatcgttggcctctacgggaatggagtggtcacaacgtctggcacctatgtgtccgctattgcccaggcgaaagctagccaggaagggcctctgcccgagatcgaggatgaagtttttaagaagagaaaccttacaatcatggacctgcaccccggatccggcaaaacccgccggtacctgcctgccattgtgagagaggccatcaagcgcaaactccggacactgattcttgctccgaccagagtcgtggcctctgaaatggcggaggctctgaaggggatgcccatccggtatcaaacgacagccgttaaaagcgaacataccggcaaggagattgtggatctcatgtgccacgccaccttcacaatgcgcctgctgtcccctgtcagagtgcccaattacaacatgatcatcatggacgaggctcattttaccgatcctgccagcattgctgcccggggatatatctctacacgcgtgggcatgggggaagcggccgctattttcatgaccgccacgccccctggatccgtcgaggcttttccgcagagcaatgccgttatccaggacgaagagagagatattcccgaacggtcttggaacagcggctacgactggatcacagatttccctgggaagaccgtgtggtttgtgccctccatcaaatctggaaatgacattgccaactgtctcagaaagaacggcaaacgcgtcatccagcttagccggaagacattcgacaccgagtatcagaagacgaagaataacgattgggactacgtggttaccacagatatttccgagatgggggctaatttcagagcggaccgcgtgatcgatcctcggagatgcctgaagcccgtcattctgaaagacggcccggaacgcgtgatcctcgccggacctatgcccgttaccgctgcctctgccgctcagcggagaggccgcattgggagaaaccagaataaggagggagatcagtacatctatatgggccaacccctgaacaatgacgaagatcacgcccattggacagaggcgaaaatgcttctggacaacatcaatacccctgaggggattatccccgctctctttgaacctgagcgggaaaagagcgccgccattgatggagagtaccgcctgagaggcgaagctcggaaaacattcgtggagctgatgcgcagaggggacctcccggtctggctttcctataaggtggccagcgagggctttcagtactctgatcggagatggtgcttcgacggagaacgcaacaatcaggtcctggaggaaaacatggacgtggagatctggaccaaggaaggcgagcggaaaaagctgagaccccgctggctcgatgcgcggacgtattccgaccctctggcccttagagagtttaaagagttcgctgccgggcggcgcagcgtttccggagatctgattctcgagatcggcaagctgccccagcacctgacactcagagctcaaaatgcccttgacaacctggtgatgctgcacaattctgaacaagggggaaaggcttaccggcatgccatggaggaactccctgataccatcgagaccctgatgcttctggcgctcattgccgtgctgacaggcggcgtcaccctgtttttcctcagcgggaagggacttggcaaaacatccatcgggctgctgtgtgttatggcttctagcgtgctcctgtggatggcctccgtggagccccactggattgctgccagcatcattcttgaatttttcctgatggtcctcctgatcccggagcctgaccgccagagaacgccccaggataaccaactggcctatgtggttatcggactcctttttatgattctgaccgtggctgcgaacgaaatgggcctgctcgagacaaccaagaaggacctggggatcggacatgtcgtggccgagaatcaccaccatgctacaatgcttgatattgacctgcaccctgcctctgcctggaccctctacgctgtcgccacgaccatcattacacccatgatgcggcataccatcgaaaacacaaccgcgaatatttccctgacggccatcgctaaccaggccgctatcctgatgggcctcgataaaggctggcctattagcaagatggacatcggggtgccccttctggccctgggatgctactctcaggttaatccgctcacactgaccgcggccgtgcttatgctggtcgctcactatgccattatcggccctgggctccaagctaaagccacacgcgaggctcagaagagaaccgccgcgggaattatgaaaaaccccaccgtggatggcatcgttgccatcgacctggaccccgtggtctacgatgctaagttcgaaaagcagctggggcagattatgctccttatcctgtgtacatcccaaattctgctcatgcggacgacctgggccctgtgcgagagcatcacacttgctaccggacctctgacaaccctctgggaaggctctccgggcaaattttggaatacgacaattgccgtgagcatggccaacatcttccgcgggtcctatctggcgggagctggcctggccttctctctcatgaagtcccttgggggaggcagacgggggaccggagctcagggcgagaccctgggcgagaaatggaagagacagctgaatcagctctccaaaagcgaatttaacacatacaagcgctccgggatcatggaggtggaccggtctgaagccaaggagggactgaaaagaggcgaaaccacaaagcatgccgttagccgcgggacggctaaacttcggtggttcgtcgagagaaatctggtgaagcccgagggaaaagtgattgatctcggctgtgggcgcggaggctggtcctattactgcgccggcctgaagaaggtcaccgaagttaaagggtatacaaagggaggccctgggcacgaggaacccatccctatggcgacctacggatggaacattgtgaaactgcactctggccgggacgtgtttttcacaccccctgagaagtgtgataccctcctttgcgacatcggggaaagctccccgaatcccacgattgaggagggaagaaccctgcgcgtcctgaaaatggtggaaccttggctccggggcaaccaattttgtatcaagattctgaatccctacatgccttctgttgtggagacacttgaacagatgcagagaaaacatggcgggatgctggtccgcaaccccctcagcagaaattccacccacgagatgtattgggtgagctgcggaacaggcaacatcgtttctgccgtgaacatgacctccagaatgctgctgaatcgcttcacaatggctcatagaaagccgacctacgagcgggatgtcgacctcggggccggaacgcgccacgtggctgtggaacctgagatcgccaacctggatattatcggccagagaattgaaaatatcaagaacgagcacaaaagcacatggcattatgacgaagataatccctacaagacctgggcgtatcacgggtcttacgaggtcaaaccctccggaagcgcctcttccatggttaacggcgtggtgcggcttctgaccaagccttgggacgtcattcccatggtgacacaaatcgctatgacggacaccacaccttttggccagcagagagttttcaaagagaaggtggatacccggacaccgcgccccaagagagggaccgcccaaatcatggaagtcacagctaaatggctctggggatttctgagccggaataagaaacctcgcatttgtaccagagaggagttcacgcggaaggtgcgctccaacgccgctatcggcgccgtttttgtggacgagaatcagtggaacagcgcgaaagaagccgtcgaggatgagagattctgggaccttgtgcatcgggaacgcgagctgcacaagcaggggaagtgcgctacctgcgtttataatatgatgggaaaaagagaaaagaaactcggcgagtttgggaaggccaaaggctctcgggctatttggtacatgtggctgggagcccgcttcctggagttcgaggccctcggctttatgaacgaggatcattggttcagcagagaaaattccctgtctggggtggagggagaaggccttcacaagctggggtacatcctccgggacattagcaagatccccggaggcaacatgtatgcggatgacacagctgggtgggatacccgcatcacagaggacgatctgcagaatgaggccaaaattaccgacatcatggaacctgagcacgcccttctggctacgtccatttttaagctcacataccaaaacaaagtcgtgagagtccagcggcccgccaagtctggcaccgtgatggatgttatcagcagacgcgaccagcggggatccggccaggtggggacatatggactgaacaccttcacgaatatggaagtccaactgattagacagatggagtctgaaggcatctttagcccgtccgagctcgagaacagcaatctggctgaacgcgtgcttgactggctggagaaacatggggtggaacggctcaagagaatggccatctctggagatgactgtgttgtgaaacctaccgatgaccgcttcgcgacagccctgaccgctcttaacgatatgggcaaggtccggaaggacattccccagtgggagccttccaaagggtggaatgattggcagcaagtgcccttttgcagccaccatttccaccagctgatcatgaaggacggcagagaaattgttgtgccttgtcgcaaccaggatgagctcgtcggacgggccagagtgtctcagggcgctgggtggtccctgcgcgagacagcctgcctgggaaaaagctacgcgcaaatgtggcagctcatgtattttcaccggagagacctgcggcttgccgctaatgccatctgttccgctgtccccgtgaactgggttccgacctctagaacaacctggagcattcatgcccaccatcagtggatgacgacagaagatatgctgtccgtgtggaatcgcgtctggatcgaggaaaacccttggatggaggacaagacccacgtgagctcttgggaagacgttccctacctcggcaaacgggaggatcaatggtgcgggtccctgattggacttaccgctagagccacatgggcgaccaatatccaggtggccatcaaccaggtccgcagactgattggcaatgagaactatctcgactacatgacaagcatgaagcggttcaagaatgaatctgatcccgagggggctctgtggtga

SEQ ID NO: 19486 - RNA, 9879 nt, synthetic construct
  misc_feature 1..9879: note = derived and/or modified CDS sequence (opt5) from DENV-1__KM403579__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatatccagaacaccacattcattatcgacgggcctgatacccccgaatgtcctgacgatcagagagcctggaatatttgggaggtcgaggactatggatttggcgttttcacgacaaacatctggctgaaacttcgcgatagctacacccagatgtgcgaccaccggctcatgtccgctgcgattaaagatagcaaggccgtgcatgctgacatgggctattggatcgaatctgagaaaaatgaaacatggaagctggccagagcctcctttatcgaggtgaagacctgtatttggccccgcagccacacactgtggtctaacggggtcctcgaatccgagatgatcattccgaaaatctacggaggccctattagccaacataattatcggcccgggtacttcacccagacggctggaccttggcacctgggcaaacttgagctggatttcaacctctgcgaagggaccacagtggttgtggacgagcactgcggaaatagaggcccctctctgcggaccacaaccgtcacgggcaaaatcatccatgaatggtgttgccgcagctgtacactgcctccccttagatttagaggggaagatggatgctggtacggcatggagattagaccggtgaaggaaaaagaggaaaacctcgttcgctccatggtgagcgccgggtctggagaggtcgactccttcagcctgggcctgctctgtgtgtccatcatgattgaagaggttatgcggtctagatggagccgcaagatgctgatgaccgggacacttgcggtgtttttcctgctcatcatgggacagctgacctggaatgacctgattagactttgcatcatggtcggcgctaacgtgtccgatcggatgggcatggggaccacatatctggccctcatggccacgtttaagatgcgccctatgttcgctgtgggactgctctttagacggctgacctctcgcgaggtccttctgctcacaattggcctgagcctggttgcctccgtggaacttcccaactctctggaggaactcggggacggactggcgatgggcatcatgatgctcaaactgcttaccgatttccaaagccaccagctgtggacaaccctcctgtccctgacgtttatcaagacaacccttagcctggactacgcttggaaaaccatggccatggtgctctctattgtctccctgttccccctctgtctgagcacaacctctcagaagacaacgtggcttcctgtgctgctggggtcctttggatgcaaaccgctcaccatgttcctgatcacagagaataagatttggggcagaaagagctggccccttaacgaaggcatcatggccgttgggattgtgtctatcctgctctccagcctgctcaaaaatgatgtccctctggctggaccccttatcgccggcgggatgctgattgcttgttatgtgatctccggaagctctgccgacctgagcctcgagcgggcggccgaggtttcctgggaagaggaagctgagcattctggcgccagccacaacattctggtggaagtccaggatgacgggaccatgaagatcaaagatgaggagcgcgacgatacacttaccattctgctcaaggctacgctgctcgccgtgtccggagtctaccctatgtctatccccgccaccctgtttgtgtggtatttctggcagaagaagaaacagagaagcggcgttctttgggacacacctagccctcccgaagtggagcgggctgtcctggatgacggcatctaccgcattctgcagagagggctcctgggacggtctcaggtgggcgttggggtgttccaagacggagtctttcataccatgtggcacgtgacaagaggcgcggtgcttatgtatcaggggaaacgcctggaacccagctgggcctccgttaagaaagatctcatcagctacggaggcggctggcggttccaggggtcttggaataccggagaggaggtccaggtgattgctgtggaacccggcaagaaccctaaaaatgtccaaacaacgcccgggacctttaagacaccggagggagaagtgggcgccatcgccctggacttcaaacctgggacctccggaagccccattgttaacagagagggcaagatcgtgggcctctacgggaatggagtcgtgaccacatctggcacgtatgtttccgctattgcccaggcgaaggctagccaggaagggcctctgcccgagatcgaggatgaagtgtttaaaaagcgcaaccttaccatcatggacctgcaccccggatccggcaaaacacggagatacctgcctgccattgtccgcgaggccatcaagcggaaactcagaaccctgattcttgctccgacacgcgtggttgcctctgaaatggcggaggctctgaaggggatgcccatccggtatcaaaccacggccgtgaagtccgaacatacaggcaaagagattgtcgatctcatgtgccacgccaccttcaccatgagactgctgtcccctgtgcgggtgcccaattacaacatgatcatcatggacgaggctcattttacagatcctgccagcattgctgcccgcggatatatctctaccagagtcggcatgggggaagcggccgctattttcatgacagccacaccccctggatccgttgaggcttttccgcagagcaatgccgtgatccaggacgaagaacgggatattcccgaacgctcttggaacagcggctacgactggatcacggatttccctgggaagacagtgtggtttgtcccctccatcaaatctggaaatgacattgccaactgtctcagaaagaacggcaaacgggtgatccagcttagcagaaagaccttcgacacagagtatcaaaagaccaaaaataacgattgggactacgttgtgacgaccgatatttccgagatgggggctaatttccgcgcggaccgggtcatcgatcctagacgctgcctgaagcccgtgattctgaaagacggcccggaacgggttatcctcgccggacctatgcccgtgacagctgcctctgccgctcagagacgcggccggattgggagaaaccagaataaggagggagatcagtacatctatatgggccaacccctgaacaatgacgaagatcacgcccattggaccgaggcgaaaatgcttctggacaacatcaatacacctgaggggattatccccgctctctttgaacctgagcgcgaaaagagcgccgccattgatggagagtacagactgcggggcgaagctcgcaagaccttcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatctggacaaaggaaggcgagcgcaagaagctgcgcccccggtggctcgatgcgagaacctattccgaccctctggcccttcgcgagtttaaagagttcgctgccgggcggagaagcgtgtccggagatctgattctcgagatcggcaagctgccccagcacctgacgctccgggctcaaaatgcccttgacaacctggtgatgctgcacaattctgaacaagggggaaaggcttaccgccatgccatggaggaactccctgatacaatcgagaccctgatgcttctggcgctcattgccgtcctgaccggcggcgttacactgtttttcctcagcgggaagggacttggcaagacctccatcgggctgctgtgtgtgatggcttctagcgtgctcctgtggatggcctccgtcgagccccactggattgctgccagcatcattcttgaatttttcctgatggtgctcctgatcccggagcctgacagacagcggacaccccaggataaccaactggcctatgttgtgatcggactcctttttatgattctgacggtcgctgcgaacgaaatgggcctgctcgagaccaccaagaaggacctggggatcggacatgtggtcgccgagaatcaccaccatgctaccatgcttgatattgacctgcaccctgcctctgcctggacactctacgctgtggccaccacgatcattacccccatgatgcgccatacaatcgaaaacaccacagcgaatatttccctgaccgccatcgctaaccaggccgctatcctgatgggcctcgataaaggctggcctattagcaagatggacatcggggttccccttctggccctgggatgctactctcaggtgaatccgctcacgctgacagcggccgtccttatgctggtggctcactatgccattatcggccctgggctccaagctaaagccaccagagaggctcagaagcggacagccgcgggaattatgaagaaccccaccgttgatggcatcgtggccatcgacctggaccccgtcgtgtacgatgctaaattcgaaaagcagctggggcagattatgctccttatcctgtgtacctcccaaattctgctcatgcgcacaacgtgggccctgtgcgagagcatcacccttgctacaggacctctgaccacactctgggaaggctctccgggcaaattttggaataccacgattgccgtgagcatggccaacatcttcagagggtcctatctggcgggagctggcctggccttctctctcatgaaaagccttgggggaggccggcgcgggacaggagctcagggcgagaccctgggcgagaaatggaagagacagctgaatcagctctccaagagcgaatttaacacctacaaacggtccgggatcatggaggttgacagatctgaagccaaggagggactgaaacgcggcgaaacaaccaagcatgccgtcagccgggggacagctaaacttagatggttcgtggagcgcaatctggtgaagcccgagggaaaggtcattgatctcggctgtgggcggggaggctggtcctattactgcgccggcctgaaaaaggttacggaagtgaaagggtataccaagggaggccctgggcacgaggaacccatccctatggcgacatacggatggaacattgtgaaactgcactctggcagagacgtctttttcacaccccctgagaagtgtgataccctcctttgcgacatcggggaaagctccccgaatcccaccattgaggagggacgcacgctgcgggtgctgaaaatggttgaaccttggctcagaggcaaccaattttgtatcaagattctgaatccctacatgccttctgtggtcgagacccttgaacagatgcagcgcaagcatggcgggatgctggtgcggaaccccctcagcagaaattccacacacgagatgtattgggttagctgcggaaccggcaacatcgtgtctgccgtcaacatgacatcccgcatgctgctgaatcggttcaccatggctcatagaaaaccgacatacgagcgcgatgtggacctcggggccggaaccagacacgtggctgtcgaacctgagatcgccaacctggatattatcggccagcggattgaaaatatcaagaacgagcacaaaagcacgtggcattatgacgaagataatccctacaagacatgggcgtatcacgggtcttacgaggttaaaccctccggaagcgcctcttccatggtgaacggcgtggtccgccttctgaccaagccttgggacgtgattcccatggttacccaaatcgctatgacagacacgaccccttttggccagcagagagtgttcaaggagaaagtcgatacacggaccccgagacccaagcgggggacagcccaaatcatggaagtgaccgctaaatggctctggggatttctgagccgcaataagaaacctagaatttgtacacgggaggagttcacccgcaaggttagatccaacgccgctatcggcgccgtgtttgtcgacgagaatcagtggaacagcgcgaaggaagccgtggaggatgagcggttctgggaccttgttcatcgcgaaagagagctgcacaaacaggggaagtgcgctacgtgcgtgtataatatgatgggaaaacgggaaaagaaactcggcgagtttgggaaggccaagggctctcgcgctatttggtacatgtggctgggagccagattcctggagttcgaggccctcggctttatgaacgaggatcattggttcagccgggaaaattccctgtctggggtcgagggagaaggccttcacaaactggggtacatcctccgcgacattagcaagatccccggaggcaacatgtatgcggatgacaccgctgggtgggatacaagaatcaccgaggacgatctgcagaatgaggccaaaattacagacatcatggaacctgagcacgcccttctggctacctccatttttaagctcacgtaccaaaacaaagtggtccgggtgcagcgccccgccaagtctggcacagttatggatgtgatcagcagacgggaccagagaggatccggccaggtcgggacctatggactgaacacattcaccaatatggaagtgcaactgattcgccagatggagtctgaaggcatctttagcccgtccgagctcgggaacagcaatctggctgagcgggtgcttgactggctggaaaaacatggagttgagagactcaagcgcatggccatctctggcgatgactgtgtggtcaagcctacggatgaccggttcgcgaccgccctgacagctcttaacgatatggggaaagtgagaaaggacattccccagtgggaaccttccaaaggctggaatgattggcagcaagttcccttttgcagccaccatttccaccagctgatcatgaaggacggacgcgagattgtggtcccttgtcggaaccaggatgaactcgtgggcagagcccgcgtctctcagggggctggatggtccctgcgggagaccgcctgcctgggcaaaagctacgcgcaaatgtggcagctcatgtattttcacagacgcgacctgcggcttgccgctaatgccatctgttccgctgtgcccgttaactgggtgccgacatctagaaccacatggagcattcatgcccaccatcagtggatgaccacggaggatatgctgtccgtctggaatcgggtgtggatcgaagagaacccttggatggaagacaagacacacgttagctcttgggaggacgtgccctacctcgggaagagagaagatcaatggtgcggatccctgattggccttaccgctcgcgccacctgggcgacaaatatccaggtcgccatcaaccaggtgcggaaactgattgggaatgagaactatctcgactacatgaccagcatgaagagattcaaaaatgagtctgatcccgaaggcgctctgtggtga

SEQ ID NO: 19487 - RNA, 9879 nt, synthetic construct
  misc_feature 1..9879: note = derived and/or modified CDS sequence (opt5) from DENV-1__HM469968__SS-prME
  source 1..9879: mol_type = other RNA
agcgtgaccatgctgctcatgctgatgcccaccgctcttgctttccacctgacgacccggggaggggaacctcatatgatcgtgtccaagcaggaacggggaaaatctctcctgtttaagaccagcgctggcgttaacatgtgcacccttatcgcgatggacctgggggaactctgtgaagatacaatgacctacaaatgccccagaatcacagaagctgaacccgacgatgtggactgttggtgcaatgccaccgatacgtgggtgacctatggaacatgttcccaaaccggcgagcaccggcgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgccctgcttacctggctgggactcaattctagatccacaagcctgtctatgacctgtatcgctgtgggcctggttacactttacctcggggtgatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacgcgcctcgaaaacatcatgtggaaacagatttccaacgagctgaatcatatccttctggaaaacgacatgaagttcacagtggttgtgggagatgtcgccggcattctcgcccaggggaaaaagatgatccggccgcaacccatggagtacaaatattcttggaaaagctggggaaaggctaagattatcggcgcggacgtgcagaataccacctttatcattgatgggcctaacacacccgaatgtcctgacgatcagagagcctggaatatctgggaggtggaggactacggattcggcatttttaccacgaacatctggctgaagctgcgcgattcctatacacaggtctgcgaccaccggcttatgagcgctgccattaaagattctaaggccgttcacgctgacatgggctactggatcgaatccgagaaaaatgaaacctggaagctcgccagagcgagcttcatcgaggtgaagacatgtatttggcccaaatctcataccctgtggtccaacggggtgctggaaagcgagatgatcattccgaagatctatggaggccctatttctcaacacaattaccgccccgggtacttcacacagaccgctggaccttggcatctcggcaaactggagcttgattttgacctgtgcgaagggacgaccgtcgtggttgatgagcactgcggaaaccggggccccagcctcagaacaaccacagtgaccggcaagatcatccacgaatggtgttgccggtcctgtacgctgcctcccctgcgcttcagaggggaggacggatgctggtatggcatggagattcggccggtcaaagaaaaggaggaaaatcttgtcaagagcatggtttctgccgggtccggagaggtggacagcttttccctcggcctgctgtgtatctctattatgatcgaagaggtcatgagaagccgctggtcccggaaaatgctcatgacagggaccctggccgtgttctttcttctgattatgggacagctcacatggaacgatctgatcagactgtgcattatggttggcgctaatgcctctgaccgcatgggcatggggaccacctaccttgcgctgatggctacattcaagatgagacctatgtttgccgtgggactcctgttccggcgcctcacgagcagagaggtcctgcttctgaccatcggcctctccctggtggcctctgtggaactgcccaacagccttgaggaactgggggatggactcgctatgggcatcatgattctgaaactcctgacagactttcaatcccatcagctttgggccaccctgctcagcctgacattcatcaagaccacgttttctctgcactatgcttggaaaacaatggccatggtcctttccattgttagcctgttccccctctgtctgtctaccacctcccagaagacaacctggctccctgtgctgcttgggagcctgggatgcaagccgctgacaatgtttctcatcgcggagaataaaatttggggccggaagtcttggcccctgaacgaaggcatcatggccgtggggatcgtctccattcttctgagctccctcctgaaaaacgatgtgcctctcgctggacccctgatcgccggcgggatgcttattgcttgttacgttatcagcggatctagcgccgacctgtccctggagaaggccgctgaggtgtcttgggaagaggaagcggagcatagcggcgcctcccacaatattctcgtcgaagtgcaggatgacgggacgatgaaaatcaaggatgaggagcgcgacgataccctgacaatccttctgaaagctaccctcctggccgtttctggagtgtatcctctcagcattcccgccacactgttcgtctggtacttctggcaaaagaagaaacagagatccggcgtgctttgggacaccccttctcccccggaagtcgagcgggctgtgctggatgacggcatctatcgcattatgcagagagggctgctcggacggagccaggttggcgtgggggtctttcaagaaaacgtgttccatacgatgtggcacgttacccgcggagccgtgctgatgtaccagggcaagagacttgagccttcctgggcgagcgtcaaaaaggacctgatctcttacgggggaggctggcggctccagggctcctggaatacaggggaggaagtccaggtgattgctgttgagcccggcaagaaccctaagaatgtccaaaccgcccccggcacatttaagaccccggaaggggaggtgggagccatcgctctggatttcaaacctggcacaagcgggtctcccattgtgaacagagaaggaaagatcgtcggcctctatggcaatggggtggttacgacctccggaacatacgtgagcgccatcgcgcaggctaaagcctcccaggagggccctctgcccgagattgaagacgaggtctttcgcaagcggaaccttaccatcatggatctgcaccccgggtctggaaaaaccagacgctatctgcctgccattgtgcgggaagctatcaagagaaagctccgcacactgattcttgccccgacgcgggttgtggctagcgagatggccgaagcgctgaaaggcatgcccatcagataccaaaccacagccgtcaagtccgagcataccgggaaagagatcgtggacctcatgtgccacgctacattcaccatgcgcctgctgagccctgttcgggtgcccaattataacatgattatcatggatgaagcccattttacggacccttcttccattgctgccagaggctacatcagcacacgggtcggaatgggcgaggccgctgcgattttcatgaccgccacaccccctgggtctgtggaggcttttccgcagagcaatgccgtgatccaggatgaggaacgcgacatccccgagagatcctggaactctggatatgagtggattacagatttccctggcaagaccgtctggtttgttcccagcatcaaatccgggaatgacattgccaactgtctccggaagaatggaaagcgcgtgatccagctttctagaaaaacattcgataccgaataccaaaagacgaaaaacaacgactgggactacgtggtcacaaccgatattagcgagatgggcgctaatttccgggccgacagagtgatcgatcctcgccggtgcctgaagcccgttattctgaaagacgggccggaaagagtgatcctcgcgggccctatgcccgtcacagtggcttccgccgcccagcgccggggaagaatcggccgcaaccacaataaggagggggatcagtatatttacatgggacagcccctgaacaatgacgaggatcatgctcactggaccgaagccaagatgcttctggacaacatcaatacgcctgagggcattatccccgcgctctttgaacctgagcgggaaaagagcgccgctattgatggggagtatagactgcgcggagaggccagaaagaccttcgttgagctgatgcggcgcggcgacctcccggtgtggctttcttacaaagtcgcttccgaggggtttcaatatagcgatagacggtggtgcttcgacggcgaacgcaacaatcaggtgctggaggaaaacatggatgtcgagatctggacaaaggagggagaacgcaagaagctgcggcccagatggctcgacgcccgcacctactccgaccctctggcccttcgggagtttaaagagttcgccgcgggcagacgctctgtgagcggggatctgatcctcgagattggaaagctgccccagcacctgacacagcgggcccaaaatgctctcgacaaccttgttatgctgcataattccgaacagggcgggagagcctatcggcacgctatggaggagctgcctgataccatcgaaacactcatgctgcttgccctgattgccgtgctcaccggaggcgtgacgctgtttttcctgtctggccgcgggctcggaaagacaagcatcggccttctgtgtgtcatggcttccagcgttctgctctggatggcgtctgtggagccccattggattgccgcttccatcatcctggaatttttccttatggtgctgctcattccggagcctgacagacagcggacaccccaggataaccaactggcctacgtcgtgatcgggctgctctttatgattcttaccgttgccgctaatgagatgggactgctggaaacaaccaaaaaggacctcggcatcgggcacgtggccgtcgagaaccaccatcacgcggccatgctggatgtggaccttcatcctgctagcgcctggacactgtacgctgtcgccacgaccattatcacacccatgatgcgccacaccattgaaaacacaaccgcgaatatctctctcacggccatcgctaaccaggccgctattctgatgggactggataaaggctggcctatctccaagatggacattggcgtgcccctccttgccctggggtgctatagccaggttaatccgctgaccctcacagctgccgtgctgatgcttgtcgcgcattacgccatcattggacctggcctgcaagctaaagccaccagagaggctcagaagcggacagccgccgggatcatgaagaaccccaccgtggatggaatcgttgcgattgacctcgatcccgtggtctatgacgctaaattcgaaaagcagctgggccagatcatgctgctcattctttgtacgtctcaaatcctgctgatgcgcacaacctgggccctctgcgagagcattacactggctaccgggcctcttaccacactgtgggagggatccccgggcaaattttggaatacgaccatcgccgtgtctatggccaacatcttcagaggcagctacctcgctggggccggactggcgttctccctgatgaaaagcctcggcgggggacggcgcggcacaggggcccagggagaaacccttggcgagaaatggaagagacagctgaatcagctgtccaagtctgaatttaacacatataaacggagcggcattatggaggtggacagatccgaagctaaggaggggctcaaacgcggagagaccacgaagcacgccgtttctcggggcacagctaaactgagatggttcgtcgaacgcaatcttgtgaagcccgaggggaaggtgatcgatctgggatgtggcagagggggatggagctactattgcgccggcctcaaaaaggtcaccgaagttaaaggctacaccaaagggggacctggccacgaggaacccattcctatggcgacatacgggtggaacctggtgaaactgcattccggaaaggacgtgtttttcattccccctgagaaatgtgataccctcctttgcgacattggcgagtctagcccgaatcccacaatcgaagaggggagaacgctgcgcgtcctgaagatggtggaaccttggctccggggaaaccaattttgtattaagatcctgaatccctatatgccttccgttgtggagacccttgagcagatgcagagaaaatacggcggcatgctggtccgcaaccccctcagcagaaattctacacacgaaatgtattgggtgtcctgcgggaccggaaacatcgttagcgccgtgaatatgacatctagaatgctgctgaaccgcttcaccatggctcatcggaagccgacgtacgagagagatgtcgacctcggcgccgggacccgccacgtggctgtggaacctgaggtcgccaacctggatattatcggacagagaattgaaaatatcaaacacgagcataagtccacatggcactatgacgaggataacccctacaaaacctgggcttatcatggcagctacgaagttaagccctctgggtccgccagctccatggtgaatggagtggtcaaacttctgacaaaaccttgggacgtgattcccatggttacccaaatcgcgatgacagataccacgccttttggccagcagcgggtgttcaaggagaaagtcgacacacgcaccccgaaggccaaaagaggcaccgctcaaatcatggaagtgacagcccggtggctctgggggtttctgagcagaaacaagaagccccggatttgtacgcgcgaggagttcaccagaaaagttcggtctaatgctgccatcggagccgtgtttgtcgacgagaaccagtggaatagcgcgaaggaggctgtggaagatgagcgcttctgggaccttgttcacagagaacgggagctgcataaacagggcaagtgcgccacatgcgtgtacaacatgatggggaaacgcgaaaagaagctcggagagtttggcaaagccaaggggtccagagctatttggtatatgtggctgggcgcccggttcctggagttcgaagctctcggatttatgaatgaggatcactggttctctcgcgaaaacagcctgtccggcgtcgagggggagggacttcacaaactgggctacatcctcagagacatttctaagatccctgggggaaatatgtatgccgatgacaccgcgggctgggatacacggatcaccgaagacgatctgcagaacgaggccaaaattacagacatcatggaacccgagcatgcccttctggccaaggctatttttaaactcacctaccaaaataaggtggtccgcgtgcagagacctgccaagaacgggacggttatggatgtgatcagccggcgcgaccagagaggctccggacaggtcggcacctatgggctgaatacattcaccaacatggaagcgcaactgattcggcagatggagtctgagggaatctttctccccagcgaactggagacaccgaaccttgccgaaagagtgctggattggctcgagaaatacggcgtggaacgcctgaagcggatggctatctccggggacgactgtgttgtgaaacctattgatgacagattcgccaccgctcttacggccctgaatgatatgggaaaggtccgcaaagacatcccccagtgggagcctagcaagggctggaacgattggcagcaagtgcccttttgctctcaccatttccaccagctcattatgaaggacgggcgggagatcgttgtgccttgtagaaatcaggatgaactggtcggccgcgctcgggtgtcccagggagccggctggagcctgagagagacagcgtgcctcgggaaatcttatgcccaaatgtggcagctgatgtactttcaccgccgggaccttagactggctgccaacgccatttgttccgctgtccccgtggattgggttccgaccagccgcacaacctggtccatccatgcccaccatcagtggatgacgaccgaagacatgctctctgtgtggaatcgggtctggattgaggaaaacccttggatggaggataagacacacatcagctcctgggaggacgtgccctacctgggaaaaagagaagaccaatggtgcggcagccttatcgggctgaccgcgcgggctacatgggccaccaatattcaggttgccatcaaccaggtgagacgcctcattggaaatgagaactatctggattacatgacatctatgaagcggttcaaaaatgaatccgaccccgagggcgctctgtggtga

SEQ ID NO: 19488 - RNA, 9879 nt, synthetic construct
  misc_feature 1..9879: note = derived and/or modified CDS sequence (opt5) from DENV-1__KC172834__SS-prME
  source 1..9879: mol_type = other RNA
agcgtgaccatgctgctcatgctgatgcccacagcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccgagaatcacagaggctgaacccgacgatgtggactgttggtgcaatgccaccgatacgtgggtgacctatggaacatgttcccaggccggcgagcacagacgggacaagcgctctgtcgctctggcccctcatgtggggctgggactcgagaccagaacagaaacctggatgagctccgagggcgcttggaaacagattcagcgggttgaaacgtgggccctgcgccaccccggcttcacagtgatcgcgctttttctggcccatgctattgggacctctatcacacagaagggaatcattttcatcctcctgatgcttgtcacccctagcatggccatgagatgcgtgggcattgggtcccgggattttgttgagggactgagcggcgctacctgggtggacgtcgtgctcgagcacgggtcttgtgtgacaacgatggccaaggataaacccaccctggacatcgaactgctcaagacagaggtcaccaaccctgcggttctgcgcaaactttgcattgaagccaagatctccaatacaaccacggatagcagatgtccgacacaaggagaggctaccctggtggaagaacaggacgccaacttcgtgtgccggcgcacctttgtcgatagaggctggggcaatgggtgtggactcttcggcaaagggtctctgcttacatgcgctaagtttaagtgcgtgaccaaactggagggaaagattgttcagtacgaaaacctcaaatattccgtgatcgtcacagtgcacacgggcgaccagcatcaagttgggaatgagagcaccgaacacggaacaaccgccacaatcacaccccaggcccctacgaccgagattcagctgacagactacggcgctctgaccctcgattgttctccccggacaggcctggacttcaacgaaatggtgcttctgaccatgaaggagaaatcctggctcgtccataagcagtggtttctggatcttcctctgccctggacgagcggggcgtccacatctcaagagacctggaatcgccaggacctcctggtgacattcaaaaccgcccacgctaagaagcaggaagtcgtggttctgggaagccaagagggcgccatgcacaccgccctcacaggggctacggaaatccagacctccggaacaaccacaatttttgccggccatctgaaatgcagacttaagatggataaactgaccctcaaggggatgagctatgtgatgtgtacgggctctttcaaactggagaaggaagtcgcggagacacagcacggaaccgtgctggttcagatcaagtacgagggcaccgacgctccgtgcaaaattcctttctccacacaagatgaaaagggggtgacccagaacggacggcttatcacagccaatcccatcgtcacggacaaagagaagcctgtgaacattgaagccgagccgccctttggcgagagctatatcgtgattggggctggagaaaaagccctcaagctgtcttggttcaagaaaggcagctccatcgggaagatgtttgaggctaccgccagaggcgcgcgccggatggccattctgggagatacagcttgggacttcggctctatcgggggagtttttaccagcgtcggcaaactcgtgcatcagatcttcgggacagcctacggagtgctgttttccggcgtcagctggaccatgaagattgggatcggcgtgcttctgacgtggctcggactcaattctagatccaccagcctgtctatgacatgtattgctgttggccttgtgaccctctacctgggggtcatggtgcaggccgattccggatgcgttatcaactggaaaggccgcgaactgaagtgtgggagcggaattttcgtgacaaatgaggtccacacctggacagaacaatataagtttcaggcggactcccctaaacggctctctgccgctatcggcaaggcctgggaggagggggtgtgcggcattagaagcgctacccgcctggaaaacatcatgtggaaacagatctccaacgagcttaatcatattctgctcgaaaacgacatgaagttcacggttgtggtcggagatgtggccggcatcctggcccaggggaaaaagatgattcggccgcaacccatggagtacaaatattcttggaaaagctggggaaaggctaagatcattggcgcggacgtgcaaaattccacatttatcatcgatgggcctaacacccccgaatgtcctgacgatcagagagcctggaatatttgggaggtcgaggactacggattcggcatctttaccacaaacatttggctgaaacttcgcgatagctatacccaggtttgcgaccaccggctcatgtctgctgccatcaaagattccaaggccgtgcacgctgacatgggctactggattgaaagcgagaaaaatgaaacgtggaagctggccagagcgtctttcatcgaggtgaagacatgtatctggcccaaatcccataccctgtggagcaacggggtcctcgaatctgagatgattatcccgaagatttatggaggccctatcagccaacacaattaccgccccgggtacttcacacagaccgctggaccttggcatctgggcaaacttgagctggattttgacctctgcgaagggacaaccgtggttgtggatgagcactgcggaaaccggggcccctccctgagaacgaccacagtcaccggcaagattatccacgaatggtgttgccggagctgtacactgcctccccttcgcttcagaggggaggacggatgctggtatggcatggagatccggccggtgaaagaaaaggaggaaaatctcgttaagtctatggtgtccgccgggagcggagaggtcgactccttttctctgggcctgctctgtattagcatcatgattgaagaggtgatgagatcccgctggtctcggaaaatgctgatgaccgggacgcttgccgttttctttctgctcatcatgggacagctgacatggaacgatctgattagactttgcatcatggtgggcgctaatgccagcgaccgcatgggcatggggaccacatacctggcgctcatggctaccttcaagatgagacctatgtttgccgtcggactgctgttccggcgcctgacctccagagaggtgcttctgctcacaattggcctgtctctggtggccagcgtcgaacttcccaactccctggaggaactcggggatggactggctatgggcatcatgatcctcaaactgcttacggactttcaaagccatcagctgtgggccaccctcctgtctctgacattcattaagaccacattttcccttcactatgcttggaaaaccatggccatggttctgagcatcgtgtctctcttccccctgtgtctctccacgacaagccagaagaccacctggctgcctgtgcttctggggtctctgggatgcaagccgctcacaatgtttctgattgcggagaataaaatctggggccggaagtcctggccccttaacgaaggcattatggccgtcgggatcgtgagcatcctgctctccagcctgctcaaaaacgatgttcctctggctggaccccttattgccggcgggatgctgatcgcttgttacgtgatttctggaagctccgccgacctgtctctcgagaaggccgctgaggtcagctgggaagaggaagcggagcattccggcgcctctcacaatatcctggtggaagttcaggatgacgggaccatgaaaattaaggatgaggagcgcgacgatacacttacgatcctgctcaaagctaccctgctcgccgtgagcggagtctatcctctgtccatccccgccacacttttcgtgtggtacttctggcaaaagaagaaacagagatctggcgtcctgtgggacacccctagccctcccgaagtggagcgggctgttctggatgacggcatttatcgcatcatgcagagagggctcctgggacggtcccaggtgggcgtcggggtgtttcaagaaaacgttttccatacaatgtggcacgtgacccgcggagccgtccttatgtaccagggcaagagactggagcccagctgggcgtctgtgaaaaaggacctcatttcctacgggggaggctggcggtttcagggcagctggaatacgggggaggaagtgcaggttatcgctgtcgagcccggcaagaatcctaagaatgtgcaaaccgcccccggcacattcaagaccccggaaggggaggtgggagccattgctctggattttaaacctggcacatctgggtcccccatcgtcaacagagaaggaaagattgtgggcctctatggcaatggggttgtgaccacaagcggaacgtacgtctccgccatcgcgcaggctaaagcctctcaggagggccctctgcccgagatcgaagacgaggtgttccgcaagcggaaccttaccattatggatctgcaccccgggagcggaaaaacaagacgctatctgcctgccatcgttcgggaagctattaagagaaagctccgcaccctgatccttgccccgacccgggtggtcgcttccgagatggccgaagcgctgaaaggcatgcccattagataccaaacaacggccgtcaagagcgagcataccgggaaagagatcgttgacctcatgtgccacgctacatttaccatgcgcctgctgtctcctgtgcgggtccccaattataacatgatcattatggatgaagcccatttcacagacccttccagcatcgctgccagaggctacatttctacccgggtgggaatgggcgaggccgctgcgatctttatgacggccacaccccctgggagcatggaggctttcccgcagtccaatgccgtgattcaggatgaggaacgcgacatccccgagagatcttggaacctcggacacgagtggatcaccgattttcctggcaagaccgtctggttcgttcccagcattaaagccgggaatgacatcgctaactgtcttcggaagaatggaaagcgcgtgattcagctgtccagaaaaacattcgataccgaatatcaaaagaccaagaacaacgactgggactacgtggtcaccacggatatctctgagatgggcgccaattttcgggcggacagagtgattgatcctcgccggtgcctgaagcccgttatcctcaaagacgggccggaaagagtgattctggctggccctatgcccgtcacagtggccagcgccgctcagcgccggggaagaatcggccgcaaccataataaggagggggatcagtacatctatatgggacagccccttaacaatgacgaggatcacgcccactggaccgaagcgaagatgctgctcgacaacattaatacacctgagggcatcattcccgccctgttcgaacctgagcgggaaaaatccgctgccatcgatggggagtacagactgcgcggagaggctagaaagacctttgttgaactcatgcggcgcggcgaccttccggtgtggctgagctataaagtcgcctctgaggggttccaatactccgatagacggtggtgctttgacggcgaacgcaacaatcaggtgctggaggaaaacatggatgtcgagatttggacgaaggagggagaacgcaaaaagctccggcccagatggctggacgctcgcacctatagcgaccctcttgccctgcgggagttcaaagaatttgcggccggcagacgctccgtgtctggggatctcatcctggagatcggaaagctgccccagcatctcacacagcgggctcaaaatgcccttgacaacctggttattctgcacaatagcgaacagggcgggagagcttaccggcatgccatggaggagctccctgataccatcgaaacactgatgcttctggccctcattgctgtgctgaccggaggcgtgacactgttctttctctccggcaaggggcttggaaaaacctctatcggcctgctgtgtgtcatggcgagctccgttctcctgtggatggccagcgtggagccccactggattgctgcctctatcatccttgagttctttctgatggtgctcctgattccggagcctgaccgccagagaacgccccaggataaccaactggcctatgtcgtgatcgggctccttttcatgattctgacagttgctgccaatgagatgggactgctcgaaaccaccaagaaagacctgggcatcgggcacgtggcggtcgagaaccatcaccatgccgctatgcttgatgtggacctgcaccctgcctccgcttggacactctacgccgtcgcgaccacaattatcacgcccatgatgcggcataccattgaaaacacaaccgccaatatcagcctgacagctatcgccaaccaggctgccattctgatgggactcgataagggctggcctatctctaaaatggacattggcgtgccccttctggctctggggtgctactcccaggttaatccgctcaccctgacggccgcggtgcttatgctggtcgcccactatgctatcattggacctggcctccaagccaaggctacccgcgaggcccagaagagaacagccgcggggatcatgaaaaaccccaccatcgatggaattgtggctatcgacctggatcccgttgtgtacgacgccaagtttgaaaaacagctgggccagattatgctccttatcctgtgtacaagccaaattctgctcatgcggaccacgtgggctctgtgcgagtctatcacacttgccaccgggcctctgacaaccctctgggagggaagcccgggcaagttctggaataccacaatcgccgtctccatggctaacattttccgcggctcttatctggccggggcgggactggcctttagcctcatgaaatcccttggcgggggaagacggggcacgggggctcagggagaaaccctgggcgagaagtggaagcgccagctgaatcagctcagcaaatccgagttcaacacatacaagagatctggcatcatggaagtggaccggagcgaagccaaagaggggctgaagagaggagagaccacaaaacacgctgtgtcccgcggcaccgccaaacttcggtggtttgttgaaagaaatctggtcaagcccgaggggaaagtgattgatctcggatgtggccgcgggggatggtcttattactgcgcgggcctgaagaaagtgacggaagtcaagggctatacaaaagggggacctggccatgaggaacccatccctatggccacctacgggtggaacctggttaagctccacagcggaaaagacgtgttctttgtgccccctgagaagtgtgatacccttctgtgcgacattggcgagtcctctccgaatcccacaatcgaagaggggcggaccctgagagtcctcaagatggtggaaccttggctgcgcggaaaccaattctgtattaaaatccttaatccctacatgcctagcgttgtggagacactggagcagatgcagcggaagcatggcggcatgctcgtcagaaaccccctgtcccgcaatagcacgcacgaaatgtattgggtgtcttgcgggaccggaaacatcgtttccgctgtgaatatgacaagccggatgctgctcaacagatttaccatggcccaccgcaaaccgacatacgagcgggatgtcgacctgggcgctgggaccagacatgtggccgtggaacctgaggtcgctaaccttgatattatcggacagcgcattgaaaatatcaagcacgagcataaatctacgtggcactatgacgaggataacccctacaagacctgggcctatcatggctcctacgaagttaagcccagcgggtctgcgtccagcatggtgaatggagtggtcaaactgctcacaaagccttgggacgtgattcccatggttacccaaatcgccatgacagataccacacctttcggccagcagagagtgtttaaagagaaggtcgacacccggacgccgaaagctaagcgcggcacagcccaaatcatggaagtgaccgctagatggctgtgggggttcctttcccggaacaagaaacccagaatttgtacccgggaggaatttacacgcaaggttagaagcaatgccgccatcggagcggtgttcgtcgacgagaaccagtggaactctgctaaagaggccgtggaagatgaccggttttgggatctggttcaccgcgagagagaactccacaagcagggcaaatgcgccacgtgcgtgtataacatgatggggaagcgggagaagaaactgggagagttcggcaaggctaaagggagccgcgccatttggtacatgtggctgggcgctagattcctcgagtttgaggccctgggattcatgaatgaagaccattggttttcccgggagaactctcttagcggcgtcgaaggggagggactgcacaagctcggctacatcctgcgcgatatttccaaaatccctgggggaaatatgtatgcggacgataccgccggctgggacacaagaatcaccgaggatgaccttcagaacgaagctaagattacagatatcatggagcccgaacatgccctgctcgctaaatctattttcaagctgacctaccaaaataaggtggtccgggtgcagcgccctgccaaaaacgggacagttatggacgtgatcagcagacgggatcagcgcggctccggacaggtcggcacctatgggctgaatacgtttaccaacatggaggcgcaactcattagacagatggaatctgagggaatcttcagccccaacgagctggaaacaccgaatcttgccgagcgggtgctggactggctcgaaaagtacggcgtggagagactgaaacgcatggctatctccggggacgattgtgttgtgaagcctattgacgatcggtttgccaccgctcttacagccctgaacgacatgggaaaagtcagaaaggatatcccccagtgggaacctagcaagggctggaatgactggcagcaagtgcccttctgctctcaccactttcatcagctcattatgaaagatgggcgcgagatcgttgtgccttgtcggaaccaggacgagctggtcggcagagctcgcgtgtcccagggagccggctgggggctgcgggaaaccgcgtgcctcggaaagagctatgcccaaatgtggcagctgatgtacttccacagacgcgatcttcggctggctgccaatgccatttgttctgctgtccccgtggactgggttccgacgtccagaacaacctggagcatccatgcccaccatcagtggatgacaaccgaggatatgctctccgtgtggaaccgcgtctggattgaagagaatccttggatggaagacaaaacgcggatctctagctgggaggacgtgccctatctgggcaagagagaggatcaatggtgcgggtcccttatcggactgaccgcgcgggctacatgggccaccaacattcaggttgccatcaatcaggtgagacgcctcattggcaacgaaaattacagcgactacatgacatctatgaaacggtttaagaacgagtccgaacccgagggggctctgtggtga

SEQ ID NO: 19489 - RNA, 9879 nt, synthetic construct
  misc_feature 1..9879: note = derived and/or modified CDS sequence (opt5) from DENV-1__KJ933413__SS-prME
  source 1..9879: mol_type = other RNA
agcgtgaccatgctgctcatgctgcttcccacagctctggctttccacctcacgacccggggcggggaacctcatatgatcgtctccaagcaagaacggggaaaatctctgctttttaagaccagcaccggcgttaatatgtgcacactgattgccatggacctcggggagctgtgtgaagataccatgacatacaaatgcccccgcatcaccgagacggaacccgacgatgtggactgttggtgcaatgcgaccgagacatgggtgacctatggaacatgttcccaaaccggcgagcacagacgggataagcgctctgtcgctctggcccctcatgtggggctcggactggaaacgagaacagagacctggatgagctccgaaggcgcctggcggcagattcagaaagttgagacatgggcccttcgccaccccggcttcaccgtgatcgccctgtttctcgctcatgccattgggacctctatcacacagaagggaatcattttcatcctgcttatgctggtcacgcctagcatggcgatgagatgcgtgggcattgggaaccgggactttgttgagggactctccggcgccacctgggtggatgtcgtgctggaacacgggagctgtgtgacaaccatggctaaggacaaacccacactggatatcgagctcctgaagaccgaagtcacgaatcctgccgttcttcgcaaactgtgcattgaggctaagatctctaacacaaccaccgactccagatgtccgacacaaggagaagccaccctcgtggaggagcaggatacaaatttcgtgtgccggcgcacgctggtcgacagaggctggggcaacgggtgtggactttttggcaaagggagcctgattacctgcgcgaagttcaagtgcgtgacaaaactcgaaggaaagatcgttcagtacgagaatctgaaatattctgtgatcgtcaccgtgcacacaggcgatcagcatcaagttgggaacgaaaccacggagcacggaaccacagccaccattacaccccaggctcctacctccgaaatccagctgacggactacggcgccctcacactggactgtagcccccggaccggccttgattttaatgagatggtgctgctcacaatgaaggagaaatcttggctggtccataagcagtggttccttgacctgcctctcccctggacctccggggctagcacctcccaagaaacatggaaccgccaggatctgctggtgacgtttaaaaccgcccacgccaagaagcaggaggtcgtggttctcggatctcaagaaggcgctatgcacacagcgctgaccggggccacagagattcagaccagcggaacgacaaccatcttcgctggccatcttaaatgcagactgaagatggacaaactcaccctgaagggggtgtcctatgtcatgtgtacaggcagctttaaactggaaaaggaggtggccgagacccagcacggaacagttcttgtgcaggtcaagtacgaaggcacggatgccccgtgcaaaattcctttcacctctcaagacgagaagggggtgacacagaatggacggctcatcaccgctaaccccatcgtgacagataaagaaaagcctgttaatattgaggccgagccgcccttcggcgaatcctatctggtcgtgggggcgggagagaaagctctgaagctcagctggtttaagaaaggctctagcatcgggaagatgttcgaagccaccgccagaggcgctcgccggatggccattctgggagacacggcttgggattttggctccatcgggggagtgttcacctctgtcggcaaacttattcatcagatctttgggacagcctacggagtgctgttcagcggcgtttcctggaccatgaagatcgggattggcatcctcctgacatggctgggacttaacagcagatctacctccctcagcatgacatgtattgcggtgggcatggtcaccctgtacctgggggtgatggttcaggccgactctggatgcgtgatcaattggaaaggccgcgagctcaagtgtgggtccggaatttttgtcacgaacgaagtgcacacatggaccgagcaatataagttccaggctgatagccctaaacggctgtccgccgctatcggcaaggcctgggaggaaggggtttgcggcattagatctgtgacccgccttgagaacatcatgtggaaacagatcagcaatgaactgaaccatattctcctggagaatgacatgaagtttacagtcgtggtgggagacgtcaacggcatcctggcgcaggggaaaaagatgattcggccgcaacccatggaacacaaatactcctggaagtcttggggaaaggccaaagttatcggcgctgatgtgcagaatagcaccttcattatcgacgggcctaacacgcccgagtgtcctgatgaccagagagcctggaatatctgggaggtggaagattatggatttggcattttcacaaccaacatctggcttaagctccgcgactcctacacacaggtctgcgatcaccggctgatgagcgctgccattaaagactctaaggccgtgcatgctgatatgggctattggatcgagtccgagaaaaatgagacctggaagctgacaagagcgagctttattgaagttaagacctgtgtgtggcccaaatctcacacgctctggtccaacggggtcctggagagcgagatgatcatcccgaagatttacggaggccctatctctcaacataattatcgccccgggtacttcacccagacagccggaccttggcaccttggcaaactggaactcgacttcgggctgtgcgagggaaccacagtggttgtggatgaacactgcggcaaccggggccccagcctgagaaccacgacagtcaccgggaagattatccatgagtggtgttgccggtcctgtacacttcctcccctccgctttaaaggagaggacggctgctggtacgggatggaaattagaccggtgaaggagaaggaagagaatctggttaaaagcatggtgtctgctggatccggcgaagtcgatagcttctccctggggctcctgtgtatctctatcatgattgaggaggtgatgcggagcagatggtcccgcaagatgcttatgaccggaaccctggccgtgtttctcctgctgatcatgggccagcttacatggaacgacctgattcggctctgcatcatggtcggcgccaatgcttctgacaaaatggggatgggaacgacctatctggccctcatggcgacattcagaatgcgccctatgtttgctgttggcctgcttttcagacggctgaccagccgcgaagtgctcctgctgacagtggggctttccctggtcgcctctgtggagctccccaacagcctggaagaactcggagatggcctggccatggggattatgatgcttaagctgctcaccgactttcaatcccaccagctgtgggctgccctgcttagcctgacgttcgttaaaacaaccttttctctccattacgcgtggaagaccatggctatgatcctgtccattgtgagcctcttccccctgtgtctttctacaacctcccagaagacaacgtggctgcctgtcctgctcggaagcctgggctgcaaaccgcttaccatgtttctgatcacagaaaacagaatctggggccggaagtcttggcccctcaatgaggggattatggccgtgggaatcgtttccattctgctcagctccctgcttaaaaacgatgtgcctctggccggccccctgatcgctgggggaatgctcattgcctgttatgtcatcagcggctctagcgctgacctgtcccttgagaaggccgcggaagtgtcttgggaggaagaggccgaacacagcggggcttcccataatatcctggtcgaggtgcaggatgacggaaccatgaaaattaaggatgaggaacgcgacgatacactcaccatcctgctcaaagccacgctgcttgctatttctggcgtttaccctatgagcatccccgccaccctgttcgtgtggtatttttggcaaaagaagaaacagagatccggcgtcctgtgggacacaccttctcccccggaggtggaacgggccgttctcgatgacgggatttaccgcatcctgcagagaggacttctgggcaagagccaggtgggggtcggagtgttccaagagggcgtgttccacaccatgtggcacgttacaagaggggctgtcctcatgtatcagggaaaacgcctggagccttcctgggcgagcgtgaagaaagatctcatctcttacggcggcgggtggagatttcagggatcctggaacaccggcgaagaggtgcaggtcattgccgtggaacccgggaagaatcctaagaacgttcaaacagctcccggaacgttcaaaaccccggagggcgaagtgggggccatcgccctggactttaagcctggaacaagcggctctcccattgtcaatcgggagggcaaaatcgtggggctttacggaaacggcgttgtgaccacctccgggacatatgtcagcgctattgcccaggcgaaggcttcccaggagggacctctgcccgaaatcgaggacgaagtgttcagaaaacgcaatctgacgattatggatctccatcccggctctgggaagacccggagatacctgcctgccatcgttcgcgaggccatcaagcggaaacttagaacactggtgctcgctccgacccgcgtcgtggccagcgaaatggcggaggctctgaagggcatgcccattcggtatcaaacaaccgccgtgaaatccgagcacacgggaaaggaaatcgtcgacctgatgtgccatgccacatttaccatgagactccttagccctgttcgcgtgcccaactacaatatgattatcatggatgaggctcacttcaccgaccctgcctctattgctgcccggggctatatctccacaagagtggggatgggagaagcggccgctatctttatgaccgccacaccccctggcagcatggaggctttcccgcagtctaacgccgccattcaggatgaagaacgggacatccccgagcgcagctggaactccgggtacgattggattaccgactttcctggaaaaacggtctggttcgtgccctctatcaagagcggcaacgatattgctaattgtctgagaaagaacgggaaacgggttgtgcagctgtcccgcaagacatttgacaccgaatatcagaaaaccaagaacaatgattgggactacgtcgtgaccacggacatctctgagatgggcgcgaacttcagagccgatcgggttatcgaccctagacgctgcctcaaacccgtgattctgaaggatggaccggaacgggtcatccttgctggccctatgcccgtgaccgtcgccagcgccgctcagagacgcgggcggattggaagaaatcagaacaaggagggcgaccagtacatctatatggggcaacccctgaataacgatgaggaccatgcccactggacagaagcgaaaatgctcctggataatattaacacccctgagggaatcattcccgctctgttcgaacctgagcgcgaaaagtccgccgccatcgacggcgagtaccggctcagaggggaggctcgcaaaacatttgtggaacttatgagacggggcgatctgccggtttggctgagctataaggtggcctctgagggattccagtactccgaccgcagatggtgctttgatggcgaacggaataaccaggtgctcgaggaaaatatggacgtcgagatctggaccaaagagggggaacgcaagaaactgagaccccggtggcttgatgcgagaacatatagcgaccctctggccctccgcgagttcaaggaatttgctgccggacggagatccgtttctggcgacctgattctggagatcgggaagctcccccagcaccttacccaacgcgctcagaacgccctggataatctggtgatgctccataacagcgaacagggaggcaaggcttaccggcacgccatggaggagctgcctgacacgattgaaacacttatgctgctcgcgctgatcgccgtgctgaccggcggggtcaccctcttctttctttccggaagaggcctggggaagacatctattggactgctctgtgtgatggctagctccgccctgctttggatggctagcgttgagccccattggatcgccgcctctatcattctggagttctttctcatggtgctgctgatcccggagcctgatcggcagcgcacaccccaagacaatcagctcgcttatgtcgtgattggccttctgttcatgatcctgacagtcgcggccaacgagatggggctcctggaaacgaccaaaaaggatcttggaattggccacgtggctgccgagtcccaccatcacgccgctatgctggacgttgatctccatcctgccagcgcgtggacactgtacgccgtggctaccacagtcatcacccccatgatgagacacacgatcgaaaacaccacagccaatatttctctgaccgctatcgccaaccaggcggccattctcatgggccttgacaaagggtggcctatctccaagatggatattggagtgcccctgctggctctcggctgctacagccaagttaatccgctgacacttaccgccgctgtgctgatgctcgtcgcccattatgctatcattgggcctggactgcaggccaaggcgacgcgggaggcccagaaacgcacagctgccggcatcatgaagaaccccaccgtggacgggatcgtggctattgatctggaccccgttgtctacgatgccaaatttgaaaagcagctcggacaaatcatgcttctgattctgtgtacatctcagatcctcctgatgagaaccacctgggccctttgcgagagcattacactggcgacgggccctctcaccacactgtgggagggctccccggggaaattctggaataccacaatcgctgtgtctatggccaacatctttcggggaagctatctggctggcgccgggctcgccttctcccttatgaaaagcctgggaggcgggcgcagaggaaccggcgctcagggcgaaacgctgggggagaagtggaaacggcagctcaatcaactgtccaagtctgagttcaacacatacaaacgcagcggaattatcgaggtggacagatccgaagccaaggagggccttaaaagaggggaaaccaccaagcacgcggtctctcggggaacagccaagctgcgctggtttgttgaacggaatctcgtgaaacccgagggcaaggtgattgacctggggtgtggaagaggcggctggagctattactgcgctgggctgaaaaaggtcaccgaagtgaaaggatatacaaagggcgggcctggacacgaggaacccatccctatggccacgtacggctggaacctcgttaaacttcattccgggaaggatgtgttctttacaccccctgagaagtgtgacacactgctgtgcgatattggagagtctagcccgaatcccaccatcgaagagggccgcacactccgggtcctgaaaatggtggaaccttggcttagaggcaaccagttctgtatcaaggttctgaatccctacatgccttccgtggtcgagaccctcgagcagatgcagcgcaaacacgggggaatgctggtgcggaaccccctgagcagaaattctacgcatgaaatgtattgggtgtcctgcggcaccgggaacattgtcagcgctgttaatatgacatctcgcatgctcctgaaccggtttaccatggcccacagaaagccgacatacgagcgcgacgtggatcttggagcgggcacccggcacgtggccgtcgaacctgaggtggctaacctggacatcattgggcaaagaatcgaaaatattaaaaacgagcataagtccacatggcactatgatgaggacaatccctacaagacctgggcctatcatggaagctacgaagttaaaccctctggctccgctagctccatggtgaacggcgtcgtgcgcctcctgacgaagccttgggatgttatccccatggtgacacagattgccatgaccgacaccacacctttcgggcagcaaagagtctttaaagagaaggtggatacgcggaccccgaaagctaagcgcggaacagcccagatcatggaagttaccgcgagatggctttggggcttcctgagccggaataagaaacccagaatctgtacacgggaggaatttaccaagaaagtgcgctctaacgccgctattggggccgtcttcgtggacgagaatcagtggaacagcgctaaggaggccgtcgaagacgagagattttgggatctcgtgcaccgggaacgcgagctgcataaacagggaaagtgcgccacatgcgtttataatatgatgggcaagagagagaaaaagctgggggagttcggcaaagcgaagggatcccgggctatctggtacatgtggctcggcgcccgctttctggagttcgaagcccttgggttcatgaacgaggaccactggttttctagagaaaatagcctgtccggagtggagggcgaggggctccacaaactgggatacattcttcgggatatctctaagattcctggcgggaacatgtatgctgacgataccgccggctgggacacgcgcatcaccgaagatgacctgcaaaatgaggctaaaatcacagatattatggaacccgagcatgccctcctggcgaccagcatcttcaagctgacataccagaacaaggtcgtgagagtgcagcggcctgccaaaaatggaaccgttatggacgtgatttcccgcagagatcagcggggctctgggcaagtcggaacgtatggcctcaacacatttaccaacatggaagctcagctgatccgccagatggagagcgaggggattttccttccctccgaactggagacaccgaatctcgccgaaagagtgctggactggcttgagaagtacggaatcgaacggctgaaaagaatggctatcagcggcgatgactgtgttgtgaagcctattgacgatcgctttgccaccgcgctcacggccctgaacgacatggggaaagtccggaaggatatcccccagtgggagccttctaagggctggaatgactggcaacaggtgcccttctgctcccaccattttcaccagctgattatgaaagatggaagagagatcgtcgtgccttgtcgcaaccaggacgaactcgttggccgggctagagtgagccaaggggccggatggtctctgcgcgagaccgcttgccttggcaagtcctatgcccagatgtggcagctgatgtacttccaccggagagatctccgcctggctgccaatgcgatttgtagcgccgtccccgtggactgggttccgacatcccggaccacatggtctatccatgctcaccatcaatggatgaccacagaagatatgcttagcgtgtggaacagagtctggatcgaggaaaatccttggatggaggacaaaacccacgtgtccagctgggaggatgtgccctatctggggaagcgcgaagaccagtggtgcggatctctcattggcctgacggcccgggccacatgggctaccaacatccaggttgccattaatcaggtcagacggctgatcgggaacgagaattacctcgactacatgacctccatgaaaagatttaagaacgaaagcgatcccgagggcgcgctgtggtga

SEQ ID NO: 19490 - RNA, 9879 nt, synthetic construct
  misc_feature 1..9879: note = derived and/or modified CDS sequence (opt5) from DENV-1__KU666942__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggagttaacatgtgcacccttattgcgatggacctgggggaactctgtgaagatacaatgacctacaaatgccccagaatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccattctgcgcaaactttgcatcgaagcgaagatttccaataccacgacagatagcagatgtccgacccaaggagaggccaccctggttgaagaacaggacgctaacttcgtgtgccggcgcacatttgtggatagaggctggggcaatgggtgtggactcttcggcaaagggtctctgatcacatgcgccaagtttaagtgcgtcacaaaacttgagggaaagatcgtgcagtacgaaaacctgaaatattccgttattgtgacggtccacaccggcgaccagcatcaagtggggaatgagagcacagaacacggaaccacagctaccatcacgccccaggcccctaccacagagattcagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaatccagacatccggaaccacaaccatttttgctggccatctcaaatgcagactgaagatggataaacttacgctgaaggggatgagctatgttatgtgtacaggctctttcaaactcgagaaggaagtggccgagacccagcacggaaccgtcctggtgcagatcaagtacgagggcacagacgcgccgtgcaaaatccctttctccacccaagatgaaaagggggttacacagaacggacggctgattacggctaatcccatcgtgaccgacaaagagaagcctgtcaacattgaagccgagccgccctttggcgagagctatatcgtgattggggccggagaaaaagctcttaagctctcttggttcaagaaaggcagctccatcgggaagatgtttgaggccacagctagaggcgcccgccggatggcgatcctgggagataccgcctgggacttcggctctattgggggagtgtttacaagcgttggcaaactggtccatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctacggcgatcggcaaggcctgggaggagggggtctgcggcatcagaagcgctacacgcctcgaaaacattatgtggaaacagatctccaacgagctgaatcatattcttctggaaaacggaatgaagttcaccgtggttgtgggcgacgtcgccgggatcctcgctcagggcaaaaagatgattcggccgcaacccatggagcacaaatactcttggaaaagctggggcaaggccaagatcatcggggccgatgtgcagaataccacatttattatcgacggacctaacacccccgaatgtcctgatgaccagagagcttggaatatttgggaggtggaggattatggcttcggcatctttacgacaaacatttggctgaagctgcgcgactcctacacccaggtctgcgatcaccggcttatgagcgcggccatcaaagactctaaggctgttcatgccgatatggggtattggatcgaatccgagaaaaatgaaacatggaagctcgccagagctagcttcattgaggtgaagacctgtatctggcccaaatctcacacactgtggtccaacggagtgctggaaagcgagatgattatcccgaagatttacggcgggcctatctctcaacataattatcgccccggatacttcacccagacggccggcccttggcacctcgggaaactggagcttgactttgatctgtgcgaaggaaccacagtcgtggttgacgagcactgcggcaaccggggccccagcctcagaaccacaaccgtgacggggaagatcattcatgaatggtgttgccggtcctgtacactgcctcccctgcgctacagaggagaggatggctgctggtatgggatggagatccggccggtcaaagaaaaggaggaaaatcttgtcaagagcatggtttctgcgggatccggcgaggtggacagcttctccctcgggctgctgtgtatttctatcatgattgaagaggtcatgagaagccgctggtcccggaaaatgctcatgaccggaacactggctgtgtttttccttctgatcatgggccagctcacctggaacgacctgattagactgtgcatcatggttggcgccaatgcctctgatcgcatggggatgggaaccacataccttgctctgatggccacgtttaagatgagacctatgttcgcggtgggcctcctgtttcggcgcctcaccagcagagaggtcctgcttctgacaatcgggctctccctggtggcttctatggaactgcccaacagccttgaggaactgggagacggcctcgccatggggattatgatcctgaaactcctgaccgatttccaatcccaccagctttgggccacactgctcagcctgacctttattaagacgacattctctctgcattatgcttggaaaaccatcgccatggtgctttccattgtcagcctgtttcccctctgtctgtctaccacatcccagaagaccacatggctccctgttctgcttggaagcctgggctgcaagccgctgacgatgttcctcatcgctgagaataaaatctggggccggaagtcttggcccctgaacgaagggattatggccgtgggaatcgtgtccattcttctgagctccctcctgaaaaacgacgtccctctcgcgggccccctgatcgccgggggaatgcttattgcttgttacgtgatcagcggctctagcgccgatctgtccctggagaaggctgccgaggtttcttgggaagaggaagccgagcacagcggggcttcccataatatcctcgtggaagtccaggacgatggaaccatgaaaattaaggacgaggagcgcgatgacacactgaccatccttctgaaagcgacactcctggccgtgtctggcgtttatcctctcagcattcccgctaccctgtttgtgtggtacttctggcaaaagaagaaacagagatccggcgtcctttgggatacgccttctcccccggaagtggagcgggccgtcctggacgatgggatctatcgcattatgcagagaggactgctcggccggagccaggtgggggttggagtgttccaagaaaacgtctttcacaccatgtggcacgtgacacgcggcgccgttctgatgtaccaggggaagagacttgagccttcctgggctagcgtgaaaaaggacctgatctcttacggaggcggctggcggctccaggggtcctggaataccggagaggaagtccaggtgattgccgtggagcccggcaaaaaccctaagaatgttcaaacagcgcccgggaccttcaagacaccggaaggagaggtcggcgctatcgccctggactttaaacctgggacgagcggatctcccatcgtgaacagagaaggcaagattgtgggcctctatgggaatggagtcgtgaccacatccggcacctacgttagcgccatcgctcaggccaaagcgtcccaggaggggcctctgcccgagattgaagatgaggtgttccgcaagcggaaccttaccatcatggacctgcatcccggatctggcaaaacaagacgctatctgcctgctattgtccgggaagccatcaagagaaagctccgcacgctgatccttgccccgacccgggtggttgctagcgagatggccgaagctctgaaagggatgcccattagataccaaacaaccgccgtgaagtccgagcacacaggcaaagagatcgtcgatctcatgtgccatgcgacctttacgatgcgcctgctgagccctgtgcgggttcccaattataacatgattatcatggacgaagcccacttcacagatccttcttccattgctgccagaggatacatcagcacccgggtgggcatgggggaggctgccgccatctttatgaccgctacaccccctggatctgtcgaagcgttcccgcagagcaatgccgtgattcaggacgaggaacgcgatatccccgagagatcctggaactctggctatgagtggattaccgactttcctgggaagacagtgtggttcgtccccagcatcaaatccggaaatgatattgctaactgtctccggaagaatggcaagcgcgttatccagctttctagaaaaacctttgacacggaataccaaaagaccaaaaacaacgattgggactacgtggtgaccacagacattagcgagatgggggccaatttccgggccgatagagtcatcgaccctcgccggtgcctgaagcccgtgatcctgaaagatggcccggaaagagttattctcgctggacctatgcccgtgaccgtcgcctccgcggctcagcgccggggcagaatcgggcgcaaccataataaggagggagaccagtatatttacatgggccagcccctgaacaatgatgaggaccacgcccactggacggaagccaagatgcttctggataacatcaatacccctgaggggattatccccgctctcttcgaacctgagcgggagaaaagcgccgcgatcgacggagagtatagactgcgcggcgaggccagaaagacatttgtggaactgatgcggcgcggggatctcccggtttggctttcttacaaagtggcttccgagggcttccaatatagcgacagacggtggtgctttgatggagaacgcaacaatcaggtcctggaggaaaacatggacgtggagatttggaccaaggagggcgaacgcaaaaagctgcggcccagatggctcgatgcccgcacatactccgaccctctggcccttcgggagttcaaagaatttgccgctgggagacgctctgtcagcggagacctgatcctcgagattggcaagctgccccagcatctgacccagcgggcccaaaatgcgctcgataaccttgtgatgctgcacaattccgaacaagggggcagagcttatcggcatgctatggaggagctgcctgacacaatcgaaaccctcatgctgcttgccctgattgctgttctcacgggaggcgtgacactgttctttctgtctgggaagggactcggcaaaaccagcatcgggcttctgtgtgtgatggcctccagcgccctgctctggatggcttctgtcgagccccactggatcgcggcctccattatcctggagttctttcttatggttctgctcattccggagcctgatcgccagagaacaccccaggacaaccaactggcttacgtggtgatcggactcctgttcatgattcttacagtcgccgccaatgagatgggcctgctggaaaccacaaagaaagatctcgggatcggacacgtggctgttgagaaccatcaccatgccgcgatgctggacgtggatcttcaccctgccagcgcttggacgctgtacgccgtcgctaccacaattatcacccccatgatgcggcatacaatcgaaaacaccacggccaatatttctctcaccgcgatcgccaaccaggctgccattctgatgggcctggacaagggctggcctatctccaaaatggatattggggtgcccctccttgctctgggatgctatagccaggtcaatccgctgacactcaccgccgctgtgctgatgcttgttgcccactacgcgatcatcggccctgggctgcaagccaaggctacacgcgaggcccagaagagaaccgctgccggaattatgaaaaaccccacggtggacggcatcgtcgccattgatctcgaccccgtggtttatgatgcgaagtttgaaaaacagctggggcagatcatgctgctcattctttgtacatctcaaatcctgctgatgcggaccacatgggctctctgcgagagcatcaccctggccaccggacctcttacaacgctgtgggagggctccccgggcaagttctggaataccacaattgctgtgtctatggccaacatctttcgcgggagctacctcgccggagctggcctggccttctccctgatgaaaagcctcgggggaggcagacgggggaccggagcgcagggcgaaacacttggcgagaagtggaagcgccagctgaatcagctgtccaaatctgagttcaacacctataagagaagcgggattatggaggtcgaccggtccgaagccaaagagggactcaagagaggcgagacgacaaaacacgctgtgtctcgcgggaccgccaagctgcggtggtttgtggaaagaaatcttgttaagcccgagggaaaagtcatcgacctgggctgtgggcgcggaggctggagctactattgcgctggcctcaagaaagtgaccgaagtgaaggggtacacaaaaggaggccctgggcatgaggaacccgtccctatggccacctacggatggaacctggttaagctgcactccggcaaagatgtgttctttattccccctgagaagtgtgacacactcctttgcgatatcggggagtctagcccgaatcccacgattgaagagggacggaccctgagagtgctgaagatggtcgaaccttggctccgcggcaaccaattctgtatcaaaatcctgaatccctatatgccttccgtggttgagacacttgagcagatgcagcggaagcatggcgggatgctggtgagaaaccccctcagccgcaattctacccacgaaatgtactgggtctcctgcggaacaggcaacattgtgagcgcgatcaatatgacctctcggatgctgctgaacagatttacgatggcccaccgcaaaccgacctatgagcgggacgttgatctcggggctggaacaagacatgtggccgtcgaacctgaggtggctaacctggacattatcggccagcgcattgaaaatatcaagtgtgagcacaaatccacctggcattacgatgaggacaacccctataagacatgggcctaccacgggagctatgaagtgaagccctctggatccgctagctccatggtcaatggcgttgtgaaacttctgaccaagccttgggatgtgatccccatggtcacacaaattgccatgaccgacacgacacctttcggccagcagagagtgtttaaagagaaggttgatacccggaccccgaaagcgaagcgcgggacagcccaaatcatggaagtgacggctagatggctctggggattcctgagccggaacaagaaacccagaatttgcacccgggaggaatttacacgcaaggtcagatctaatgccgctatcggcgccgtgttcgttgacgagaaccagtggaatagcgccaaagaggcggtggaagacgagcggttttgggatcttgtccatcgcgaaagagagctgcacaagcaggggaaatgcgctacctgtgtgtacaacatgatgggaaagcgggaaaagaaactcggcgagttcgggaaggccaaaggctcccgcgccatttggtacatgtggctgggagctagatttctggagttcgaagccctcggcttcatgaatgaggaccactggttttctcgggaaaacagcctgtccggggttgagggagagggccttcataagctggggtatatcctccgcgatatctctaaaattagcggaggcaatatgtacgctgacgatacagccgggtgggacaccagaatcacagaagatgacctgcagaacgaggcgaagattaccgaaatcatggagcctgaacacgcccaacttgctaaagccattttcaagctgacgtatcagaataaggtggtccgggtgcagcgccccgctaaaaacggcaccgtcatggatgtgatctccagacgggaccagcgcggatctggccaagttgggacatacggactcaatacctttacaaacatggaggcccagctgatcagacagatggagagcgaaggcattttctcccctagcgagctggaaacccccaacctcgcggagcgggtgctggattggcttgaaaagtatggggtcgagagactgaaacgcatggccatctctggagacgattgcgtggtgaagccgattgacgaccggtttgctacggccctcacagctctgaatgatatgggcaaagttagaaaggacatccctcagtgggagccctccaaggggtggaacgattggcaacaggtgcctttctgtagccatcactttcaccagcttattatgaaagacggccgcgaaatcgtcgtgccctgccggaatcaggatgagctggttggcagagcccgcgtgtctcaaggcgctgggtggtccctccgggaaaccgcctgtctgggaaagagctacgcgcagatgtggcagctgatgtatttccatagacgcgacctccggctggccgctaacgccatttgctccgccgtccctgtggattgggtccccacatctagaaccacgtggagcatccacgctcatcaccaatggatgaccacagaggacatgctttccgtgtggaatcgcgtttggatcgaagagaacccgtggatgaaagataagacccatattagctcttgggaggacgtgccttacctgggcaaacgggaagatcagtggtgtgggtccctcatcggactgacagccagagcgacctgggctacaaatattcaggtcgccatcaaccaggtgcggagacttattggcaatgagaactacctggactatatgaccagcatgaagcgctttaagaatgaatctgaccccgagggggccctctggtga

SEQ ID NO: 19491 - RNA, 9879 nt, synthetic construct
  misc_feature 1..9879: note = derived and/or modified CDS sequence (opt5) from DENV-1__KU666939__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaagtctctcctgtttaagaccagcgccggcgttaacatgtgcacccttattgccatggacctgggggaactctgtgaagatacgatgacctacaaatgcccgagaatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctgggactcgagacacggaccgaaacgtggatgagctccgagggcgcctggaaacagattcagcgggttgaaacatgggtgctgcgccaccccggcttcaccgtcatcgctctttttctggcccatgcgattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctgtgctgcgcaaactttgcattgaagccaagatctccaataccacgacagatagcagatgtccgacccaaggagaggcgaccctggtggaagaacaggacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctaccacagagatccagctcaccgactacggcgccctgacactggattgtctcccccggaccggcctggacttcaacgaaatggtccttctgacgatgaaggagaaatcttggctcgtgcataagcagtggtttctggatcttcctctgccctggacatccggggccagcacctcccaagagacatggaatcgccaggacctcctggtcaccttcaaaaccgctcacgcgaagaagcaggaagtggttgtgctgggatctcaagagggcgccatgcacacagctctcacgggggccaccgaaattcagacaagcggaaccacaaccatctttgccggccatctgaaatgcagacttaagatggataaactgacgctcaaggggatgtcctatgtcatgtgtacaggcagcttcaaactggagaaggaagtggctgagacccagcacggaaccgttctggtgcagattaagtacgagggcacagacgccccgtgcaaaatccctttctctacccaagatgaaaagggggtcacacagaacggacggcttatcacggcgaatcccattgtgaccgacaaagagaagcctgtgaacatcgaagctgagccgccctttggcgagtcctatattgttatcggggccggagaaaaagccctcaagctgagctggttcaagaaaggctctagcattgggaagatgtttgaggctacagccagaggcgctcgccggatggccatcctgggagataccgcgtgggacttcggctccatcgggggagtctttacatctgtgggcaaactcgtgcatcagattttcgggaccgcctacggagtcctgtttagcggcgtgtcctggacgatgaagatcgggattggcgttcttctgacctggctcggactgaatagcagatctacatccctgagcatgacctgtatcgctgtgggccttgtcacactctacctgggggtgatggttcaggccgattctggatgcgtgattaactggaaaggccgcgaactgaagtgtgggtccggaatcttcgtcaccaatgaggtgcacacatggaccgaacaatataagtttcaggctgacagccctaaacggctctccgccgcgattggcaaggcctgggaggagggggtttgcggcatcagatctgctacgcgcctggaaaacatcatgtggaaacagattagcaacgagcttaatcatatcctgctcgaaaacgacatgaagttcacagtggtcgtgggagatgtggccggcattctggctcaggggaaaaagatgatccggccgcaacccatggagcacaaatactcctggaagtcttggggaaaggccaaaattatcggcgccgacgtccagaataccacctttatcattgatgggcctaacacacccgaatgtcctgacgatcagagagcttggaatatctgggaggttgaggactatggattcggcatttttaccacgaacatctggctgaaacttcgcgatagctacacacaggtgtgcgaccaccggctcatgtccgcggccattaaagatagcaaggctgtgcatgccgacatgggctattggatcgaatctgagaaaaatgaaacctggaagctggccagagcttccttcatcgaggtcaagacatgtatttggcccaaaagccacaccctgtggtctaacggggtgctcgaatccgagatgatcattccgaagatctacggaggccctattagccaacataattatcgccccgggtacttcacacagaccgccggaccttggcacctgggcaaacttgagctggattttgacctctgcgaagggacgaccgttgtggtcgatgagcactgcggaaaccggggcccctctctgagaacaaccacagtgaccggcaagatcatccatgaatggtgttgccggagctgtacgctgcctccccttcgcttcagaggggaggacggatgctggtacggcatggagattcggccggttaaagaaaaggaggaaaatctcgtgaagtccatggtcagcgcggggtctggagaggtggactcctttagcctgggcctgctctgtatctccattatgatcgaagaggttatgagatctcgctggagccggaaaatgctgatgacagggacccttgctgtgttctttctgctcattatgggacagctgacatggaacgatctgatcagactttgcattatggtcggcgccaatgcctccgaccgcatgggcatggggaccacctatctggctctcatggccacattcaagatgagacctatgtttgcggtgggactcctgttccggcgcctgacgtctagagaggtgcttctgctcaccatcggcctgagcctggtcgcttccgttgaacttcccaactctctggaggaactcggggatggactggccatgggcatcatgattctcaaactgcttacagactttcaaagccaccagctgtgggccaccctcctgtccctgacattcatcaagaccacgtttagccttcattacgcttggaaaacaatggccatggtgctgtctattgtgtccctcatccccctgtgtctcagcaccacctctcagaagacaacctggctgcctgtccttctggggtccctgggatgcaagccgctcacaatgttcctgattgctgagaataaaatctggggcagaaagagctggccccttaacgaaggcatcatggccgtggggattgtttctatcctgctctccagcctgctcaaaaacgatgtgcctctggcgggaccccttattgccggcgggatgctgatcgcttgttatgtcatttccggaagctctgccgacctgctcctggagaaggctgccgaggtgagctgggaagaggaagccgagcactccggcgcttctcataatatccttgttgaagtgcaggatgacgggacgatgaaaatcaaggatgaggagcgcgacgataccctgacaattctcctgaaagcgaccctcctggccatcagcggagtctaccctctttccattcccgctacactgtttgtgtggtatttctggcaaaagaagaaacagagatctggcgtcctgtgggacacccctagccctcccgaagtggagcgggccgttctcgatgacggcatctaccgcattatgcagagagggctgcttggacggtcccaggtgggcgtcggggtgttccaagaaaacgtttttcacacgatgtggcacgtgacccgcggagccgtcctgatgtatcagggcaagagactcgagccctcttgggctagcgtgaaaaaggacctgatctcctacgggggaggctggcggctccagggcagctggaatacaggggaggaagtgcaggttattgccgtcgagcccggcaagaaccctaagaatgtgcaaaccgcgcccggcacattcaagaccccggaaggggaggtgggagctatcgccctggattttaaacctggcacatctgggtcccccatcgtcaacagagaaggaaagattgtgggcctttacggcaatggggttgtgacgaccagcggaacatatgtctctgccatcgctcaggccaaagcgtcccaggagggccctctgcccgagattgaagacgaggtgttccgcaagcggaacctgaccatcatggatctccatcccgggagcggaaaaaccagacgctacctgcctgctattgttcgggaagccatcaagagaaaacttcgcacactgatcctcgccccgacgcgggtggtcgcttccgagatggccgaagctctgaaaggcatgcccattagatatcaaaccacagccgtgaagtctgagcacaccgggaaagagatcgttgacctgatgtgccatgcgacatttaccatgcgcctccttagccctgtgcgggtccccaattacaacatgattatcatggatgaagcccacttcacggacccttccagcattgctgccagaggctatatctctacacgggtgggaatgggcgaggctgccgccatctttatgaccgctacaccccctgggtccgtggaagcgttcccgcagagcaatgccgtcattcaggatgaggaacgcgacatccccgagagatcttggaacagcggatacgagtggattacagattttcctggcaagaccgtttggttcgtgccctccatcaaatctgggaatgacattgctaactgtctgcggaagaatggaaagcgcgtgatccagctgagcagaaaaacatttgataccgaatatcaaaagacgaaaaacaacgactgggactacgtcgtgacaaccgatatttccgagatgggcgccaatttccgggccgacagagttatcgatcctcgccggtgcctcaagcccgtgatcctgaaagacgggccggaaagagtcattcttgctggccctatgcccgtgacagttgcctctgcggctcagcgccggggaagaatcggccgcaaccataataaggagggggatcagtacatttatatgggacagcccctgaacaatgacgaggatcacgcccactggaccgaagccaagatgctcctggacaacatcaatacgcctgagggcattatccccgctctgttcgaacctgagcgggaaaagagcgccgcgatcgatggggagtacagactccgcggagaggccagaaagacctttgtggagcttatgcggcgcggcgacctgccggtctggctgtcctataaagtggctagcgaggggttccaatactctgatagacggtggtgctttgacggcgaacgcaacaatcaggtcctcgaggaaaacatggatgtggagatttggacaaaggagggagaacgcaagaagctgcggcccagatggcttgacgcccgcacctattccgaccctctggctctccgggagttcaaagaatttgccgctggcagacgcagcgtttccggggatctgatcctggagattggaaagctcccccagcatcttacacagcgggcccaaaatgcgctggacaacctggtgatgctccacaattctgaacagggcgggagagcctaccggcatgctatggaggagctgcctgataccatcgaaacacttatgctgctcgccctgattgctgtgctgaccggaggcgtcacactcttctttcttagcggccgcgggctgggaaagacatccatcggcctgctctgtgttatggcctctagcgtgctgctttggatggcctccgtggagccccactggatcgctgcgagcattatcctggagttctttctcatggtcctgctgattccggagcctgacagacagcggacaccccaggataaccaactcgcctatgtggttatcgggcttctgttcatgattctgaccgtggctgccaatgagatgggactcctggaaacaaccaaaaaggaccttggcatcgggcacgtcgccgtggagaaccatcaccatgctacaatgctggatgtcgacctccaccctgcctctgcgtggacgctgtacgccgtggctaccacaattatcacccccatgatgcgccatacaatcgaaaacaccacggccaatatttccctgaccgctatcgccaaccaggcggccattctcatgggacttgataaaggctggcctatcagcaagatggacattggcgttcccctgctggctctcgggtgctactctcaggtgaatccgctgacacttaccgccgctgtcctgatgctcgtggcccactatgctatcatcggacctggcctgcaagccaaagcgacaagagaggcccagaagcggaccgctgccgggattatgaagaaccccacggttgatggaatcgtggctattgacctggatcccgtcgtgtacgacgccaaatttgaaaagcagctcggccagatcatgcttctgattctgtgtacatcccaaatcctcctgatgcgcaccacatgggccctttgcgagagcatcaccctggcgaccgggcctctcacaacgctgtgggagggatctccgggcaaattctggaataccacaattgctgtgagcatggccaacatctttagaggctcctatctggctggggccggactcgccttctctcttatgaaaagcctgggcgggggacggcgcggcaccggggctcagggagaaacactgggcgagaaatggaagagacagctcaatcagctgtccaagagcgagttcaacacctacaaacggtccggcattatggaggttgacagatctgaagccaaggaggggcttaaacgcggagagacgacaaagcacgcggtcagccggggcaccgccaaactgagatggtttgtggaacgcaatctcgtgaagcccgaggggaaggtcatcgatctgggatgtggcagagggggatggtcctattactgcgctggcctgaaaaaggttaccgaagtgaaaggctatacaaaagggggacctggccatgaggaacccattcctatggccacctacgggtggaacctcgtgaaactttactctggaaaggacgtcttctttattccccctgagaaatgtgatacactgctgtgcgacatcggcgagagctccccgaatcccacgatcgaagaggggagaaccctccgcgtgctgaagatggttgaaccttggcttcggggaaaccaattctgtatcaagattctgaatccctatatgccttctgtggtcgagacactcgagcagatgcagagaaaacacggcggcatgctggtgcgcaaccccctgagcagaaattccacccatgaaatgtactgggttagctgcgggacaggaaacatcgtgtctgctgtcaatatgacctccagaatgctcctgaaccgctttacgatggcccaccggaagccgacctatgagagagatgtggaccttggcgcggggacacgccacgtggccgtcgaacctgaggttgctaacctggatattatcggacagagaattgaaaatatcaaacatgagcacaagagcacctggcattacgacgaggataacccctataaaacatgggcctaccacggctcttatgaagtgaagccctccgggagcgcttcttccatggtgaatggagtcgtgaagctcctgaccaaaccttgggacgttatccccatggtgacacaaattgccatgaccgatacgacacctttcggccagcagcgggtctttaaggagaaagtggacacccgcaccccgaaggctaaaagaggcacagcccaaatcatggaagttacggcgcggtggctttgggggttcctgagcagaaacaagaagccccggatttgtacccgcgaggaatttacaagaaaagtgcggtccaatgccgctatcggagccgtcttcattgacgagaaccagtggaatagcgctaaggaggccgtggaagatgagcgcttttgggacctcgttcatagagaacgggagctgcacaaacagggcaagtgcgcgacctgcgtgtacaacatgatggggaaacgcgaaaagaagctgggagagttcggcaaagcgaaggggtctagagctatctggtacatgtggctcggcgcccggtttctggagttcgaagcccttggattcatgaatgaggatcactggtttagccgcgaaaactccctgtctggcgtcgagggggagggactccataaactgggctatatccttagagacattagcaagatccctgggggaaatatgtacgctgatgacacagccggctgggatacccggattacagaagacgatctgcagaacgaggctaaaatcaccgacattatggaacccgagcacgccctcctggcgaaggccatcttcaaactgacgtatcaaaataaggtggtccgcgtgcagagacctgctaagaacgggaccgttatggatgtgatctcccggcgcgaccagagaggctctggacaggtcggcacatacgggctcaatacctttacaaacatggaagcccaactgattcggcagatggagagcgagggaatcttctccccctctgaacttgagaccccgaacctggctgaaagagtgctcgattggctgggcaaatatggggtggagcgccttaagcggatggccattagcggagacgactgtgttgtgaaacctatcgatgacagatttgcgacggccctgacagctctcaatgatatgggcaaggtccgcaaagacattccccagtgggaaccttccaaggggtggaacgattggcagcaagtgcccttctgcagccatcactttcaccagctgatcatgaaggacggccgggagattgttgtgccttgtagaaatcaggatgagctggtcggacgcgcccgggtgtctcagggcgctgggtggtccctcagagaaaccgcctgcctgggaaaaagctacgctcaaatgtggcagcttatgtatttccatcgccgggacctgagactcgccgcgaacgccatctgttctgctgtccccgtggattgggttccgacatcccgcaccacgtggagcatccacgcccatcaccagtggatgaccacagaggacatgctgtccgtgtggaatcgggtctggattgaagagaacccttggatggaagataagacccatatctctagctgggaggacgtgccctaccttggcaaaagagaggaccaatggtgcgggtccctgattggactcacagcccgggctacctgggccacaaatatccaggttgcgattaaccaggtgagacgcctgatcggcaatgaaaactacctggattatatgaccagcatgaagcggtttaaaaatgagtctgaccccgaaggggctctctggtga

SEQ ID NO: 19492 - RNA, 9879 nt, synthetic construct
  misc_feature 1..9879: note = derived and/or modified CDS sequence (opt5) from DENV-1__KU666940__SS-prME
  source 1..9879: mol_type = other RNA
agcgtgaccatgctgctcatgctgacccccacggcccttgctttccacctgaccacaagaggaggggaacctcatatgatcgtctccaagcaggaacgggggaaatctctcctgtttaagaccagcgccggcgttaacatgtgcacacttatcgcgatggacctgggggaactctgtgaagataccatgacatacaaatgccccagaatcaccgaggctgaacccgacgatgtggactgttggtgcaatgccacggatacctgggtgacatatggaacctgttcccaaacaggcgagcacagacgggacaagcgctctgttgccctggctcctcatgtggggctgggactcgagaccagaacggaaacatggatgagctccgagggcgcctggaaacagattcagcgggttgaaacctgggctctgcgccaccccggcttcacagtgatcgccctttttctggcgcatgccattgggacctctatcacccagaagggaatcattttcatcctcctgatgcttgtcacacctagcatggctatgagatgcgtgggcattgggtcccgggattttgttgagggactgagcggcgccacgtgggtggacgtcgtgctcgagcacgggtcttgtgtgaccacaatggctaaggataaacccaccctggacatcgaactgctcaagacagaggtcaccaaccctgccgttctgcgcaaactttgcattgaagcgaagatctccaatacgacaaccgatagcagatgtccgacccaaggagaggccacactggtggaagaacaggacgctaacttcgtgtgccggcgcacctttgtcgatagaggctggggcaatgggtgtggactcttcggcaaagggtctctgattacatgcgccaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgctacgattacaccccaggcccctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcttccacatctcaagagacctggaatcgccaggacctgctcgtgaccttcaaaacagcgcacgccaagaagcaggaagtcgtggttctgggaagccaagagggcgctatgcacacggccctgaccggggccacagaaattcagacctccggaacaaccacgatctttgctggccatctcaaatgcagactgaagatggataaacttacactgaaggggatgagctatgtgatgtgtaccggctctttcaaactcgagaaggaagtcgccgagacccagcacggaacagtgctggttcagattaagtacgagggcaccgacgcgccgtgcaaaatccctttctccacacaagatgaaaagggggtgacgcagaacggacggctgatcaccgctaatcccattgtcacagacaaagagaagcctgtgaacatcgaagccgagccgccctttggcgagagctatattgtgatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtttttaccagcgtcggcaaactggtgcatcagattttcgggacggcttacggagtgctcttttccggcgtcagctggaccatgaagatcgggattggcgtgctgcttacatggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatcttcgtgacaaatgaggtccacacctggacggaacaatataagtttcaggccgactcccctaaacggctgtctgcggccattggcaaggcttgggaggagggggtgtgcggcatcagaagcgccacacgcctcgaaaacatcatgtggaaacagatttccaacgagctgaatcatatccttctggaaaacgacatgaagttcaccgttgtggtcggagatgtggctggcattctcgcccaggggaaaaagatgatccggccgcaacccatggagcacaaatactcttggaaaagctggggaaaggccaaaattatcggcgctgacgtgcagaataccacatttatcattgatgggcctaacacccccgaatgtcctgacgatcagagagcgtggaatatctgggaggtcgaggactatggattcggcatttttacgacaaacatctggctgaagctgcgcgattcctacacccaggtttgcgaccaccggcttatgagcgccgctattaaagattctaaggccgtgcatgccgacatgggctattggatcgaatccgagaaaaatgaaacatggaagctcgctagagccagcttcatcgaggtgaagacctgtatttggcccaaatctcacacactgtggtccaacggggtcctggaaagcgagatgatcattccgaagatctacggaggccctatttctcaacataattatcgccccgggtacttcacccagacggcgggaccttggcacctcggcaaactggagcttgattttgacctgtgcgaagggaccacagtggttgtggatgagcactgcggaaaccggggccccagcctcagaaccacaaccgtcacgggcaagatcatccatgaatggtgttgccggtcctgtacactgcctcccctgcgctacagaggggaggacggatgctggtatggcatggagattcggccggtgaaagaaaaggaggaaaatcttgttaagagcatggtgtctgctgggtccggagaggtcgacagcttctccctcggcctgctgtgtatctctattatgatcgaagaggtgatgagaagccgctggtcccggaaaatgctcatgaccgggacactggccgtctttttccttctgattatgggacagctcacctggaacgatctgatcagactgtgcattatggtgggcgccaatgcttctgaccgcatgggcatggggaccacataccttgccctgatggcgacgtttaagatgagacctatgttcgctgtcggactcctgtttcggcgcctcaccagcagagaggtgctgcttctgacaatcggcctctccctggtggcctctgtcgaactgcccaacagccttgaggaactgggggatggactcgccatgggcatcatgattctgaaactcctgaccgacttccaatcccaccagctttgggctacactgctcagcctgacctttatcaagacgacattctctctgcattatgcctggaaaaccattgctatggttctttccatcgtgagcctgtttcccctctgtctgtctaccacatcccagaagaccacatggctccctgtgctgcttgggagcctgggatgcaagccgctgacgatgttcctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcacagcggcgcgtcccataatatcctcgtggaagttcaggatgacgggaccatgaaaatcaaggatgaggagcgcgacgatacactgaccattcttctgaaagccacactcctggctgtgtctggagtctatcctctcagcatccccgccaccctgtttgtgtggtacttctggcaaaagaagaaacagagatccggcgtcctttgggacacgccttctcccccggaagtggagcgggccgttctggatgacggcatttatcgcatcatgcagagagggctgctcggacggagccaggtgggcgtcggggtgttccaagaaaacgtttttcacaccatgtggcacgtgacacgcggagctgtcctgatgtaccagggcaagagacttgagccttcctgggccagcgtgaaaaaggacctgatttcttacgggggaggctggcggctccagggctcctggaataccggggaggaagtgcaggttatcgcggtcgagcccggcaaaaaccctaagaatgtgcaaacagctcccggcaccttcaagacaccggaaggggaggtgggagccattgccctggattttaaacctggcacgagcgggtctcccatcgtcaacagagaaggaaagatcgtgggcctctatggcaatggggttgtgaccacatccggaacctacgtcagcgctattgcccaggcgaaggcttcccaggagggccctctgcccgagatcgaagacgaggtgttccgcaagcggaaccttaccattatggatctgcatcccgggtctggaaaaacaagacgctatctgcctgccatcgttcgggaagccattaagagaaagctccgcacgctgatccttgctccgacccgggtggtcgccagcgagatggctgaagccctgaaaggcatgcccatcagataccaaacaaccgcggtgaagtccgagcacacagggaaagagattgttgacctcatgtgccatgccacctttacgatgcgcctgctgagccctgtgcgggtccccaattataacatgatcattatggatgaagctcacttcacagacccttcttccatcgccgctagaggctacattagcacccgggtgggaatgggcgaggccgccgctatctttatgaccgcgacaccccctgggtctgtggaagccttcccgcagagcaatgctgtcatccaggatgaggaacgcgacattcccgagagatcctggaactctggatatgagtggatcaccgattttcctggcaagacagtttggttcgtgcccagcattaaatccgggaatgacatcgccaactgtctccggaagaatggaaagcgcgtgattcagctttctagaaaaacctttgatacggaataccaaaagaccaaaaacaacgactgggactacgtcgtgaccacagatatcagcgagatgggcgccaatttccgggctgacagagttattgatcctcgccggtgcctgaagcccgtgatcctgaaagacgggccggaaagagtcatcctcgccggccctatgcccgtgaccgttgcgtccgctgcccagcgccggggaagaattggccgcaaccataataaggagggggatcagtatatctacatgggacagcccctgaacaatgacgaggatcacgcccactggacggaagctaagatgcttctggacaacattaatacccctgagggcatcattcccgccctcttcgaacctgagcgggagaaaagcgcggccatcgatggggagtatagactgcgcggagaggctagaaagacatttgtggaactgatgcggcgcggcgacctcccggtctggctttcttacaaagtggcctccgaggggttccaatatagcgatagacggtggtgctttgacggcgaacgcaacaatcaggtcctggaggaaaacatggatgtggagatctggaccaaggagggagaacgcaagaaactgcggcccagatggctcgacgctcgcacatactccgaccctctggcccttcgggagttcaaagaatttgctgccggcagacgctctgttagcggggatctgattctcgagatcggaaagctgccccagcatctgacccagcgggcgcaaaatgccctcgacaaccttgtgatgctgcacaattccgaacagggcgggagagcttatcggcatgccatggaggagctgcctgatacaattgaaaccctcatgctgcttgctctgatcgccgtgctcacgggaggcgtcacactgttctttctgtctggcaaggggctcggaaaaaccagcattggccttctgtgtgttatggcctccagcgtgctgctctggatggcttctgtggagccccactggatcgcggcctccatcattctggagttctttcttatggtcctgctcatcccggagcctgaccgccagagaacaccccaggataaccaactggcttacgtggttattgggctcctgttcatgatccttacagtggccgccaatgagatgggactgctggaaaccacaaagaaagacctcggcattgggcacgtcgctgtggagaaccatcaccatgccgcgatgctggatgtcgaccttcaccctgccagcgcttggacgctgtacgccgtggctaccacaatcattacccccatgatgcggcatacaatcgaaaacaccacggccaatatctctctcaccgcgattgccaaccaggctgccatcctgatgggactggataagggctggcctatttccaaaatggacatcggcgttcccctccttgctctggggtgctatagccaggtgaatccgctgacactcaccgccgctgtcctgatgcttgtggcccactacgcgattatcggacctggcctgcaagccaaggctacacgcgaggcccagaagagaaccgctgccgggatcatgaaaaaccccacggttgatggaattgtggccatcgacctcgatcccgtcgtgtatgacgcgaagtttgaaaaacagctgggccagattatgctgctcatcctttgtacatctcaaattctgctgatgcggaccacatgggctctctgcgagagcatcaccctggccaccgggcctcttacaacgctgtgggagggatccccgggcaagttctggaataccacaatcgctgtgtctatggccaacatttttcgcggcagctacctcgccggggctggactggccttctccctgatgaaaagcctcggcgggggaagacggggcaccggggcgcagggagaaacacttggcgagaagtggaagcgccagctgaatcagctgtccaaatctgagttcaacacctataagagaagcggcatcatggaggttgaccggtccgaagccaaagaggggctcaagagaggagagacgacaaaacacgctgtctctcgcggcaccgccaagctgcggtggtttgtggaaagaaatcttgtgaagcccgaggggaaagtcattgatctgggatgtggccgcgggggatggagctactattgcgctggcctcaagaaagttaccgaagtgaagggctacacaaaagggggacctggccatgaggaacccgtgcctatggccacctacgggtggaacctggtcaagctgcactccggaaaagacgtgttctttattccccctgagaagtgtgatacactcctttgcgacattggcgagtctagcccgaatcccacgatcgaagaggggcggaccctgagagttctgaagatggtggaaccttggctccgcggaaaccaattctgtattaaaatcctgaatccctatatgccttccgtcgtggagacacttgagcagatgcagcggaagcatggcggcatgctggttagaaaccccctcagccgcaattctacccacgaaatgtactgggtgtcctgcgggacaggaaacatcgtcagcgcgattaatatgacctctcggatgctgctgaacagatttacgatggcccaccgcaaaccgacctatgagcgggatgtggacctcggcgctgggacaagacatgtggccgtcgaacctgaggttgctaacctggatatcattggacagcgcatcgaaaatattaagtgtgagcacaaatccacctggcattacgacgaggataacccctataagacatgggcctaccacggcagctatgaagtgaagccctctgggtccgctagctccatggtgaatggagtcgtgaaacttctgaccaagccttgggacgttatccccatggtgacacaaatcgccatgaccgatacgacacctttcggccagcagagagtctttaaagagaaggtggacacccggaccccgaaagcgaagcgcggcacagcccaaattatggaagttacggctagatggctctgggggttcctgagccggaacaagaaacccagaatctgcacccgggaggaatttacacgcaaggtgagatctaatgccgctattggagccgtcttcgtggacgagaaccagtggaatagcgccaaagaggcggttgaagatgagcggttttgggaccttgtgcatcgcgaaagagagctgcacaagcagggcaaatgcgctacctgtgtctacaacatgatggggaagcgggaaaagaaactcggagagttcggcaaggccaaagggtcccgcgccatctggtacatgtggctgggcgctagatttctggagttcgaagccctcggattcatgaatgaggatcactggttttctcgggaaaacagcctgtccggcgtggagggggagggacttcataagctgggctatattctccgcgacatctctaaaatcagcgggggaaatatgtacgctgatgacacagccggctgggataccagaattacagaagacgatctgcagaacgaggcgaagatcaccgaaattatggagcctgaacacgcccaacttgctaaagccatcttcaagctgacgtatcagaataaggtcgtgcgggttcagcgccccgctaaaaacgggaccgtgatggacgtcatttccagacgggatcagcgcggctctggacaagtgggcacatacgggctcaatacctttacaaacatggaggcccagctgatcagacagatggagagcgaaggaatcttctcccctagcgagctggaaacccccaacctcgcggagcgggtgctggactggcttgaaaagtatggcgttgagagactgaaacgcatggccatttctggggatgactgcgtggtcaagccgatcgacgatcggtttgctacggccctcacagctctgaatgacatgggaaaagtgagaaaggatattcctcagtgggagccctccaagggctggaacgactggcaacaggttcctttctgtagccatcactttcaccagcttatcatgaaagatgggcgcgaaattgtggtcccctgccggaatcaggacgagctggtgggcagagcccgcgtctctcaaggagctggctggtccctccgggaaaccgcctgtctgggaaagagctacgcgcagatgtggcagctgatgtatttccatagacgcgatctccggctggccgctaacgccatctgctccgccgtgcctgttgactgggtgcccacatctagaaccacgtggagcattcacgctcatcaccaatggatgaccacagaggatatgctttccgtctggaatcgcgtgtggatcgaagagaacccgtggatgaaagacaagacccatatcagctcttgggaggatgttccttacctgggaaaacgggaagaccagtggtgtggctccctcattgggctgacagccagagcgacctgggctacaaatatccaggtggccattaaccaggtccggagacttatcggaaatgagaactacctggactatatgaccagcatgaagcgctttaagaatgaatctgatcccgagggcgccctctggtga

SEQ ID NO: 19493 - RNA, 9879 nt, synthetic construct
  misc_feature 1..9879: note = derived and/or modified CDS sequence (opt5) from DENV-1__KU666941__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattggagcgaagatctccaataccacgacagatagcagatgtccgacccaaggcgaagccaccctggtggaggaacaggacgctaacttcgtgtgccggcgcacatttgtcgatagaggctgggggaatggatgtggcctcttcgggaaaggatctctgattacctgcgccaagtttaagtgcgtgacaaaacttgagggcaagatcgttcagtacgagaacctgaaatattccgtgatcgtcacggtgcacaccggggaccagcatcaagttggaaatgaaagcacagagcacggcaccacagctaccattacgccccaggcccctaccacagaaatccagctcaccgactacggcgccctgacactggattgttctccccggaccgggctcgacttcaacgagatggtgctgcttacgatgaaggaaaaatcctggctggtccataagcagtggtttctcgatctgcctcttccctggacaagcggagcttccacctctcaagagacatggaatcgccaggacctgctcgtgaccttcaaaaccgcgcacgccaagaagcaggaggtcgtggttctgggcagccaagaaggggctatgcacacagccctgacgggagccaccgagattcagacatccggcaccacaaccatctttgctgggcatctcaaatgcagactgaagatggataaacttacgctgaagggcatgagctatgtgatgtgtacaggatctttcaaactcgaaaaggaggtcgccgaaacccagcacggcaccgtgctggttcagattaagtacgaggggacagacgcgccgtgcaaaatccctttctccacccaagatgagaagggagtgacacagaacggccggctgatcacggctaatcccattgtcaccgacaaagaaaagcctgtgaacatcgaggccgaacccccctttggggagagctatattgtgatcggagccggcgagaaagctcttaagctctcttggttcaagaaagggagctccattggcaagatgtttgaagccacagctagaggagcccgccggatggcgatcctgggcgataccgcctgggacttcgggtctatcggaggcgtttttacaagcgtcgggaaactggtgcatcagattttcggaaccgcttacggcgtgctcttttccggggtcagctggacgatgaagatcggcattggagtgctgcttacctggctgggcctcaattctagatccacaagcctgtctatgacctgtatcgccgttgggctggtgacactttacctcggagtcatggtgcaggctgattccggctgcgttattaactggaaagggcgcgagctgaagtgtggaagcggcatcttcgtgaccaatgaagtccacacatggaccgagcaatataagtttcaggccgactcccctaaacggctgtctgcggccattgggaaggcttgggaagagggcgtgtgcggaatcagaagcgccacgcgcctcgagaacatcatgtggaaacagatttccaacgaactgaatcatatccttctggagaacgacatgaagttcacagttgtggtcggcgatgtggctgggattctcgcccagggaaaaaagatgatccggccgcaacccatggaacacaaatactcttggaagagctggggcaaggccaaaattatcggggctgacgtgcagaataccacctttatcattgatggacctaacacacccgagtgtcctgacgatcagagagcgtggaatatctgggaagtcgaggactatggcttcggcatttttaccacgaacatctggctgaagctgcgcgattcctacacacaggtttgcgaccaccggcttatgagcgccgctattaaagattctaaggccgtgcatgccgacatggggtattggatcgagtccgaaaaaaatgagacctggaagctcgctagagccagcttcatcgaagtgaagacatgtatttggcccaaatctcacaccctgtggtccaacggagtcctggagagcgaaatgatcattccgaagatctacggcgggcctatttctcaacataattatcgccccggatacttcacacagaccgcgggcccttggcacctcgggaaactggagcttgattttgacctgtgcgagggaacgaccgtggttgtggatgaacactgcggcaaccggggccccagcctcagaacaaccacagtcaccgggaagatcatccatgagtggtgttgccggtcctgtacgctgcctcccctgcgctacagaggagaagacggctgctggtatgggatggagattcggccggtgaaagagaaggaagagaatcttgttaagagcatggtgtctgctggatccggcgaagtcgacagcttctccctcgggctgctgtgtatctctattatgatcgaggaagtgatgagaagccgctggtcccggaaaatgctcatgacaggaaccctggccgtttttttccttctgattatgggccagctcacatggaacgatctgatcagactgtgcattatggtgggcgccaatgcttctgaccgcatggggatgggaaccacctaccttgccctgatggcgacatttaagatgagacctatgttcgctgtcggcctcctgtttcggcgcctcacgagcagagaggtgctgcttctgaccatcgggctctccctggtggcctctgtcgagctgcccaacagccttgaagagctgggagatggcctcgccatggggatcatgattctgaaactcctgacagacttccaatcccaccagctttgggctaccctgctcagcctgacatttatcaagaccacgttctctctgcattatgcctggaaaacaattgctatggttctttccatcgtgagcctgtttcccctctgtctgtctaccacctcccagaagacaacctggctccctgtgctgcttggaagcctgggctgcaagccgctgacaatgttcctcattgccgaaaataaaatctggggccggaagtcttggcccctgaacgaggggatcatggcggtcggaattgtgtccatccttctgagctccctcctgaaaaacgatgttcctctcgccggccccctgattgctgggggaatgcttatcgcctgttacgtgattagcggctctagcgctgacctgtccctggaaaaggccgccgaggtctcttgggaggaagaggctgaacacagcggggcgtcccataatatcctcgtggaggttcaggatgacggaacgatgaaaatcaaggatgaagagcgcgacgataccctgacaattcttctgaaagccaccctcctggctgtgtctggcgtctatcctctcagcatccccgccacactgtttgtgtggtacttctggcaaaagaagaaacagagatccggcgtcctttgggacaccccttctcccccggaggtggaacgggccgttctggatgacgggatttatcgcatcatgcagagaggactgctcggccggagccaggtgggggtcggagtgttccaagagaacgtttttcacacgatgtggcacgtgacccgcggcgctgtcctgatgtaccaggggaagagacttgaaccttcctgggccagcgtgaaaaaggacctgatttcttacggaggcggctggcggctccaggggtcctggaatacaggagaggaggtgcaggttatcgcggtcgaacccggcaaaaaccctaagaatgtgcaaaccgctcccgggacattcaagaccccggagggagaagtgggcgccattgccctggattttaaacctgggacaagcggatctcccatcgtcaacagagagggcaagatcgtgggcctctatgggaatggagttgtgacgacctccggcacatacgtcagcgctattgcccaggcgaaagcttcccaggaagggcctctgcccgagatcgaggacgaagtgttccgcaagcggaaccttaccattatggatctgcatcccggatctggcaaaaccagacgctatctgcctgccatcgttcgggaggccattaagagaaagctccgcacactgatccttgctccgacgcgggtggtcgccagcgaaatggctgaggccctgaaagggatgcccatcagataccaaaccacagcggtgaagtccgaacacaccggcaaagagattgttgacctcatgtgccatgccacatttaccatgcgcctgctgagccctgtgcgggtccccaattataacatgatcattatggatgaggctcacttcacggacccttcttccatcgccgctagaggatacattagcacacgggtgggcatgggggaagccgccgctatctttatgaccgcgaccccccctggatctgtggaggccttcccgcagagcaatgctgtcatccaggatgaagagcgcgacattcccgaaagatcctggaactctggctatgagtggatcacagattttcctgggaagaccgtttggttcgtgcccagcattaaatccggaaatgacatcgccaactgtctccggaagaatggcaagcgcgtgattcagctttctagaaaaacatttgataccgagtaccaaaagacgaaaaacaacgactgggactacgtcgtgacaaccgatatcagcgaaatgggggccaatttccgggctgacagagttattgatcctcgccggtgcctgaagcccgtgatcctgaaagacggcccggagagagtcatcctcgccggacctatgcccgtgacagttgcgtccgctgcccagcgccggggcagaattgggcgcaaccataataaggaaggagatcagtatatctacatgggccagcccctgaacaatgacgaggatcacgcccactggaccgaggctaagatgcttctggacaacattaatacgcctgaagggatcattcccgccctcttcgagcctgaacgggagaaaagcgcggccatcgatggagaatatagactgcgcggcgaggctagaaagacctttgtggagctgatgcggcgcggggacctcccggtctggctttcttacaaagtggcctccgaaggcttccaatatagcgatagacggtggtgctttgacggagagcgcaacaatcaggtcctggaagagaacatggatgtggaaatctggacaaaggagggcgagagaaaaaagctgcggcccagatggctcgacgctcgcacctactccgaccctctggcccttcgggaattcaaagagtttgctgccgggagacgctctgttagcggagatctgattctcgaaatcggcaagctgccccagcatctgacacagcgggcgcaaaatgccctcgacaaccttgtgatgctgcacaattccgagcaggggggaagagcttatcggcatgccatggaagagctgcctgataccattgagacactcatgctgcttgctctgatcgccgtgctcaccggcggcgtcacgctgttctttctgtctgggaagggactcggcaaaacaagcattgggcttctgtgtgttatggcctccagcgtgctgctctggatggcttctgtggaaccccactggatcgcggcctccatcattctggagttctttcttatggtcctgctcatcccggaacctgaccgccagagaaccccccaggataaccaactggcttacgtggttattggactgctcttcatgatccttaccgtggccgccaatgagatgggcctgctggagacaaccaagaaagacctcgggattggacacgtcgctgtggaaaaccatcaccatgccgcgatgctggatgtcgaccttcaccctgccagcgcttggacactgtacgccgtggctacgaccatcattacacccatgatgcggcataccatcgagaacacaaccgccaatatctctctcacggcgattgccaaccaggctgccatcctgatgggcctggataagggctggcctatttccaaaatggacatcggggttcccctccttgctctgggatgctatagccaggtgaatccgctgaccctcacagccgctgtcctgatgcttgtggcccactacgcgattatcggccctgggctgcaagccaaggctacccgcgaagcccagaagagaacagctgccggaatcatgaaaaaccccaccgttgatggcattgtggccatcgacctcgatcccgtcgtgtatgacgcgaagtttgagaaacagctggggcagattatgctgctcatcctttgtacgtctcaaattctgctgatgcggacaacctgggctctctgcgaaagcatcacactggccaccggacctcttaccacactgtgggagggctccccgggcaagttctggaatacgaccatcgctgtgtctatggccaacatttttcgcgggagctacctcgccggagctggcctggccttctccctgatgaaaagcctcgggggaggcagacgggggacaggagcgcagggcgagacccttggcgaaaagtggaagcgccagctgaatcagctgtccaaatctgagttcaacacatataagagaagcgggatcatggaagttgaccggtccgaggccaaagaaggactcaagagaggcgagaccacgaaacacgctgtctctcgcgggacagccaagctgcggtggtttgtggagagaaatcttgtgaagcccgaaggaaaagtcattgatctgggctgtgggcgcggaggctggagctactattgcgctggcctcaagaaagttaccgaggtgaaggggtacaccaaaggaggccctgggcatgaagagcccgtgcctatggccacatacggatggaacctggtcaagctgcactccggcaaagacgtgttctttatcccccctgaaaagtgtgataccctcctttgcgacattggggagtctagcccgaatcccacaatcgaggaaggacggacgctgagagttctgaagatggtggagccttggctccgcggcaaccaattctgtattaaaatcctgaatccctatatgccttccgtcgtggaaacccttgagcagatgcagcggaagcatggcgggatgctggttagaaaccccctcagccgcaattctacacacgagatgtactgggtgtcctgcggaaccggcaacatcgtcagcgcgattaatatgacatctcggatgctgctgaacagatttaccatggcccaccgcaaaccgacgtatgaacgggatgtggacctcggggctggaaccagacatgtggccgtcgagcctgaagttgctaacctggatatcattggccagcgcatcgagaatattaagtgtgaacacaaatccacatggcattacgacgaggataacccctataagacctgggcctaccacgggagctatgaggtgaagccctctggatccgctagctccatggtgaatggcgtcgtgaaacttctgacaaagccttgggacgttatccccatggtgacccaaatcgccatgacagataccacgcctttcggccagcagagagtctttaaagaaaaggtggacacacggaccccgaaagcgaagcgcgggaccgcccaaattatggaggttacagctagatggctctggggattcctgagccggaacaagaaacccagaatctgcacgcgggaagagtttacccgcaaggtgagatctaatgccgctattggcgccgtcttcgtggacgaaaaccagtggaatagcgccaaagaggcggttgaggatgaacggttttgggaccttgtgcatcgcgagagagaactgcacaagcaggggaaatgcgctacatgtgtctacaacatgatgggaaagcgggagaagaaactcggcgaattcgggaaggccaaaggctcccgcgccatctggtacatgtggctgggagctagatttctggagttcgaggccctcggcttcatgaatgaagatcactggttttctcgggagaacagcctgtccggggtggaaggagagggccttcataagctggggtatattctccgcgacatctctaaaatcagcggaggcaatatgtacgctgatgacaccgccgggtgggatacaagaattaccgaggacgatctgcagaacgaagcgaagatcacagagattatggaacctgagcacgcccaacttgctaaagccatcttcaagctgacctatcagaataaggtcgtgcgggttcagcgccccgctaaaaacggcacggtgatggacgtcatttccagacgggatcagcgcggatctggccaagtggggacctacggactcaatacatttaccaacatggaagcccagctgatcagacagatggagagcgagggcatcttctcccctagcgaactggagacacccaacctcgcggaacgggtgctggactggcttgagaagtatggggttgaaagactgaaacgcatggccatttctggagatgactgcgtggtcaagccgatcgacgatcggtttgctaccgccctcacggctctgaatgacatgggcaaagtgagaaaggatattcctcagtgggagccctccaaggggtggaacgactggcaacaggttcctttctgtagccatcactttcaccagcttatcatgaaagatggccgcgagattgtggtcccctgccggaatcaggacgaactggtgggaagagcccgcgtctctcaaggcgctgggtggtccctccgggagacagcctgtctgggaaagagctacgcgcagatgtggcagctgatgtatttccatagacgcgatctccggctggccgctaacgccatctgctccgccgtgcctgttgactgggtgcccacctctagaacaacctggagcattcacgctcatcaccaatggatgacgaccgaagatatgctttccgtctggaatcgcgtgtggatcgaggaaaacccgtggatgaaagacaagacacatatcagctcttgggaggatgttccttacctgggcaaacgggaggaccagtggtgtgggtccctcattggactgaccgccagagcgacatgggctaccaatatccaggtggccattaaccaggtccggagacttatcggcaatgaaaactacctggactatatgacaagcatgaagcgctttaagaatgagtctgatcccgaaggggccctctggtga

SEQ ID NO: 19494 - RNA, 9879 nt, synthetic construct
  misc_feature 1..9879: note = derived and/or modified CDS sequence (opt5) from DENV-1__KC172835__SS-prME
  source 1..9879: mol_type = other RNA
agcgtgaccatgctgctcatgctgatgcccacagcccttgctttccacctgacgacccggggaggggaacctcatatgatcgtctccaagcaggaacggggaaaatctctcctgtttaagacaagcgccggcgttaacatgtgcacccttattgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctgggactcgagacacggaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttgtgaactggaaaggccgcgaactgaagtgtgggagcggaattttcgtcaccaatgaggtgcacacatggaccgaacaatataagtttcaggccgactcccctaaacggctgtctgcggccatcggcaaggcttgggaggagggggtttgcggcattagaagcgccacgcgcctcgaaaacgtgatgtggaaacagatctccaacgagctgaatcatatccttctggaaaacgacatgaagttcacagtcgtggtgggagatgtcgctggcattctcgcccaggggaaaaagatgatccggccgcaacccatggagtacaaatattcttggaaaagctggggaaaggccaagattatcggcgctgacgttcagaataccacctttattatcgatgggcctaacacacccgaatgtcctgacgatcagagagcgtggaatatctgggaggtggaggactacggattcggcatttttaccacgaacatctggctgcgcctgcgggattcctatacacaggtgtgcgaccacagacttatgagcgccgctattaaggattctaaagccgtccacgccgacatgggctactggatcgaatccgagaagaatgaaacctggaaactcgctcgcgccagcttcattgaggtgaagacatgtatctggcccaagtctcataccctgtggtccaacggggttctggaaagcgagatgatcattccgaaaatctatggaggccctatttctcaacacaattaccggcccgggtacttcacacagaccgcgggaccttggcatctcggcaagctggagcttgattttgacctgtgcgaagggacgaccgtggtcgtggatgagcactgcggaaacagaggccccagcctccggacaaccacagttaccggcaaaacgatccacgaatggtgttgccgctcctgtacactgcctcccctgagattcagaggggaagacggatgctggtatggcatggagattagaccggtgaaggaaaaagaggaaaatcttgtcaagagcatggtgtctgctgggtccggagaggttgacagcttttccctcggcctgctgtgtatctctatcatgattgaagaggtgatgcgcagccggtggtccagaaagatgctcatgaccgggacactggccgtcttctttcttctgatcattggacagctcacctggaacgatctgatccgcctgtctattatggtgggcgccaatgctagcgacaaaatgggcatggggaccacataccttgccctgatggcgacgttcaagatgagacctatgtttgctgtgggactcctgttccggcgcctcacctccagagaggtcctgcttctgacaatcggcctctctctggttgccagcgtggaactgcccaactcccttgaggaactgggggatggactcgccatgggcattatgatcctgaaactcctgaccgactttcaaccccatcagctttgggctacactgctcagcctgaccttcatcaagacgacattttctctgcactatgcctggaaaaccatggctatggtgctttccattgtcagcctgttccctctctgcctgtctaccacatcccagaagaccacatggctcccggtgctgcttgggagcctgggatgtaagcccctgacgatgtttctcatcaccgagaataaaatttggggccggaagtcttggcctctgaacgaaggcatcatggccgttgggattgtgtccatccttctgagctccctcctgaaaaacgatgtccccctcgcgggacctctgatcgccggcgggatgcttattgcttgctacgtgatcagcggatctagcgccgacctgtccctggagaaggctgccgaggtttcttgggaagaggaagccgagcatagcggcgcttcccacaatattctcgtggaagtccaggatgacgggacaatgaaaatcaaggatgaggagcgcgacgataccctgacaattcttctgaaagcgaccctcctggccgtgtctggagtctatcccctcagcatccctgctacgctgttcgtgtggtacttctggcaaaagaagaaacagagatccggcgttctttgggacaccccctctccgcctgaagtggagcgggccgccctggatgacggcatctatcgcattatgcagagagggctgctcggacggagccaggtcggcgtgggggtttttcaagaaaacgtgttccatacaatgtggcacgtcacccgcggagctgtgctgatgtaccagggcaagagacttgagccctcctgggccagcgtgaaaaaggacctgatctcttacgggggaggctggcggctccagggctcctggaatacaggggaggaagttcaggtcattgcggtggagcctggcaagaaccccaagaatgtgcaaaccgctccgggcacatttaagacgcctgaaggggaggtcggagccatcgccctggatttcaaacccggcaccagcgggtctcctattgtgaacagagaaggaaagatcgttggcctctatggcaatggggtggtcacaacctccggaacctacgtgagcgctattgcccaggcgaaggcttcccaggagggccccctgcccgagatcgaagacgaggtttttcgcaagcggaaccttacaatcatggatctgcaccctgggtctggaaaaacgagacgctatctgccggccattgtgcgggaagccatcaagagaaagctccgcaccctgattcttgctcccacacgggtcgtggccagcgagatggctgaagccctgaaaggcatgcctatcagataccaaaccacagcggttaagtccgagcataccgggaaagagattgtggacctcatgtgtcacgccacgttcacaatgcgcctgctgagccccgtccgggtgcctaattataacatgatcatcatggatgaagctcattttaccgacccctcttccattgccgctagaggctacatcagcacccgggtgggaatgggcgaggccgccgctattttcatgacagcgacccctccggggtctgtcgaagcctttccccagagcaatgctgttatccaggatgaggaacgcgacattcctgagagatcctggaactctggatatgagtggatcacagatttccccggcaagaccgtgtggtttgtgcctagcatcaaatccgggaatgacattgccaactgcctccggaagaatggaaagcgcgtcatccagctttctagaaaaacgttcgatacagaataccaaaagaccaaaaacaacgactgggactacgtggttacaaccgatattagcgagatgggcgccaatttccgggctgacagagtgatcgatccccgccggtgtctgaagccggtcattctgaaagacgggcctgaaagagtgatcctcgccggccccatgcccgttacggtggcgtccgctgcccagcgccggggaagaattggccgcaaccacaataaggagggggatcagtatatctacatgggacagcctctgaacaatgacgaggatcatgcccactggaccgaagctaagatgcttctggacaacatcaatacacccgagggcattatccctgccctctttgaaccggagcgggaaaagagcgcggccattgatggggagtatagactgcgcggagaggctagaaagaccttcgtcgagctgatgcggcgcggcgacctccccgtgtggctttcttacaaagtcgcctccgaggggtttcaatatagcgatagacggtggtgcttcgacggcgaacgcaacaatcaggtgctggaggaaaacatggatgttgagatctggacaaaggagggagaacgcaagaaactgcggcctagatggctcgacgctcgcacctactccgaccccctggcccttcgggagtttaaagagttcgctgccggcagacgctctgtgagcggggatctgattctcgagatcggaaagctgcctcagcacctgacacagcgggcgcaaaatgccctcgacaaccttgtgatgctgcataattccgaacagggcgggagagcttatcggcacgccatggaggagctgcccgataccatcgaaacgctcatgctgcttgctctgattgccgtcctcacaggaggcgttaccctgtttttcctgtctggccgcgggctcggaaagaccagcatcggccttctgtgcgtgatggcctccagcgtgctgctctggatggcttctgtcgagccgcattggattgcggcctccatcattctggaatttttccttatggtgctgctcatccctgagcccgacagacagcggacacctcaggataaccaactggcttacgttgtgatcgggctgctctttatgattcttaccgtcgccgccaatgagatgggactgctggaaacaacgaaaaaggacctcggcatcgggcacgtggctgatgagaaccaccatcacgccgcgatgctggacgtcgatcttcatcccgccagcgcttggaccctgtacgccgtggctacaaccattatcacacctatgatgcgccacaccattgaaaacacgaccgccaatatctctctcacagcgattgccaaccaggctgccatcctgatgggactggacaaaggctggcccatctccaagatggatattggcgttccgctccttgctctggggtgttatagccaggtgaatcctctgaccctcacagccgctgtcctgatgcttgtggcccattacgcgatcattggacccggcctgcaagccaaagctaccagagaggcccagaagcggacggctgccgggatcatgaagaaccccacagttgacggaattgtggccatcgatctcgaccctgtcgtgtatgacgcgaaattcgaaaagcagctgggccagatcatgctgctcattctttgcacctctcaaatcctgctgatgcgcacaacctgggctctctgtgagagcattaccctggccacagggccgcttacgaccctgtgggagggatcccccggcaaattttggaatacaaccatcgctgtgtctatggccaacattttcagaggcagctacctcgccggggctggactggccttctccctgatgaaaagcctcggcgggggacggcgcggcacaggggcgcagggagaaacccttggcgagaaatggaagagacagctgaatcagctgtccaagtctgaatttaacacgtataaacggagcggcatcatggaggttgatagatccgaagccaaggaggggctcaaacgcggagagacaaccaagcacgctgtctctcggggcaccgccaaactgagatggttcgtggaacgcaatcttgtgaagcctgaggggaaggtcatcgacctgggatgcggcagagggggatggagctactattgtgctggcctcaaaaaggttacagaagtgaaaggctacaccaaagggggacccggccacgaggaacctattcccatggccacatacgggtggaacctggtgaaactgcattccggaaaggatgtctttttcatccctccggagaaatgcgacacgctcctttgtgatattggcgagtctagccccaatcctaccatcgaagaggggagaacactgcgcgtgctgaagatggttgaaccctggctccggggaaaccaattttgcattaagatcctgaatccttatatgccctccgtggtcgagacccttgagcagatgcagagaaaacacggcggcatgctggtgcgcaacccgctcagcagaaattctacacatgaaatgtactgggtttcctgtgggaccggaaacattgtgagcgcggtcaatatgacgtctagaatgctgctgaaccgcttcaccatggtgcaccggaagcctacatatgagagagacgtggatctcggcgccgggacccgccacgtcgctgttgaacccgaggtggccaacctggacatcatcggacagagaattgaaaatatcaaacatgagcacaagtccacatggcattacgatgaggacaacccctataaaacctgggcttaccacggcagctatgaagtgaagccttctgggtccgccagctccatggtcaatggagtggttaaacttctgacaaaaccctgggatgtgattcctatggtcacccaaatcgctatgacggacacaaccccgtttggccagcagcgggtgttcaaggagaaagttgacacccgcacacccaaggccaaaagaggcacggcgcaaattatggaagtgaccgcccggtggctctgggggtttctgagcagaaacaagaagcctcggatctgcacacgcgaggagttcaccagaaaagtccggtctaatgctgccatcggagctgtgtttattgatgagaaccagtggaatagcgccaaggaggccgttgaagacgagcgcttctgggatcttgtgcatagagaacgggagctgcacaaacagggcaagtgtgcgacatgcgtctacaacatgatggggaaacgcgaaaagaagctcggagagtttggcaaagctaaggggtccagagccatctggtacatgtggctgggcgcccggttcctggagttcgaagctctcggatttatgaatgaggaccactggttctctcgcgaaaacagcctgtccggcgtggagggggagggacttcataaactgggctatattctcagagatatctctaagattcccgggggaaatatgtacgccgacgataccgctggctgggacacacggatcaccgaagatgacctgcagaacgaggccaaaatcacggatattatggaaagcgagcacgcgcttctggccaagtccatctttaaactcacctatcaaaataaggtcgtgcgcgttcagagacctgctaagaacgggacagtgatggacgtcatttctcggcgcgatcagagaggcagcggacaggtgggcacctacgggctgaatacattcaccaacatggaagcccaactgatccggcagatggagtccgagggaatttttagcccctctgaactcgagacgccgaacctggctgaaagagcccttgactggctggagaaacatggcgtggaacgcctcaagcggatggcgatctccggggacgattgcgttgtgaaacctatcgacgatagattcgccacagctctgaccgcccttaatgacatgggaaaggtccgcaaagatattccccagtgggagcctagcaagggctggaacgactggcagcaagtgcccttttgttctcaccacttccatcagctgatcatgaaggatgggcgggagattgttgtgccttgcagaaatcaggacgaactcgtcggccgcgctcgggtgtcccagggagccggctggagcctgagagagacagcttgtctggggaaatcctatgcccaaatgtggcagctcatgtactttcaccgccgggatctgagacttgcggccaacgctatctgctctgccgtccccgtggactgggttccgaccagccgcacgacctggtccattcatgcccaccatcagtggatgacaaccgaagatatgctgagcgtgtggaatcgggtctggatcgaggaaaacccttggatggaggacaagacacacatttcttcctgggaggacgtgccctatctcggaaaaagagaagatcaatggtgtggcagcctgatcgggcttaccgctcgggccacatgggcgaccaatatccaggttgctatttctcaggtgagacgcctgatcggaaacgagaattacctcgactacatgacgagcatgaagcggttcaaaaacgaatccgatcccgagggcgccctgtggtga

SEQ ID NO: 19495 - RNA, 9879 nt, synthetic construct
  misc_feature 1..9879: note = derived and/or modified CDS sequence (opt5) from DENV-1__EU848545__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccattatcgcgatggacctgggggagctctgtgaagatacaatgacctacaaatgcccgcgcattacaaaggctgagcccgacgatgtggactgttggtgcaatgccaccgatacgtgggtgacctatggaacatgttccagaaccggcgaacaccggcgcgacaaaagatctgtcgccctggctcctcatgtggggctgggactcgagacacgggccgagacctggatgagctccgaaggcgcttggaagcaaatccagaaggttgagacgtgggccctgcgccaccccggcttcacagtgattgcgctttttctggcccatgctatcgggacctctatcacacagaaaggaattatcttcattctcctgatgcttgtcacccctagcatggccatgagatgcgtgggcatcgggaaccgggattttgttgaaggactgtccggcgctacctgggtggacgtcgtgctcgagcacgggagctgtgtgacaacgatggccaaggataaacccaccctggacattgagctgctcaagacagaagtcaccaaacctgcggttctgcgcaagctttgcatcgaggccaagatttctaatacaaccacggattccagatgtccgacacagggagaagctaccctggtggaggaacaagacgccaacttcgtgtgccggcgcacctttgtcgatagaggctggggcaatgggtgtggactcttcggcaaagggagcctgatcacatgcgctaagtttaaatgcgtgaccaagcttgagggaaaaatcgttcagtacgagaacctgaagtattctgtgattgtcacagtgcacacgggcgaccagcatcaggttgggaatgaaaccacagagcacggaaccatcgccacaattaccccccaagcccctacgtccgaaatccagctcaccgactacggcgctctgacactggattgtagcccccggaccggcctcgacttcaacgagatggtgctgcttacaatgaaagaaaagtcttggctggtccataagcagtggtttctcgatctgcctcttccctggacctccggggcgagcacgccgcaggagacatggaatcgcgaggacctgctcgtgaccttcaaaacagcccacgctaagaaacaagaagtcgtggttctgggatcccaggagggcgccatgcacaccgccctgaccggggctacagaaattcagacgtctggaaccacaaagatctttgccggccatctcaaatgcagactgaagatgaacaagcttaccctgaaagggatgagctatgtgatgtgtacaggctccttcaagctcgagaaagaagtcgcggagacccaacacggaacggtgctggttcaggtgaagtacgagggcacagatgctccttgcaaaatccccttcagcacccaggacgaaaagggggtcacccagaatggacggctgattacagccaaccctatcgtgaccgataaggagaaacccgtgaatattgaagccgagcccccttttggcgagtcttatatcgttgtcggggctggagaaaaggcccttaaactctcctggttcaagaaaggcagctctattgggaagatgctggaggctacagccagaggcgcgcgccggatggccatcctgggagacacggcttgggattttggcagcatcgggggagtgttcacctccgtgggcaagctcgtccatcaaatttttgggacagcctacggagtgctgttctctggcgttagctggaccatgaaaatcgggattggcatccttctgacatggctcggactgaactccagaagcgcttctctgtccatgacctgtattgccgtgggcatggtcacgctttacctcggggtgatggttcaggcggacagcggatgcgtgatcaattggaagggccgcgaactgaaatgtgggtctggaatttttgtcaccaacgaggtgcacacatggaccgaacagtataagttccaggccgattccccgaaacggctgagcgctgccatcggcaaggcttgggaggagggggtttgcggcatcagatccgccacacgcctcgaaaacattatgtggaaacaaatctctaatgagctgaaccatattcttctggaaaatgacatgaagtttaccgtggtcgtgggagacgtgagcggcatcctcacacaggggcggaagatgattggaccccagcctatggagcacaaatactcctggaagtcttggggcaaagccaagatcatcggggctgatgtccagaacaccacgttcattatcgacggacccaatacacctgaatgtcccgatgaccaaagagcgtggaacatttgggaggttgaggattatggctttggcatcttcaccaccaatatttggctgaaactgcgcgacagctacacacaggtgtgcgatccgcggcttatgtccgccgctatcaaggacagcaaggccgtgcacgccgatatggggtattggatcgaatctgagaaaaacgaaacctggaagctcgctagagcctcctttattgaggtcaaaacgtgtgtgtggcctaagagccatacactgtggtctaatggagttctggaatccgagatgatcattcccaaaatctacggcgggcctattagccagcacaactatcgccccggatactctacccagacagcgggcccttggcatctcgggaagctggagcttgacttcgatctgtgcgaaggaaccacagtggtcgtggacgagcactgcggcaatcggggccccagcctcagaaccacgaccgttacagggaagatcatccacgaatggtgttgccggtcctgtaccctgccgcctctgcgcttcaaaggagaggatggctgctggtacgggatggagattagacccgtgaaggacaaagaagagaaccttgtcaagagcctcgtgtctgctggatccggcgaagttgacagcttttccctggggctgctctgtatctctattatgatcgaggaagtgatgcggagcagatggtcccgcaaaatgctgatgacaggaacccttgccgtcttcctgctcctgattatgggccaactgacgtggaatgatcttatccggctgtgcattatggtgggcgccaacgcttctgacagaatggggatgggaacaacctatctcgccctgatggcgacatttaagatgcgccccatgttcgctgtgggcctcctgtttagacggcttaccagccgcgaggtcctgctcctgaccatcgggctgtcccttgttgcctctgtggagctgcctaatagcctcgaagagctgggagatggcctcgccatggggatcatgattctgaagcttctgacagacttccagtcccatcagctctgggctgccctgctgagccttacgtttatcaaaaccacattctctctgcactacgcttggaagaccgtggccatggtcctctccattgtgagcctgtttccgctctgtctgtctacaacctcccaaaaaacgacatggcttcccgttctgctgggaagcctcggctgcaagcctctgaccatgttccttatcgcggaaaacaaaatttggggcagaaagtcttggcccctgaacgaggggatcatggccgtgggaatcgtctccattctcctgagctccctcctgaaaaatgatgtgcctcttgctggccccctgatcgccgggggaatgctgattgcttgttatgttatcagcggctctagcgccgacctctccctggaaaaggccgctgagatttcttgggaggaagaggcggaacatagcggggcctcccacaacatccttgtggaggtccaggatgacggaaccatgaagatcaaagatgaagagcgggacgatacactgaccattctcctgaaggctacactcctggccgtgtctggcgtctaccctatcagcattcccgccacgctttttgtgtggtatttctggcagaaaaagaaacagcgctccggcgttctgtgggacaccccgtctcctcccgaggtggaaagagctgtcctggatgacgggatctaccggattctccaacgcggactgcttggcagaagccaggtgggggttggagtgtttcaggagggcgtcttccatacaatgtggcacgtgacccggggggccgtgctgatgtatcagggaaagcgcctcgaaccttcctgggcgagcgttaagaaagacctgatctcttacggcggcgggtggagattccaaggatcctggaatacaggcgaggaggtccaggtgattgctgtggaacccgggaagaacccgaaaaatgtccagaccgcccctggaacgtttaagacccccgagggcgaagtgggggccatcgctctcgatttcaaacctggaacaagcggctctcccatcgttaaccgggagggcaagattgtggggctgtacggaaatggcgtcgtgaccacatccgggacctatgttagcgccatcgcgcaggctaaggcctcccaagaaggaccccttcctgagattgaggacgaagtgtttagaaaacgcaacctgacaatcatggatctgcacccgggctctgggaagacgcggagatacctccccgccattgtccgcgaggctatcaaacggaagctgagaacccttatcctggcccctacacgcgtggttgctagcgaaatggccgaggcgctcaaaggcatgcccattcggtatcagaccaccgccgtgaagtccgaacatacaggaagagagatcgtcgacctgatgtgccacgctacgttcaccatgcgcctgctcagccctgtgcgggtgcccaattacaacatgattatcatggatgaggcccattttacagaccctgcttctattgccgccagaggctatatctccacccgggtcgggatgggagaagctgcggccatcttcatgacagctaccccgcccggcagcgttgaggcctttcctcagtctaatgccgtgattcaagatgaagagcgcgacatccccgaaagaagctggaactccgggtacgattggattacggacttccctggaaagacagtgtggtttgtcccctctatcaaaagcggcaatgatattgctaactgtcttcggaagaatgggaaacgcgtgatccagctgtccagaaagaccttcgacaccgagtatcagaaaacaaagaacaacgactgggattacgttgtgaccacagacatttctgagatgggcgccaattttcgggcggatagagtcatcgacccgcgccggtgcctgaagcctgtgatcctcaaagatggacccgaaagagttattctggctggccccatgcctgtgaccgtcgccagcgccgctcagcgccgggggagaatcggacgcaaccaaaataaggagggcgaccagtacatttatatggggcagccccttaacaatgatgaagaccacgcccattggacggaggcgaaaatgctgctcgataacatcaatacacctgagggaattatcccggccctgttcgaacccgagcggggcaagtccgctgccatcgacggggaatacagactgcgcggcgaggctagaaaaaccttcgtggaactcatgcggcgcggagatcttcctgtctggctgagctataaggtggcctctgagggctttcagtactccgacagaaaatggtgcttcgatggggagcggaacaatcaagttctggaagagaacatggacgtggaaatttggacaaaggagggagaacgcaagaaactcagaccccggtggctggacgctagaacctatagcgatcctcaggcccttcgcgagtttaaggagttcgcggccggccggagatccgtgtctggggacctgatcctcgaaattggaaaactgccccagcacctgacgcagcgcgctcaaaatgccctcgataaccttgtcatgctgcacaatagcgagcagggcggcaaggcttaccggcatgccatggaagagctgccggacaccatcgaaacactcatgctgcttgccctgattgctgttctcaccgggggagtgacactgtttttcctgtccggcagagggctcggaaaaacctctatcggccttctgtgtgtgatggcgagctccgtcctgctctgggtggccagcgttgagcctcactggatcgctgcctctattatcctggagtttttccttatggtgctgctcattcccgaacctgatcggcagcgcacaccccaggacaaccaactggcctatgtcgtgatcgggctgctctttatgattcttaccgtcgctgccaatgagatgggactgctggaaacgacaaagaaggatctcggcatcggccatgtggcggttgagaaccaccaccatgccaccatgctggacgtggatcttagacctgcttccgcctggaccctgtacgctgtcgccacaaccattatcacacccatgatgcggcacacgatcgagaacaccacagcgaatattagcctcaccgccatcgctaaccaggccgctattctgatggggctggacaaaggatggccgatctctaagatggatattggcgtgcctctccttgccctggggtgctactcccaggttaatcccctgacactcatcgctgccgtgctgatgcttgtcgcgcattatgccatcattggacccggcctgcaagctaaagccacccgcgaagctcagaagagaacggccgccgggatcatgaaaaaccctaccgtggacggaattgtggcgatcgatctcgacccggttgtctacgacgctaagttcgagaagcagctgggccagattatgctgctcatcctttgtacaagccaaatcctgctgatgcggaccacatgggccctctgcgaatctattaccctggctacgggcccccttacaaccctgtgggaggggagccctggaaaattttggaatacaaccatcgccgtgtccatggccaacattttccgcggctcttatctcgctggggccggactggcgtttagcctgatgaagtccctcggcgggggaagacggggcaccggcgcccagggggaaacacttggagagaaatggaagcgccagctgaatcagctgagcaaatccgagttcaacacgtacaagagatctggcatcatggaagtggatcggagcgaggctaaggaagggctcaaaagaggagagaccacaaagcacgccgtctcccgcggcaccgctaaactgcggtggttcgttgaaagaaatcttgtgaagcccgaggggaaagtgattgacctgggatgtggccgcggcgggtggtcttattactgcgccggactcaagaaagtcacagaggtgaagggctataccaaggggggacctggccatgaagagcccatccctatggcgacgtacgggtggaacctggttaaactgcacagcggaaaggatgtgtttttcacaccgcccgaaaaatgtgacaccctcctttgcgatattggcgagtcctctcctaatcccaccatcgaagagggccggacactgagagtcctgaagatggtggagccttggctccgcgggaaccaattttgtatcaaaattctgaatccctacatgccgagcgttgtggaaacccttgagcagatgcagcggaagcacggaggcatgctggtcagaaaccctctctcccgcaatagcacacatgaaatgtattgggtgtcttgcgggacgggaaacatcgtgtccgccgtcaatatgaccagccggatgctgctgaacagattcacaatggctcaccgcaagcccacctacgagcgggacgttgatctcggcgccgggacaagacatgtggctgtggagcccgaagtcgccaacctggacattatcggacagcgcattgagaatatcaaaaacgaacacaagtctacctggcactatgatgaggacaatccttacaaaacgtgggcttatcatggctcctacgaagtgaagcccagcggctctgcctccagcatggttaacggggtggtcagacttctgaccaaaccttgggatgtgatcccgatggttacacaaattgcgatgaccgacacaaccccctttggacagcagcgggtgttcaaggagaaggtcgacacacgcacccctaaagccaagagaggcacggctcaaatcatggaggtgacagcccggtggctctgggggtttctgtccagaaataaaaagccccggatttgtacccgcgaagagttcaccagaaaagttcggagcaacgctgccatcggagccgtgtttgtcgatgaaaatcagtggaactctgcgaaggaggctgtggaagacgagcgcttctgggatcttgtccacagagagcgggaactgcataagcagggcaaatgcgccacatgcgtgtataatatgatggggaagcgcgagaaaaagctcggcgaatttggaaaagccaagggcagcagagctatttggtacatgtggctgggggcccggttcctggagtttgaagctctcggattcatgaacgaggaccactggttctcccgcgagaattctctgagcggcgttgaaggggagggacttcataaactgggctacatcctcagagatatctccaagattcctgggggcaacatgtatgccgacgatacggcgggatgggacacccggatcacagaagatgacctgcagaatgaggccaagattaccgatatcatggagcccgaacacgctcttctggccacatctatttttaaactcacctaccaaaacaaggtggtccgcgtgcagagaccggctaaaaatggcacagtgatggacgttatcagccggcgcgatcagagagggtccggacaggtgggcacctatgggctgaacacgttcaccaacatggaggtccaactgatccggcagatggaatctgagggaatttttagcccttccgaactcgagacacccaatctggccgagagagtgcttgactggctggaaaagcacggcgttgagcgcctcaaacggatggcgatcagcggggacgattgtgtggtcaagcctaccgacgatagattcgccacagctctgaccgcccttaacgacatgggcaaggtgcgcaaagatattccccagtgggaaccttctaagggatggaatgactggcagcaagtccccttttgctcccatcacttccatcagctgatcatgaaagatggccgggagattgtggttccgtgtagaaaccaggacgaactcgtggggcgcgctcgggtcagccagggagccggctggtctctgagagagacggcttgcctggggaagtcctacgcccaaatgtggcagctcatgtattttcaccgccgggatctgagacttgcggccaatgctatctgtagcgccgtgcctattgactgggttcccacatcccgcaccacatggtctatccacgcccatcaccagtggatgaccacggaggatatgctgagcgtgtggaaccgggtctggatcgaagagaatccctggatggaagacaaaacccatgtgtccagctgggaggacgtgccttacctcggaaagagagaagatcaatggtgcggctctctgattgggcttacagctcgggccacctgggcgacaaacatccaggttgctattaatcaggtcagacgcctgatcggcaacgagaattatctcgactacatgacctccatgaagcggttcaaaaacgagagcgatctggaaggagccctgtggtga

SEQ ID NO: 19496 - RNA, 9879 nt, synthetic construct
  misc_feature 1..9879: note = derived and/or modified CDS sequence (opt5) from DENV-1__KR024708__SS-prME
  source 1..9879: mol_type = other RNA
tccgtgaccatgctgctcatgctgcttcccacagccctggctttccacctcacgaccagaggcggggaacctcatatgattgtctccaagcaggaacggggaaaatctctgctttttaagacaagcgccggcgttaacatgtgcaccctgattgcgatggacctcggggaactgtgtgaagatacaatgacctacaaatgcccgcgcatcacagaagctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaaggggtgtcctatgtcatgtgtacgggcagcttcaagctggagaaggaagtggccgagacacagcacggaaccgttcttgtgcaggtcaaatacgagggcaccgatgcgccgtgcaagattcctatctctacacaagacgaaaaaggggtgacccagaacggaagactcatcacagctaatcccattgtgacggataaggagaaacctgttaacatcgaaaccgagccgcccttcggcgagtcctatattgtcatcggggccggagaaaaggccctgaagctgagctggtttaaaaagggctctagcattgggaaaatgttcgaggctacagcccggggcgctagacgcatggccatcctcggagacaccgcgtgggattttggctccatcgggggagtgttcacatctgtgggcaagctggtccatcaggtgtttgggaccgcctacggagttcttttcagcggcgtgtcctggacgatgaaaattgggatcggcattctgctcacctggctgggactgaatagccggtctacatcccttagcatgacctgtatcgctgtcggcatggtgacactctacctgggggttatggtgcaggccgactctggatgcgtcattaactggaagggcagagaactgaagtgtgggtccggaatctttgtgaccaacgaggttcacacatggaccgaacaatataaattccaggctgatagccctaagcgcctctccgccgcgattggcaaagcctgggaggagggggtgtgcggcatccggtctgctacgagactggaaaatatcatgtggaagcagattagcaacgagcttaatcatatcctgctcgaaaacgacatgaaatttacagtcgtggtgggagacgccaatggcattctgacccaggggaagaaaatgatccgcccgcaacccatggagcacaagtactcctggaagtcttggggaaaagctaagattatcggcgccgatacccagaacacaaccttcatcattgacgggcctgatacgcccgaatgtcctgacgatcagcgggcctggaatatctgggaggtcgaggactatggatttggcgttttcacaaccaacatttggctgaaacttagagatagctacacacagatgtgcgaccaccgcctcatgtccgctgcgatcaaggatagcaaagccgtgcatgctgacatgggctattggattgaatctgagaagaatgaaacctggaagctggcccgggcctcctttatcgaggtgaaaacatgtatctggcccagaagccacaccctgtggtctaacggggtcctcgaatccgagatgattatcccgaagatttacggaggccctatcagccaacataattatcgccccgggtacttcacgcagaccgctggaccttggcacctgggcaaacttgagctggatttcaacctctgcgaagggacaaccgtggttgtggacgagcactgcggaaatcggggcccctctctgagaacaaccacggtcacaggcaagattatccatgaatggtgttgccggagctgtaccctgcctccccttcgctttagaggggaggatggatgctggtacggcatggagatccggccggtgaaagaaaaggaggaaaacctcgttagatccatggtgagcgccgggtctggagaggtcgactccttcagcctgggcctgctctgtgtgtccattatgatcgaagaggttatgcgctctcggtggagcagaaagatgctgatgacagggacccttgcggtgtttttcctgctcattatgggacagctgacctggaatgacctgatccgcctttgcattatggtcggcgctaacgtgtccgatagaatgggcatggggacaacgtatctggccctcatggccacctttaaaatgcggcctatgttcgctgtgggactgctctttcgcagactgacatctcgggaggtccttctgctcaccatcggcctgagcctggttgcctccgtggaacttcccaactctctggaggaactcggggacggactggcgatgggcattatgatgctcaagctgcttacagatttccaaagccaccagctgtggaccacgctcctgtccctgacatttatcaaaaccacccttagcctggactacgcttggaagacaatggccatggtgctctctatcgtctccctgttccccctctgtctgagcaccacatctcagaaaacgacctggcttcctgtgctgctggggtcctttggatgcaagccgctcacaatgttcctgattaccgagaataagatctggggccgcaaaagctggccccttaacgaaggcattatggccgttgggatcgtgtctattctgctctccagcctgctcaagaatgatgtccctctggctggaccccttatcgccggcgggatgctgatcgcttgttatgtgatttccggaagctctgccgacctgagcctcgagagagcggccgaggtttcctgggaagaggaagctgagcattctggcgccagccacaacatcctggtggaagtccaggatgacgggacaatgaaaattaaggatgaggagcgggacgatacccttacgatcctgctcaaagctaccctgctcgccgtgtccggagtctaccctatgtctattcccgccacactgtttgtgtggtatttctggcaaaagaaaaagcagcgcagcggcgttctttgggacacccctagccctcccgaagtggagagagctgtcctggatgacggcatctaccggatcctgcagcgcgggctcctgggaagatctcaggtgggcgttggggtgttccaagacggagtctttcatacaatgtggcacgtgacccggggcgcggtgcttatgtatcaggggaagagactggaacccagctgggcctccgttaaaaaggatctcattagctacggaggcggctggcgcttccaggggtcttggaatacaggagaggaggtccaggtgatcgctgtggaacccggcaaaaaccctaagaatgtccaaacgacccccgggacatttaaaaccccggagggagaagtgggcgccattgccctggacttcaagcctgggacctccggaagccccatcgttaaccgggagggcaagattgtgggcctctacgggaatggagtcgtgacaacgtctggcacctatgtttccgctatcgcccaggcgaaagctagccaggaagggcctctgcccgagattgaggatgaagtgtttaagaaaagaaaccttacaatcatggacctgcaccccggatccggcaagacccgccggtacctgcctgccatcgtcagagaggccattaaacgcaagctccggacactgatccttgctccgaccagagtggttgcctctgaaatggcggaggctctgaaggggatgcccattcgctatcaaacgacagccgtgaaaagcgaacataccggcaaggagatcgtcgatctcatgtgccacgccaccttcacaatgcggctgctgtcccctgtgagagtgcccaattacaacatgattatcatggacgaggctcattttaccgatcctgccagcatcgctgcccggggatatatttctacacgcgtcggcatgggggaagcggccgctatcttcatgaccgccacgccccctggatccgttgagagctttccgcagtctaatgctgtgattcaggacgaagagagagatatccccgaacggagctggaactccggctacgactggattacagatttccctgggaaaaccgtgtggtttgtcccctctatcaagagcggaaatgacatcgccaactgtctccgcaaaaacggcaagagagtgattcagctttcccggaagacattcgacaccgagtatcagaagacgaagaataacgattgggactacgttgtgaccacagatatctctgagatgggggccaatttcagagctgaccgcgtcattgatcctcggagatgcctgaaacccgtgatcctgaaggacggcccggaacgcgttattctcgcgggacctatgcccgtgaccgccgctagcgccgcccagcggagaggccgcatcgggcggaaccagaataaagagggagatcagtacatttatatgggccaacccctgaacaatgacgaagatcacgctcattggacagaggccaagatgcttctggacaacatcaatacccctgaggggatcattcccgcgctctttgaacctgagagagaaaagtccgctgccatcgatggagagtaccgcctgagaggcgaagcccggaaaacattcgtcgagctgatgcgcagaggggacctcccggtgtggcttagctataaggtcgcttctgagggctttcagtactccgatcggcgctggtgcttcgacggagaaagaaacaatcaggtgctggaggaaaacatggacgttgagatttggaccaaagaaggcgagcggaagaaactgagaccccgctggctcgatgcccggacgtatagcgaccctctggcgcttagagagtttaaggagttcgccgctgggcgccggtccgtgtctggagatctgatcctcgagattggcaaactgccccagcacctgacactcagagcccaaaatgctcttgacaacctggtgatgctgcacaatagcgaacaagggggaaaggcctaccggcatgctatggaggaactccctgataccatcgagaccctgatgcttctggccctcatcgcggtcctgacaggcggcgttaccctgtttttcctctccgggaagggacttggcaaaacatctattgggctgctgtgtgtgatggccagctccgtgctcctgtggatggctagcgtcgagccccactggatcgccgcttctattatccttgaatttttcctgatggtgctcctgattccggagcctgaccgccagagaacgccccaggataaccaactggcctatgttgtgatcggactcctttttatgatcctgaccgtcgccgctaacgaaatgggcctgctcgagacaaccaagaaagacctggggattggacatgtggtcgcggagaatcaccaccatgccacaatgcttgatatcgacctgcaccctgcttccgcctggaccctctacgccgtggctacgaccattatcacacccatgatgcggcataccattgaaaacacaaccgccaatatcagcctgacggcgattgccaaccaggctgccatcctgatgggcctcgataagggctggcctatctctaaaatggacattggggttccccttctggctctgggatgctactcccaggtgaatccgctcacactgaccgccgcggtccttatgctggtggcccactatgctatcattggccctgggctccaagccaaggctacacgcgaggcccagaagagaaccgctgccggaatcatgaaaaaccccaccgttgatggcattgtggcgatcgacctggaccccgtcgtgtacgatgccaagttcgaaaaacagctggggcagatcatgctccttattctgtgtacaagccaaatcctgctcatgcggacgacctgggctctgtgcgagtctattacacttgccaccggacctctgacaaccctctgggaaggcagcccgggcaagttttggaatacgacaatcgctgtgtccatggccaacattttccgcgggtcttatctggccggagcgggcctggctttcagcctcatgaaatcccttgggggaggcagacgggggaccggagcccagggcgagaccctgggcgagaagtggaagcgccagctgaatcagctcagcaaatccgaatttaacacatacaagagatctgggatcatggaggttgaccggagcgaagctaaagagggactgaagagaggcgaaaccacaaaacatgccgtctcccgcgggacggccaaacttcggtggttcgtggagagaaatctggtgaagcccgagggaaaagtcatcgatctcggctgtgggcgcggaggctggtcttattactgcgctggcctgaagaaagttaccgaagtgaaggggtatacaaaaggaggccctgggcacgaggaacccattcctatggccacctacggatggaacatcgtgaagctgcacagcggccgggacgtctttttcacaccccctgagaaatgtgataccctcctttgcgacattggggaatcctctccgaatcccacgatcgaggagggaagaaccctgcgcgtgctgaagatggttgaaccttggctccggggcaaccaattttgtattaagatcctgaatccctacatgcctagcgtggtcgagacacttgaacagatgcagagaaaacatggcgggatgctggtgcgcaaccccctctcccggaatagcacccacgagatgtattgggtttcttgcggaacaggcaacattgtgtccgcggtcaacatgaccagcagaatgctgctgaatcgcttcacaatggcccatcggaagccgacctacgagagagatgtggacctcggggctggaacgcgccacgtggccgtcgaacctgagatcgctaacctggatatcattggccagagaatcgaaaatattaaaaacgagcacaagtctacatggcattatgacgaagataatccctacaaaacctgggcctatcacgggtcctacgaggttaagcccagcggatctgcgtccagcatggtgaacggcgtggtccggcttctgaccaagccttgggacgtgatccccatggttacacaaattgccatgacggacaccacaccttttggccagcagcgcgtgttcaaagagaaggtcgataccagaacaccgcggcccaaaagagggaccgctcaaatcatggaagtgacagccaagtggctctggggatttctgtcccggaataaaaagcctcgcatctgtaccagagaggagttcacgcggaaggttcgcagcaacgctgccattggcgctgtgtttgtcgacgagaatcagtggaactctgccaaagaagcggtggaggatgagagattctgggaccttgttcatcgggaacgcgagctgcacaagcaggggaaatgcgctacctgcgtgtataatatgatgggaaagagagagaaaaagctcggcgagtttgggaaggctaaaggcagccgggccatctggtacatgtggctgggagctcgcttcctggagttcgaggccctcggctttatgaacgaggatcattggttctccagagaaaattctctgagcggggtcgagggagaaggccttcacaagctggggtacattctccgggacatctccaaaattcccggaggcaacatgtatgccgatgacacagcggggtgggatacccgcatcacagaggacgatctgcagaatgaggctaagatcaccgacattatggaacctgagcacgcccttctggccacgtctatctttaaactcacataccaaaacaaggtggtcagagtgcagcggcccgctaaaagcggcaccgttatggatgtgatttcccgcagagaccagcggggatctggccaggtcgggacatatggactgaacaccttcacgaatatggaagtgcaactgatcagacagatggagagcgaaggcatcttttccccgagcgagctcgagaactctaatctggccgaacgcgtgcttgactggctggagaagcatggggttgaacggctcaagagaatggctatctccggagatgactgtgtggtcaaacctaccgatgaccgcttcgccacagcgctgaccgcccttaacgatatgggcaaggtgcggaaagacatcccccagtgggagcctagcaaggggtggaatgattggcagcaagttcccttttgctctcaccatttccaccagctgattatgaaagacggcagagaaatcgtggtcccttgtcgcaaccaggatgagctcgtgggacgggctagagtctcccagggcgccgggtggagcctgcgcgagacagcttgcctgggaaagtcctacgcccaaatgtggcagctcatgtattttcaccggagagacctgcgccttgcggccaatgctatttgttctgccgtgcccgttaactgggtgccgaccagccggacaacctggtccatccatgctcaccatcagtggatgacgacagaagatatgctgagcgtctggaatagagtgtggattgaggaaaacccttggatggaggacaagacccacgtttcttcctgggaagacgtgccctacctcggcaaacgggaggatcaatggtgcgggagcctgatcggacttaccgccagagctacatgggccaccaatattcaggtcgcgatcaaccaggtgcgccggctgatcggcaatgagaactatctcgactacatgacatctatgaagagattcaaaaatgaaagcgatcccgagggggccctgtggtga

SEQ ID NO: 19497 - RNA, 9879 nt, synthetic construct
  misc_feature 1..9879: note = derived and/or modified CDS sequence (opt5) from DENV-1__KR024705__SS-prME
  source 1..9879: mol_type = other RNA
tccgtgaccatgctgctcatgctgcttcccaccgctctggctttccacctcacgacccggggcggggaacctcatatgatcgtctccaagcaggaacggggaaaatctctgctttttaagacaagcgctggcgttaacatgtgcaccctgattgcgatggacctcggggaactgtgtgaagataccatgacctacaaatgcccgcgcatcaccgaagctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaatgccaccacggactcccgctgtccgacacaaggagaggctaccctcgtggaagaacaagatgccaacttcgtgtgcagacggacctttgtcgaccgcggctggggcaatgggtgtggactgttcggcaaggggagccttctgacatgcgctaagtttaaatgcgtgaccaagctcgagggaaaaattgttcagtacgaaaacctgaagtattctgtgatcgtcacagtgcacacgggcgatcagcatcaagttgggaatgagaccacagaacacggaaccatcgccacaattacaccccaggcccctacgtccgagatccagctgaccgactacggcgctctcacactggactgtagccccagaaccggccttgatttcaacgaaatggtgctgctcacaatgaaagagaagtcttggctggtccataaacagtggtttcttgacctgcctctcccctggacctccggggcgagcacgtcccaagagacatggaatcggcaggatctgctggtgaccttcaagacagcccacgctaagaaacaggaagtcgtggttctcggatctcaagagggcgccatgcacaccgccctgaccggggctacagaaattcagacgagcggaaccacaaccatctttgccggccatcttaagtgccgcctgaaaatggacaagctcacactgaaaggggtgtcctatgtcatgtgtaccggcagcttcaagctggagaaggaagtggcggagacgcagcacggaacagttcttgtgcaggtcaaatacgagggcaccgatgctccgtgcaagattcctatctctacccaagacgaaaaaggggtgacacagaacggaagactcatcaccgccaatcccattgtgacagataaggagaaacctgttaacatcgaaacggagccgcccttcggcgagtcctatattgtcatcggggccggagaaaaggctctgaagctgagctggtttaaaaagggctctagcattgggaaaatgttcgaggccaccgctcggggcgccagacgcatggcgatcctcggagacacagcctgggattttggctccatcgggggagtgttcacctctgtgggcaagctggtccatcaggtgtttgggacagcttacggagttcttttcagcggcgtgtcctggaccatgaaaattgggatcggcattctgctcacgtggctgggactgaatagccggtctacctcccttagcatgacatgtatcgccgtcggcatggtgaccctctacctgggggttatggtgcaggctgactctggatgcgtcattaactggaagggcagagaactgaagtgtgggtccggaatctttgtgacaaacgaggttcacacctggacagaacaatataaattccaggccgatagccctaagcgcctctccgcggccattggcaaggcttgggaggagggggtgtgcggcatccggtctgccaccagactggaaaatatcatgtggaagcagattagcaacgagcttaatcatatcctgctcgaaaacgacatgaaatttacggtcgtggtgggagacgctaatggcattctgacacaggggaagaaaatgatccgcccgcaacccatggagcacaagtactcctggaagtcttggggaaaagccaagattatcggcgccgatacccagaacaccacattcatcattgacgggcctgatacccccgaatgtcctgacgatcagcgggcttggaatatctgggaggtcgaggactatggatttggcgttttcacgacaaacatttggctgaaacttagagatagctacacccagatgtgcgaccaccgcctcatgtccgcggccatcaaggatagcaaagctgtgcatgccgacatgggctattggattgaatctgagaagaatgaaacatggaagctggcccgggcttcctttatcgaggtgaaaacctgtatctggcccagaagccacacactgtggtctaacggggtcctcgaatccgagatgattatcccgaagatttacggaggccctatcagccaacataattatcgccccgggtacttcacccagacggccggaccttggcacctgggcaaacttgagctggatttcaacctctgcgaagggaccacagtggttgtggacgagcactgcggaaatcggggcccctctctgagaaccacaaccgtcacgggcaagattatccatgaatggtgttgccggagctgtacactgcctccccttcgctttagaggggaggatggatgctggtacggcatggagatccggccggtgaaagaaaaggaggaaaacctcgttagatccatggtgagcgcggggtctggagaggtcgactccttcagcctgggcctgctctgtgtgtccattatgatcgaagaggttatgcgctctcggtggagcagaaagatgctgatgaccgggacacttgctgtgtttttcctgctcattatgggacagctgacctggaatgacctgatccgcctttgcattatggtcggcgccaacgtgtccgatagaatgggcatggggaccacatatctggccctcatggctacgtttaaaatgcggcctatgttcgccgtgggactgctctttcgcagactgacctctcgggaggtccttctgctcacaatcggcctgagcctggttgcgtccgtggaacttcccaactctctggaggaactcggggacggactggctatgggcattatgatgctcaagctgcttaccgatttccaaagccaccagctgtggacaaccctcctgtccctgacgtttatcaaaacaacccttagcctggactacgcctggaagaccatggccatggtgctctctatcgtctccctgttccccctctgtctgagcacaacctctcagaaaacaacgtggcttcctgtgctgctggggtcctttggatgcaagccgctcaccatgttcctgattacagagaataagatctggggccgcaaaagctggccccttaacgaaggcattatggctgttgggatcgtgtctattctgctctccagcctgctcaagaatgatgtccctctggccggaccccttatcgctggcgggatgctgatcgcctgttatgtgatttccggaagctctgcggacctgagcctcgagagagccgctgaggtttcctgggaagaggaagccgagcattctggcgctagccacaacatcctggtggaagtccaggatgacgggaccatgaaaattaaggatgaggagcgggacgatacacttaccatcctgctcaaagccacgctgctcgccgtgtccggagtctaccctatgtctattcccgctaccctgtttgtgtggtatttctggcaaaagaaaaagcagcgcagcggcgttctttgggacacacctagccctcccgaagtggagagagcggtcctggatgacggcatctaccggatcctgcagcgcgggctcctgggaagatctcaggtgggcgttggggtgttccaagacggagtctttcataccatgtggcacgtgacacggggcgccgtgcttatgtatcaggggaagagactggaacccagctgggcttccgttaaaaaggatctcattagctacggaggcggctggcgcttccaggggtcttggaataccggagaggaggtccaggtgatcgccgtggaacccggcaaaaaccctaagaatgtccaaacaacgcccgggacctttaaaacaccggagggagaagtgggcgccattgctctggacttcaagcctgggacctccggaagccccatcgttaaccgggagggcaagattgtgggcctctacgggaatggagtcgtgaccacatctggcacgtatgtttccgccatcgcgcaggctaaagccagccaggaagggcctctgcccgagattgaggatgaagtgtttaagaaaagaaaccttaccatcatggacctgcaccccggatccggcaagacacgccggtacctgcctgccatcgtcagagaggctattaaacgcaagctccggaccctgatccttgccccgacaagagtggttgcgtctgaaatggctgaggccctgaaggggatgcccattcgctatcaaaccacggccgtgaaaagcgaacatacaggcaaggagatcgtcgatctcatgtgccacgctaccttcaccatgcggctgctgtcccctgtgagagtgcccaattacaacatgattatcatggacgaggcccattttacagatcctgctagcatcgccgcgcggggatatatttctacccgcgtcggcatgggggaagccgctgccatcttcatgacagctacaccccctggatccgttgaggcctttccgcagagcaatgccgtgattcaggacgaagagagagatatccccgaacggtcttggaacagcggctacgactggattacggatttccctgggaaaacagtgtggtttgtcccctccatcaagtctggaaatgacatcgctaactgtctccgcaaaaacggcaagagagtgattcagcttagccggaagaccttcgacacagagtatcagaaaaccaagaataacgattgggactacgttgtgacgaccgatatctccgagatgggggcgaatttcagagccgaccgcgtcattgatcctcggagatgcctgaaacccgtgatcctgaaggacggcccggaacgcgttattctcgctggacctatgcccgtgacagccgcctctgctgcccagcggagaggccgcatcgggcggaaccagaataaagagggagatcagtacatttatatgggccaacccctgaacaatgacgaagatcacgcgcattggaccgaggctaagatgcttctggacaacatcaatacacctgaggggatcattcccgccctctttgaacctgagagagaaaagagcgccgctatcgatggagagtaccgcctgagaggcgaagcccggaaaaccttcgtcgagctgatgcgcagaggggacctcccggtgtggctttcctataaggtcgcgagcgagggctttcagtactctgatcggcgctggtgcttcgacggagaaagaaacaatcaggtgctggaggaaaacatggacgttgagatttggacaaaagaaggcgagcggaagaaactgagaccccgctggctcgatgcccggacctattccgaccctctggctcttagagagtttaaggagttcgccgctgggcgccggagcgtgtccggagatctgatcctcgagattggcaaactgccccagcacctgacgctcagagcccaaaatgctcttgacaacctggtgatgctgcacaattctgaacaagggggaaaggcctaccggcatgcgatggaggaactccctgatacaatcgagaccctgatgcttctggccctcatcgctgtcctgaccggcggcgttacactgtttttcctcagcgggaagggacttggcaaaacctccattgggctgctgtgtgtgatggcctctagcgtgctcctgtggatggcttccgtcgagccccactggatcgccgccagcattatccttgaatttttcctgatggtgctcctgattccggagcctgaccgccagagaacaccccaggataaccaactggcttatgttgtgatcggactcctttttatgatcctgacggtcgcggccaacgaaatgggcctgctcgagaccacaaagaaagacctggggattggacatgtggtcgctgagaatcaccaccatgccaccatgcttgatatcgacctgcaccctgcctctgcttggacactctacgccgtggcgaccacgattatcacccccatgatgcggcatacaattgaaaacaccacagccaatatctccctgaccgctattgccaaccaggctgccatcctgatgggcctcgataagggctggcctatcagcaaaatggacattggggttccccttctggcgctgggatgctactctcaggtgaatccgctcacgctgacagccgctgtccttatgctggtggcccactatgctatcattggccctgggctccaagccaaggctacccgcgaggcccagaagagaacagcggccggaatcatgaaaaaccccaccgttgatggcattgtggctatcgacctggaccccgtcgtgtacgatgccaagttcgaaaaacagctggggcagatcatgctccttattctgtgtacctcccaaatcctgctcatgcggacaacgtgggctctgtgcgagagcattacccttgccacaggacctctgaccacactctgggaaggctctccgggcaagttttggaataccacgatcgccgtgagcatggcgaacattttccgcgggtcctatctggctggagccggcctggctttctctctcatgaaaagccttgggggaggcagacgggggacaggagcccagggcgagaccctgggcgagaagtggaagcgccagctgaatcagctctccaaaagcgaatttaacacctacaagagatccgggatcatggaggttgaccggtctgaagccaaagagggactgaagagaggcgaaacaaccaaacatgctgtcagccgcgggacagccaaacttcggtggttcgtggagagaaatctggtgaagcccgagggaaaagtcatcgatctcggctgtgggcgcggaggctggtcctattactgcgcgggcctgaagaaagttacggaagtgaaggggtataccaaaggaggccctgggcacgaggaacccattcctatggccacatacggatggaacatcgtgaagctgcactctggccgggacgtctttttcacaccccctgagaaatgtgatacactcctttgcgacattggggaaagctccccgaatcccaccatcgaggagggaagaacgctgcgcgtgctgaagatggttgaaccttggctccggggcaaccaattttgtattaagatcctgaatccctacatgccttctgtggtcgagacccttgaacagatgcagagaaaacatggcgggatgctggtgcgcaaccccctcagcagaaattccacacacgagatgtattgggttagctgcggaaccggcaacattgtgtctgctgtcaacatgacatccagaatgctgctgaatcgcttcaccatggcccatcggaagccgacatacgagagagatgtggacctcggggctggaacccgccacgtggccgtcgaacctgagatcgcgaacctggatatcattggccagagaatcgaaaatattaaaaacgagcacaagagcacgtggcattatgacgaagataatccctacaaaacatgggcctatcacgggtcttacgaggttaagccctccggaagcgcttcttccatggtgaacggcgtggtccggcttctgaccaagccttgggacgtgatccccatggttacccaaattgccatgacagacacgaccccttttggccagcagcgcgtgttcaaagagaaggtcgatacaagaaccccgcggcccaaaagagggacagctcaaatcatggaagtgaccgccaagtggctctggggatttctgagccggaataaaaagcctcgcatctgtacaagagaggagttcacccggaaggttcgctccaacgctgccattggcgcggtgtttgtcgacgagaatcagtggaacagcgccaaagaagctgtggaggatgagagattctgggaccttgttcatcgggaacgcgagctgcacaagcaggggaaatgcgccacgtgcgtgtataatatgatgggaaagagagagaaaaagctcggcgagtttgggaaggctaaaggctctcgggccatctggtacatgtggctgggagcccgcttcctggagttcgaggcgctcggctttatgaacgaggatcattggttcagcagagaaaattccctgtctggggtcgagggagaaggccttcacaagctggggtacattctccgggacatcagcaaaattcccggaggcaacatgtatgctgatgacaccgccgggtgggatacacgcatcaccgaggacgatctgcagaatgaggccaagatcacagacattatggaacctgagcacgcccttctggccacctccatctttaaactcacgtaccaaaacaaggtggtcagagtgcagcggcccgctaaatctggcacagttatggatgtgattagccgcagagaccagcggggatccggccaggtcgggacctatggactgaacacattcaccaatatggaagtgcaactgatcagacagatggagtctgaaggcatttttagcccgtccgagctcgagaacagcaatctggccgaacgcgtgcttgactggctggagaagcatggggttgaacggctcaagagaatggcgatctctggagatgactgtgtggtcaaacctacggatgaccgcttcgccaccgctctgacagcccttaacgatatgggcaaggtgcggaaagacatcccccagtgggagccttccaaggggtggaatgattggcagcaagttcccttttgcagccaccatttccaccagctgattatgaaagacggcagagaaatcgtggtcccttgtcgcaaccaggatgagctcgtgggacgggctagagtctctcagggcgccgggtggtccctgcgcgagaccgcgtgcctgggaaagagctacgcccaaatgtggcagctcatgtattttcaccggagagacctgcgccttgctgccaatgctatttgttccgccgtgcccgttaactgggtgccgacatctcggaccacatggagcatccatgctcaccatcagtggatgaccacggaagatatgctgtccgtctggaatagagtgtggattgaggaaaacccttggatggaggacaagacacacgttagctcttgggaagacgtgccctacctcggcaaacgggaggatcaatggtgcgggtccctgatcggacttaccgccagagcgacctgggccacaaatattcaggtcgctatcaaccaggtgcgccggctgatcggcaatgagaactatctcgactacatgaccagcatgaagagattcaaaaatgaatctgatcccgagggggccctgtggtga

SEQ ID NO: 19498 - RNA, 9879 nt, synthetic construct
  misc_feature 1..9879: note = derived and/or modified CDS sequence (opt5) from DENV-1__KR024706__SS-prME
  source 1..9879: mol_type = other RNA
agcgtgaccatgctgctcatgctgcttcccacagctctggctttccacctcacgaccagaggaggggagcctcatatgatcgtgtccaagcaggaacggggaaaatctctgctttttaagacaagcgccggcgttaacatgtgcaccctgattgcgatggacctcggggagctgtgtgaagatacaatgacctacaaatgcccgcgcatcacaggagctgagcccgacgatgtggactgttggtgcaatgccaccgatacgtgggtgacctatggcacatgttcccaaaccggggaacacagacgggacaagcgctctgtcgccctggctcctcatgtgggactcggcctggagacaagaaccgagacgtggatgagctccgaaggcgcctggcggcaaattcagaaagttgagacatgggcccttcgccaccccgggttcaccgtgatcgcctttttcctggcgcatgccattggaacatctatcacccagaagggcatcatttttatcctcctgatgcttgtcacccctagcatggctatgagatgcgtggggattggaaaccgggatttcgttgaaggcctgtccggggccacatgggtggacgtcgtgctcgagcacggaagctgtgtgacgaccatggctaagaataaacccacactggatatcgagctgctcaagaccgaagtcacaaaccctgccgttctgcgcaaactttgcattgaggcgaagatctctaataccacgacagactccagatgtccgacccaaggcgaagccaccctggtggaggaacaggatgctaactttgtgtgccggcgcacactcgtcgacagaggctgggggaatggatgtggcctgttcgggaaaggaagccttctgacctgcgccaagtttaagtgcgtgacaaaactcgagggcaagattgttcagtacgagaacctgaaatattctgtgatcgtcacggtgcacaccggggatcagcatcaagttggaaatgaaacaaccgagcacggcacaatcgctaccattacgccccaggcccctacctccgaaatccagctgacagactacggcgccctcaccctggactgtagcccccggacagggcttgatttcaacgagatggtgctgctcaccatgaaggaaaaatcttggctggtccataagcagtggtttcttgacctgcctctcccctggacgtccggagctagcacatcccaagagacctggaatcgccaggatctgctggtgacattcaaaaccgcgcacgccaagaagcaggaggtcgtggttctcggctctcaagaaggggctatgcacaccgccctgacaggagccacggagattcagaccagcggcacaaccacaatctttgctgggcatcttaaatgcagactgaagatggacaaactcaccctgaagggcgtgtcctatgtcatgtgtacggggtccttcaaactggaaaaggaggtggccgaaacacagcacggcaccgttcttgtgcaggtcaagtacgaggggaccgatgcgccgtgcaaaattcctatctctacacaagacgagaagggagtgacccagaacggccggctcatcacagctaatcccattgtgacggataaagaaaagcctgttaacatcgagaccgaaccgcccttcggggagtcctatattgtcatcggagccggcgagaaagccctgaagctgagctggtttaagaaagggtctagcattggcaagatgttcgaagctacagccagaggagctcgccggatggccatcctcggcgacaccgcgtgggattttgggtccatcggaggcgtgttcacatctgtggggaaactggtccatcaggtgtttggaaccgcctacggcgttcttttcagcggggtgtcctggacgatgaagattggcatcggcattctgctcacctggctgggcctgaatagcagatctacatcccttagcatgacctgtatcgctgtcgggatggtgacactctacctgggagttatggtgcaggccgactctggctgcgtcattaactggaaagggcgcgagctgaagtgtggatccggcatctttgtgaccaacgaagttcacacatggaccgagcaatataagttccaggctgatagccctaaacggctctccgccgcgattgggaaggcctgggaagagggcgtgtgcggaatcagatctgctacgcgcctggagaatatcatgtggaaacagattagcaacgaacttaatcatatcctgctcgagaacgacatgaagtttacagtcgtggtgggcgacgccaatgggattctgacccagggcaagaagatgatccggccgcaacccatggaacacaaatactcctggaagtcttggggcaaggctaaaattatcggggccgatacccagaacacaaccttcatcattgacggacctgatacgcccgagtgtcctgacgatcagagagcctggaatatctgggaagtcgaggactatggctttggcgttttcacaaccaacatttggctgaaacttcgcgatagctacacacagatgtgcgaccaccggctcatgtccgctgcgatcaaagatagcaaggccgtgcatgctgacatggggtattggattgagtctgagaagaatgagacctggaagctggccagagcctcctttatcgaagtgaagacatgtatctggccccgcagccacaccctgtggtctaacggagtcctcgagtccgaaatgattatcccgaaaatttacggcgggcctatcagccaacataattatcggcccggatacttcacgcagaccgctggcccttggcacctggggaaacttgagctggatttcaacctctgcgagggaacaaccgtggttgtggacgaacactgcggcaatagaggcccctctctgcggacaaccacggtcacagggaaaattatccatgagtggtgttgccgcagctgtaccctgcctccccttagatttcggggagaagatggctgctggtacgggatggagatcagaccggtgaaggagaaagaagagaacctcgttcgctccatggtgagcgccggatctggcgaagtcgactccttcagcctggggctgctctgtgtgtccattatgatcgaggaagttatgcggtctagatggagccgcaagatgctgatgacaggaacccttgcggtgtttttcctgctcattatgggccagctgacctggaatgacctgatcagactttgcattatggtcggcgctaacgtgtccgatcggatggggatgggaacaacgtatctggccctcatggccacctttaagatgcgccctatgttcgctgtgggcctgctctttagacggctgacatctcgcgaggtccttctgctcaccatcgggctgagcctggttgcctccgtggagcttcccaactctctggaggaactcggagacggcctggcgatggggattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctgggatcctttggctgcaaaccgctcacaatgttcctgattaccgaaaataagatctggggcagaaagagctggccccttaacgaggggattatggccgttggaatcgtgtctattctgctctccagcctgctcaaaaatgatgtccctctggctggcccccttatcgccgggggaatgctgatcgcttgttatgtgatttccggcagctctgccgacctgagcctcgaacgggcggccgaggtttcctgggaggaagaggctgaacattctggggccagccacaacatcctggtggaggtccaggatgacggaacaatgaagattaaagatgaggaacgcgacgatacccttacgatcctgctcaaggctaccctgctcgccgtgtccggcgtctaccctatgtctattcccgccacactgtttgtgtggtatttctggcagaagaagaaacagagaagcggcgttctttgggacacccctagccctcccgaggtggaacgggctgtcctggatgacgggatctaccgcatcctgcagagaggactcctgggccggtctcaggtgggggttggagtgttccaagacggcgtctttcatacaatgtggcacgtgaccagaggggcggtgcttatgtatcagggaaagcgcctggagcccagctgggcctccgttaagaaagatctcattagctacggcggcgggtggcggttccagggatcttggaatacaggcgaagaggtccaggtgatcgctgtggagcccgggaagaaccctaaaaatgtccaaacgacccccggaacatttaagaccccggaaggcgaggtgggggccattgccctggacttcaaacctggaacctccggcagccccatcgttaacagagaaggcaagattgtggggctctacggaaatggcgtcgtgacaacgtctgggacctatgtttccgctatcgcccaggcgaaggctagccaggagggacctctgcccgaaattgaggatgaggtgtttaaaaagcgcaaccttacaatcatggacctgcaccccggctccgggaaaacccggagatacctgcctgccatcgtccgcgaagccattaagcggaaactcagaacactgatccttgctccgacccgcgtggttgcctctgagatggcggaagctctgaagggcatgcccattcggtatcaaacgacagccgtcaagagcgagcataccggaaaagaaatcgtcgatctcatgtgccacgccaccttcacaatgagactgctgtcccctgtgcgggtgcccaattacaacatgattatcatggacgaggctcattttaccgatcctgccagcatcgctgcccgcggctatatttctacaagagtcgggatgggagaggcggccgctatcttcatgaccgccacgccccctggctccgttgaggcttttccgcagagcaatgccgtgattcaggacgaggaacgggatatccccgagcgctcttggaacagcgggtacgactggattacagatttccctggaaagaccgtgtggtttgtcccctccatcaaatctggcaatgacatcgccaactgtctcagaaagaacgggaaacgggtgattcagcttagcagaaagacattcgacaccgaatatcaaaagacgaaaaataacgattgggactacgttgtgaccacagatatctccgagatgggcgctaatttccgcgcggaccgggtcattgatcctagacgctgcctgaagcccgtgatcctgaaagacggaccggagcgggttattctcgccggccctatgcccgtgaccgctgcctctgccgctcagagacgcgggcggatcggaagaaaccagaataaggaaggcgatcagtacatttatatggggcaacccctgaacaatgacgaggatcacgcccattggacagaagcgaaaatgcttctggacaacatcaatacccctgagggaatcattcccgctctctttgagcctgaacgcgaaaagagcgccgccatcgatggcgaatacagactcgggggagaggctcggaagacattcgtcgaactgatgaaacgcggagacctgccggtgtggctttcctataaggtcgccagcgagggctttcagtactctgatagacggtggtgcttcgacggggagcgcaacaatcaggtgctggaagagaacatggacgttgaaatttggaccaaagagggagaaagaaagaaactgcggcccagatggctcgatgcgcgcacgtattccgaccctctggcccttcgggagtttaaggagttcgctgccggcagacgcagcgtgtccggggatctgatcctcgaaattggaaaactgccccagcacctgacactccgggctcaaaatgcccttgacaacctggtgatgctgcacaattctgagcagggcggcaaggcttacagacatgccatggaggaactccctgataccatcgaaaccctgatgcttctggcgctcatcgccgtcctgacagggggagttaccctgtttttcctcagcggcaaggggcttggaaaaacatccattggcctgctgtgtgtgatggcttctagcgtgctcctgtggatggcctccgtcgagccccactggatcgctgccagcattatccttgagtttttcctgatggtgctcctgattccggaacctgaccggcagcgcacgccccaggataaccaactggcctatgttgtgatcgggctcctttttatgatcctgaccgtcgctgcgaacgagatgggactgctcgaaacaaccaagaaagacctgggcattggccatgtggtcgccgagaatcaccaccatgctacaatgcttgatatcgacctgcaccctgcctctgcctggaccctctacgctgtggccacgaccattatcacacccatgatgagacataccattgagaacacaaccgcgaatatctccctgacggccattgctaaccaggccgctatcctgatggggctcgataagggatggcctatcagcaaaatggacattggcgttccccttctggccctggggtgctactctcaggtgaatccgctcacactgaccgcggccgtccttatgctggtggctcactatgccatcattggacctggcctccaagctaaggccacacgggaagctcagaagcgcaccgccgcggggatcatgaaaaaccccaccgttgatggaattgtggccatcgacctggaccccgtcgtgtacgatgctaagttcgagaaacagctgggccagatcatgctccttattctgtgtacatcccaaatcctgctcatgagaacgacctgggccctgtgcgaaagcattacacttgctaccggccctctgacaaccctctgggaggggtctccgggaaagttttggaatacgacaatcgccgtgagcatggccaacattttccggggctcctatctggcgggggctggactggccttctctctcatgaaaagccttggcgggggacgcagaggcaccggcgctcagggggaaaccctgggagagaagtggaagcggcagctgaatcagctctccaaaagcgagtttaacacatacaagcgctccggcatcatggaagttgacagatctgaggccaaagaagggctgaagcggggagagaccacaaaacatgccgtcagcagaggcacggctaaacttcgctggttcgtggaacggaatctggtgaagcccgaggggaaagtcatcgatctcggatgtggcagaggcgggtggtcctattactgcgccggactgaagaaagttaccgaggtgaagggctatacaaaagggggacctggccacgaggaacccattcctatggcgacctacgggtggaacatcgtgaagctgcactctggacgcgacgtctttttcacaccccctgaaaaatgtgataccctcctttgcgacattggcgagagctccccgaatcccacgatcgaagagggccggaccctgagagtgctgaagatggttgagccttggctccgcgggaaccaattttgtattaagatcctgaatccctacatgccttctgtggtcgaaacacttgagcagatgcagcggaaacatggaggcatgctggtgagaaaccccctcagccgcaattccacccacgaaatgtattgggttagctgcgggacaggaaacattgtgtctgccgtcaacatgacctcccggatgctgctgaatagattcacaatggctcatcgcaagccgacctacgagcgggatgtggacctcggcgccgggacgagacacgtggctgtcgagcctgaaatcgccaacctggatatcattggacagcgcatcgagaatattaaaaacgaacacaagagcacatggcattatgacgaggataatccctacaaaacctgggcgtatcacggctcttacgaagttaagccctccggcagcgcctcttccatggtgaacggggtggtcagacttctgaccaagccttgggacgtgatccccatggttacacaaattgctatgacggacaccacaccttttggacagcagcgggtgttcaaagagaaggtcgatacccgcacaccgagacccaaacggggcaccgcccaaatcatggaggtgacagctaagtggctctgggggtttctgagcagaaataaaaagcctcggatctgtacccgcgaagagttcacgagaaaggttcggtccaacgccgctattggagccgtgtttgtcgacgaaaatcagtggaacagcgcgaaagaggccgtggaagatgagcgcttctgggaccttgttcatagagagcgggaactgcacaagcagggcaaatgcgctacctgcgtgtataatatgatggggaagcgcgagaaaaagctcggcgaatttggaaaggccaaaggctctagagctatctggtacatgtggctgggggcccggttcctggagttcgaagccctcggatttatgaacgaggatcattggttcagccgcgaaaattccctgtctggcgtcgaaggggagggacttcacaagctgggctacattctcagagacatcagcaaaattcccgggggcaacatgtatgcggatgacacagctggatgggatacccggatcacagaagacgatctgcagaatgaggccaagatcaccgacattatggagcctgaacacgcccttctggctacgtccatctttaaactcacataccaaaacaaggtggtccgcgtgcagagacccgccaaatctggcaccgttatggatgtgattagccggcgcgaccagagagggtccggacaggtcggcacatatgggctgaacaccttcacgaatatggaggtgcaactgatccggcagatggaatctgagggaatttttagcccgtccgaactcgagaacagcaatctggctgagagagtgcttgactggctggaaaagcatggcgttgagcgcctcaagcggatggccatctctggggatgactgtgtggtcaaacctaccgatgacagattcgcgacagccctgaccgctcttaacgatatgggcaaggtgcgcaaagacatcccccagtgggaaccttccaagggatggaatgattggcagctggttcccttttgcagccaccatttccaccaactcattatgaaagacggccgggagatcgtggtcccttgtagaaaccaggatgaactggtggggcgcgcccgggtctctcagggagctggctggtccctgagagagacagcctgcctcggaaagagctacgcgcagatgtggcaactgatgtattttcaccgccgggaccttagactggccgctaatgccatttgttccgctgtgcccgttaactgggtgccgacctctcgcacaacctggagcatccatgcccaccatcagtggatgacgacagaggatatgctctccgtctggaatcgggtgtggattgaagagaacccttggatggaagacaagacccacgttagctcttgggaggacgtgccctacctgggaaaaagagaagatcagtggtgcggctcccttatcgggctgaccgctcgggccacatgggcgaccaatattcaagtcgccatcaaccaggtgagacgcctcatcggcaatgagaactatctggactacatgacaagcatgaagcggttcaaaaatgagtctgatcccgaaggagctctgtggtga

SEQ ID NO: 19499 - RNA, 9879 nt, synthetic construct
  misc_feature 1..9879: note = derived and/or modified CDS sequence (opt5) from DENV-1__KR024707__SS-prME
  source 1..9879: mol_type = other RNA
agcgtgaccatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaaacgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacgtctatatgggccaacccctgaacaatgacgaagatcacgcccattggacagaggcgaaaatgcttctggacaacattaatacccctgaggggatcatccccgctctctttgaacctgagcgcgaaaagagcgccgccattgatggagagtacagactgcggggcgaagctcgcaagacattcgtggagctgatgagaagaggggacctcccggtctggctttcctataaagtggccagcgagggctttcagtactctgatcgcagatggtgcttcgacggagaacggaacaatcaggttctggaggaaaacatggacgtggagatctggaccaaggaaggcgagcgcaagaagctgcgcccccggtggctcgatgcgagaacgtattccgaccctctggcccttcgcgagtttaaagagttcgctgccgggcggagaagcgtgtccggagatctgattctcgagatcggcaagctgccccagcacctgacactccgggctcaaaatgcccttgacaacctggtcatgctgcacaattctgaacaagggggaaaggcttaccgccatgccatggaggaactccctgataccattgagaccctgatgcttctgacactcatcgcggttctgaccggcggcgtgacactgtttttcctcagcgggaagggacttggcaagacgtccatcgggctgctgtgtgtgatggcctctagcgtcctcctgtggatggcttccgtggagccccactggattgccgctagcatcattcttgaatttttcctgatggttctcctgatcccggagcctgacagacagcggacaccccaggataaccaactggcctatgtggtcattggactcctttttatgatcctgacagtggccgctaacgaaatgggcctgctcgagaccaccaagaaggacctggggatcggacatgtcgtggcggagaatcaccaccatgccaccatgcttgatattgacctgcaccctgcttctgcctggacgctctacgccgttgctaccacaatcattacccccatgatgcgccatacaatcgaaaacaccacggccaatatttccctgacagcgatcgccaaccaggctgccattctgatgggcctcgataaaggctggcctatcagcaagatggacatcggggtgccccttctggctctgggatgctactctcaggtcaatccgctcaccctgacagccgcggtgcttatgctggttgcccactatgctattatcggccctgggctccaagccaaagctaccagagaggcccagaagcggaccgctgccggaattatgaagaaccccacagtggatggcatcgtcgcgattgacctggaccccgtggtgtacgatgccaaattcgaaaagcagctggggcagatcatgctccttatcctgtgtacgtcccaaattctgctcatgcgcaccacatgggctctgtgcgagagcatcacccttgccacaggacctctgaccacgctctgggaaggctctccgggcaaattttggaatacaaccattgctgttagcatggccaacatcttcagagggtcctatctggccggagcgggcctggctttctctctcatgaaaagccttgggggaggccggcgcgggaccggagcccagggcgagacactgggcgagaaatggaagagacagctgaatcagctctccaagagcgaatttaacacctacaaacggtccgggattatggaggtcgacagatctgaagctaaggagggactgaaacgcggcgaaacaacgaagcatgccgtgagccgggggaccgccaaacttagatggttcgtggagcgcaatctggtcaagcccgagggaaaggttatcgatctcggctgtgggcggggaggctggtcctattactgcgctggcctgaaaaaggtgacagaagtgaaagggtataccaagggaggccctgggcacgaggaacccatccctatggccacatacggatggaacattgtcaaactgcactctggcagagacgtgtttttcacgccccctgagaagtgtgataccctcctttgcgacatcggggaaagctccccgaatcccaccattgaggagggacgcacactgcgggttctgaaaatggtggaaccttggctcagaggcaaccaattttgtatcaagattctgaatccctacatgccttctgtcgtggagacccttgaacagatgcagcgcaagcatggcgggatgctggttcggaaccccctcagcagaaattccacacacgagatgtattgggtgagctgcggaaccggcaacatcgtctctgcggtgaacatgacatcccgcatgctgctgaatcggttcaccatggcccatagaaaaccgacgtacgagcgcgatgtggacctcggggctggaacaagacacgtcgccgttgaacctgagattgctaacctggatatcatcggccagcggattgaaaatatcaagaacgagcacaaaagcacctggcattatgacgaagataatccctacaagacctgggcctatcacgggtcttacgaggtgaaaccctccggaagcgcgtcttccatggtgaacggcgtcgtgcgccttctgacaaagccttgggacgttattcccatggtgacgcaaatcgccatgaccgacacaaccccttttggccagcagagagtcttcaaggagaaagtggatacacggaccccgagacccaagcgggggacagctcaaattatggaagttaccgccaaatggctctggggatttctgagccgcaataagaaacctagaatctgtacgcgggaggagttcacccgcaaggtgagatccaacgctgccatcggcgctgtctttgtggacgagaatcagtggaacagcgccaaggaagcggttgaggatgagcggttctgggaccttgtgcatcgcgaaagagagctgcacaaacaggggaagtgcgccacatgcgtctataatatgatgggaaaacgggaaaagaaactcggcgagtttgggaaggctaagggctctcgcgccatttggtacatgtggctgggagctagattcctggagttcgaggccctcggctttatgaacgaggatcattggttcagccgggaaaattccctgtctggggtggagggagaaggccttcacaaactggggtacatcctccgcgacattagcaagatccccggaggcaacatgtatgccgatgacaccgcggggtgggatacaagaattaccgaggacgatctgcagaatgaggctaaaatcacggacatcatggaacctgagcacgcccttctggccacatccatttttaagctcacctaccaaaacaaagtcgtgcgggttcagcgccccgctaagtctggcacagtgatggatgtcatcagcagacgggaccagagaggatccggccaggtggggacctatggactgaacacgttcaccaatatggaagtgcaactgattcgccagatggagtctgaaggcatctttagcccgtccgagctcgagaacagcaatctggccgaacgggttcttgactggctggagaaacatggggtggaaagactcaagcgcatggctatttctggagatgactgtgtcgtgaagcctacagatgaccggttcgccaccgcgctgacagcccttaacgatatgggcaaagttagaaaggacatcccccagtgggagccttccaaagggtggaatgattggcagcaagtgcccttttgcagccaccatttccaccagctgatcatgaaggacggccgcgaaattgtcgtgccttgtcggaaccaggatgagctcgtcggacgggctcgcgtgtctcagggcgccgggtggtccctgcgggagaccgcttgcctgggaaaaagctacgcccaaatgtggcagctcatgtattttcacagacgcgacctgcggcttgcggccaatgctatctgttccgccgttcccgtgaactgggtcccgacatctagaaccacgtggagcattcatgctcaccatcagtggatgacaaccgaagatatgctgtccgtgtggaatcgggtttggatcgaggaaaacccttggatggaggacaagacccacgtgagctcttgggaagacgtcccctacctcggcaagagagaggatcaatggtgcgggtccctgattggacttacagcccgcgctacctgggccacaaatatccaggtggcgattaaccaggtgcggagactgatcggcaatgagaactatctcgactacatgacgagcatgaaacgcttcaagaatgaatctgatcccgagggggccctgtggtga

SEQ ID NO: 19500 - RNA, 9879 nt, synthetic construct
  misc_feature 1..9879: note = derived and/or modified CDS sequence (opt5) from DENV-1__KC172829__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggcaccttcaaactcgagaaggaagtcgccgagacccagcacggaacagtgctggttcagattaagtacgagggcaccgacgcgccgtgcaaaatccctttctctacacaagatgaaaagggggtgacgcagaacggacggctgatcaccgctaatcccattgtcacagacaaagagaagcctgtgaacatcgaagccgagcccccctttggcgagtcctatattgtgatcggggccggagaaaaagctcttaagctcagctggttcaagaaaggctctagcattgggaagatgtttgaggccaccgctagaggcgcccgccggatggcgatcctgggagatacagcctgggacttcggctccatcgggggagtttttacctctgtcggcaaactggtgcatcagattttcgggacggcttacggagtgctctttagcggcgtctcctggaccatgaagatcgggattggcgtgctgcttacatggctgggactcaatagcagatctacctccctgagcatgacatgtatcgccgttggcctggtgaccctttacctcggggtcatggtgcaggctgattctggatgcgttgtgaactggaaaggccgcgaactgaagtgtgggtccggaattttcgtcacaaatgaggtgcacacctggacggaacaatataagtttcaggccgacagccctaaacggctgtccgcggccatcggcaaggcttgggaggagggggtttgcggcattagatctgccacacgcctcgaaaacatcatgtggaaacagatcagcaacgagctgaatcatattcttctggaaaacgacatgaagttcaccgtggtcgtgggagatgtggctggcatcctcgcccaggggaaaaagatgattcggccgcaacccatggagtacaaatattcctggaagtcttggggaaaggccaaaatcattggcgctgacgtccagaataccacatttatcatcgatgggcctaacacccccgaatgtcctgacgatcagagagcgtggaatatttgggaggttgaggactacggattcggcatctttacgacaaacatttggctgcgcctgcgggatagctatacccaggtgtgcgaccacagacttatgtccgccgctatcaaggatagcaaagccgtgcacgccgacatgggctactggattgaatctgagaagaatgaaacatggaaactcgctcgcgcctccttcatcgaggtcaagacctgtatctggcccaagagccatacactgtggtctaacggggtgctggaatccgagatgattatcccgaaaatttatggaggccctatcagccaacacaattaccggcccgggtacttcacccagacggcgggaccttggcatctcggcaagctggagcttgattttgacctgtgcgaagggaccacagttgtggtcgatgagcactgcggaaacagaggcccctctctccggaccacaaccgtgacgggcaaaattatccacgaatggtgttgccgcagctgtacactgcctcccctgagattccggggggaggacggatgctggtatggcatggagatcagaccggttaaggaaaaagaggaaaatcttgtgaagtccatggtcagcgctgggtctggagaggtggactcctttagcctcggcctgctgtgtatttccatcatgattgaagaggttatgcgctctcggtggagcagaaagatgctcatgaccgggacactggccgtgttctttcttctgatcattggacagctcacctggaacgatctgatccgcctgtccattatggtcggcgccaatgcttctgacaaaatgggcatggggaccacataccttgccctgatggcgacgttcaagatgagacctatgtttgctgtgggactcctgttccggcgcctcaccagcagagaggtgctgcttctgacaatcggcctctccctggtcgcctctgttgaactgcccaacagccttgaggaactgggggatggactcgccatgggcatcatgattctgaaactcctgaccgactttcaatcccatcagctttgggctacactgctcagcctgaccttcatcaagacgacattttctctgcactatgcctggaaaaccatggctatggtgctttccattgtgagcctgttccccctctgcctgtctaccacatcccagaagaccacatggctccctgtcctgcttgggagcctgggatgtaagccgctgacgatgtttctcatcaccgagaataaaatttggggccggaagtcttggcccctgaacgaaggcatcatggccgtggggatcgtttccattcttctgagctccctcctgaaaaacgatgtgcctctcgcgggacccctgatcgccggcgggatgcttattgcttgctacgtcatcagcggatctagcgccgacctgtccctggagaaggctgccgaggtgtcttgggaagaggaagccgagcatagcggcgcttcccacaatattctcgttgaagtgcaggatgacgggacaatgaaaatcaaggatgaggagcgcgacgataccctgacaatccttctgaaagcgaccctcctggccgtctctggagtgtatcctctcagcattcccgctacgctgttcgtctggtacttctggcaaaagaagaaacagagatccggcgtgctttgggacaccccttctcccccggaagttgagcgggccgtgctggatgacggcatctatcgcattatgcagagagggctgctcggacggagccaggtcggcgtgggggtttttcaagaaaacgtgttccatacaatgtggcacgtcacccgcggagccgtgctgatgtaccagggcaagagacttgagccttcctgggctagcgtgaaaaaggacctgatctcttacgggggaggctggcggctccagggctcctggaatacaggggaggaagttcaggtcattgccgtggagcccggaaaaaaccctaagaatgtgcaaaccgcgcccggcacatttaagacgaccgaaggggaggtcggagctatcgccctggatttcaaaccgggcacaagcgggtctcctattgtgaacagagaaggaaagatcgttggcctctatggcaatggggtggtcaccacctccggaacatacgtgagcgccatcgctcaggccaaagcgtcccaggagggccccctgcctgagattgaagacgaggtttttcgcaagcggaaccttacgatcatggatctgcaccccgggtctggaaaaaccagacgctatctgcccgctattgtgcgggaagccatcaagagaaagctccgcacactgattcttgcccctacccgggtcgtggctagcgagatggccgaagctctgaaaggcatgccgatcagataccaaacaaccgccgttaagtccgagcatacggggaaagagatcgtggacctcatgtgtcacgcgacattcaccatgcgcctgctgagccccgtccgggtgcctaattataacatgattatcatggatgaagcccattttaccgacccctcttccattgctgccagaggctacatcagcacacgggtgggaatgggcgaggctgccgccattttcatgaccgctacacctcccgggtctgtcgaagcgtttcctcagagcaatgccgttatccaggatgaggaacgcgacatcccggagagatcctggaactctggatatgagtggattaccgatttcagcggcaagacggtgtggtttgtgccctccatcaaatctgggaatgacattgctaactgcctccggaagaatggaaagcgcgtcatccagcttagcagaaaaacattcgataccgaataccaaaagacaaaaaacaacgactgggactacgtggttaccacggatatttccgagatgggcgccaatttccgggccgacagagtgatcgatcctcgccggtgtctgaagcccgtcattctgaaagacgggcctgaaagagtgatcctcgctggccccatgccggttaccgtggccagcgcggctcagcgccggggaagaatcggccgcaaccacaataaggagggggatcagtatatttacatgggacagcctctgaacaatgacgaggatcatgcccactggacagaagccaagatgcttctggacaacatcaatacccccgagggcattatccccgctctctttgaacctgagcgggaaaaatctgccgcgattgatggggagtatagactgcgcggagaggccagaaagacattcgtcgaactgatgcggcgcggcgacctccccgtgtggctttcctacaaagtcgctagcgaggggtttcaatattccgatagacggtggtgcttcgacggcgaacgcaacaatcaggtgctggaggaaaacatggatgttgagatctggaccaaggagggagaaagaaaaaagctgcggcctagatggctcgacgcccgcacatactctgacccgctggctcttcgggagtttaaagaattcgccgctggcagacgcagcgtgtccggggatctgatcctcgagattggaaagctgccccagcacctgacccagcgggcccaaaatgcgctcgacaaccttgtgatgctgcataattctgaacagggcgggagagcctatcggcacgctatggaggagctgcctgatacgatcgaaacactcatgctgcttgccctgattgctgtcctcaccggaggcgttaccctgtttttcctgagcggccgcgggctcggaaagacatccatcggccttctgtgcgtgatggccagctctgtgctgctctggatggcctccgtcgagccccattggattgctgcgagcatcatcctggaatttttccttatggtgctgctcattcctgagcccgacagacagcggaccccgcaggataaccaactggcctacgttgtgatcgggctgctctttatgattcttacagtcgctgccaatgagatgggactgctggaaacgaccaaaaaggacctcggcatcgggcacgtggccgatgagaaccaccatcacgctgccatgctggacgtcgatcttcatcctgcgtctgcctggacactgtacgctgtggccaccacaattatcacccccatgatgcgccacacgattgaaaacaccacagctaatatctccctcaccgccatcgcgaaccaggccgctattctgatgggactggacaaaggctggcctatcagcaagatggatattggcgttcccctccttgccctggggtgttattctcaggtgaatcctctgacactcaccgctgccgtcctgatgcttgtggctcattacgccatcattggacccggcctgcaagcgaaagccacgagagaggctcagaagcggacagccgctgggatcatgaagaacccgaccgttgacggaatcgtggccattgatctcgaccctgtcgtgtatgacgccaaattcgaaaagcagctgggccagatcatgctgctcattctttgcacaagccaaatcctgctgatgcgcaccacctgggcgctctgtgagtccattacactggctacggggccccttaccacactgtgggagggatctcccggcaaattttggaataccacaatcgccgtgagcatggctaacatcttcagaggctcctacctcgccggggccggactggctttcagcctgatgaagtccctcggcgggggacggcgcggcaccggggcccagggagaaacgcttggcgagaaatggaagagacagctgaatcagctgtctaagagcgaatttaacacatataaacggtccggcattatggaggttgatagatctgaagcgaaggaggggctcaaacgcggagagaccaccaagcacgccgtcagccggggcacagctaaactgagatggttcgtggaacgcaatcttgtgaagcctgaggggaaggtcatcgacctgggatgcggccgggggggatggtcctactattgtgccggcctcaaaaaggttaccgaagtgaaaggctacacaaaggggggaccgggccacgaggaacccattcctatggctacgtacgggtggaacctggtgaaactgcattctggaaaggatgtctttttcatcccccctgagaaatgcgacaccctcctttgtgatattggcgagagctcccccaatcctacaatcgaagaggggagaaccctgcgcgtgctgaagatggttgaaccgtggctccggggaaaccaattttgcattaagatcctgaatccctatatgcctagcgtggtcgagacacttgagcagatgcagagaaaacacggcggcatgctggtgcgcaaccccctctctcggaattccacccatgaaatgtactgggttagctgtgggacgggaaacatcgtgtctgccgtcaatatgacctccagaatgctgctgaaccgcttcacaatggtgcaccggaagcctacctatgagagagacgtggatctcggcgcggggacacgccacgtcgccgttgaacccgaggtggctaacctggacattatcggacagagaattgaaaatatcaaacatgagcacaagagcacctggcattacgatgaggacaacccgtataaaacatgggcctaccacggctcttatgaagtgaagccttccgggagcgcttccagcatggtcaatggagtggttaagcttctgaccaaaccctgggatgtgattcccatggtcacgcaaatcgccatgacagacaccaccccttttggccagcagcgggtgttcaaggagaaagttgacacacgcacgcccaaggctaaaagaggcaccgcccaaatcatggaagtgacagcgcggtggctctgggggtttctgtctagaaacaagaagcctcggatttgcacccgcgaggaattcacaagaaaagtccggagcaatgccgctatcggagccgtgtttgttgatgagaaccagtggaattccgctaaggaggccgtggaagacgagcgcttctgggatcttgtccatagagaacgggagctgcacaaacagggcaagtgtgccacctgcgtgtacaacatgatggggaaacgcgaaaagaagctcggagagtttggcaaagcgaaggggtctagagctatttggtacatgtggctgggcgcccggttcctggagttcgaagccctcggatttatgaatgaggaccactggttcagccgcgaaaactccctgtctggcgtcgagggggagggacttcataaactgggctatatcctcagagatattagcaagatcccggggggaaatatgtacgctgacgatacagccggctgggacacccggatcacggaagatgacctgcagaacgaggctaaaattaccgatatcatggaatccgagcacgcccttctggcgaagtctatttttaaactcacatatcaaaataaggtggttcgcgtgcagagacccgccaagaacgggaccgtcatggacgtgatcagccggcgcgatcagagaggctccggacaggtgggcacatacgggctgaataccttcacgaacatggaagctcaactgattcggcagatggagagcgagggaatcttttctccttccgaactcgagacacccaacctggccgaaagagctcttgactggctggagaaacatggcgttgaacgcctcaagcggatggccatcagcggggacgattgcgtggtcaaacctattgacgatagattcgcgaccgccctgacagctcttaatgacatgggaaaggtgcgcaaagatatcccccagtgggagccgtctaagggctggaacgactggcagcaagttcctttttgttcccaccacttccatcagctgattatgaaggatgggcgggagatcgtggtcccctgcagaaatcaggacgaactcgtgggccgcgcccgggtcagccagggagctggctggtccctgagagagaccgcctgtctggggaaatcttatgctcaaatgtggcagctcatgtactttcaccgccgggatctgagacttgccgcgaacgccatttgcagcgctgtgcctgttgactgggtgcccacgtcccgcaccacatggagcatccatgcccaccatcagtggatgaccacagaagatatgctgtctgtctggaatcgggtgtggattgaggaaaacccttggatggaggacaagacccacatctccagctgggaggacgttccctatctcggaaaaagagaagatcaatggtgtggctctctgatcgggcttacagcccgggctacctgggccacgaatattcaggtggcgatcagccaggtcagacgcctgattggaaacgagaattacctcgactacatgacatccatgaagcggttcaaaaacgaatctgatccggagggcgctctgtggtga

SEQ ID NO: 19501 - RNA, 9879 nt, synthetic construct
  misc_feature 1..9879: note = derived and/or modified CDS sequence (opt5) from DENV-1__EU359008__SS-prME
  source 1..9879: mol_type = other RNA
agcgtgaccatgctgctgatgctgatgcccacagcccttgctttccacctgacgacccggggaggggaacctcatatgatcgtgtccaagcaggaacggggaaaatctctcctgtttaagacaagcgccggcgttaacatgtgcacccttatcgcgatggacctgggggaactctgtgaagatacactgacctacaaatgcccgcgcatcacagaagctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggtcccgggattttgttgagggactcagcggcgccacatgggtggacgtcgtgctggagcacgggtcttgtgtgacgaccatggctaaggataaacccacactggacatcgaactcctgaagaccgaggtcacaaaccctgccgttcttcgcaaactgtgcattgaagcgaagatctccaataccacgacagatagcagatgtccgacccaaggagaggccaccctcgtggaagaacaggacgctaacttcgtgtgccggcgcacatttgtcgatagaggctggggcaatgggtgtggactgttcggcaaagggtctcttattacctgcgccaagtttaagtgcgtgacaaaactggagggaaagatcgttcagtacgaaaacctcaaatattccgtgatcgtcacggtgcacaccggcgaccagcatcaagttgggaatgagagcacagaacacggaaccacagctaccattacgccccaggcccctaccacagagatccagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccaccacacaagagacctggaatcgccaggacctcctggtgaccttcaaaacagcgcacgccaagaagcaggaagtcgtggttctgggatctcaagagggcgctatgcacacggccctcaccggggccacagaaattcagaccagcggaacaaccacgatctttgctggccatctgaaatgcagacttaagatggataaactgacactcaaggggatgtcctatgtgatgtgtaccggcagcttcaaactggagaaggaagtcgccgagacccagcacggaacagtgctggttcagattaagtacgagggcaccgacgcgccgtgcaaaatccctttccttacacaagatgaaaagggggtgacgcagaacggacggctcatcaccgctaatcccattgtcacagacaaagagaagcctgtgaacatcgaagccgagccgccctttggcgagtcttatattgtgatcggggccggagaaaaagctctgaagctgtcctggttcaagaaaggcagctctattgggaagatgtttgaggccaccgctagaggcgcccgccggatggcgatcctcggagatacagcctgggacttcggcagcatcgggggagtttttacctccgtcggcaaactggtgcatcagattttcgggacggcttacggagtgctcttttctggcgtcagctggaccatgaagatcgggattggcgccctgctcacatggctgggactcaattccagaagcacctctctttccatgacatgtatcgctgtgggcctcgttaccctgtacctgggggtgatggtccaggccgatagcggatgcgtgattaactggaaaggccgcgaactcaagtgtgggtctggaatcttcgttacaaatgaggtgcacacctggacggaacaatataagtttcaggcggactcccctaaacggctgagcgccgctattggcaaggcctgggaggagggggtctgcggcatcagatccgctacacgccttgaaaacatcatgtggaaacagatttctaacgagctgaatcatatcctcctggaaaacgacatgaagttcaccgtggttgtgggagatgtcgccggcattctggcccaggggaaaaagatgatccggccgcaacccatggagcacaaatacagctggaagtcctggggaaaggctaaaattatcggcgcggacgtgcagaataccacatttatcattgatgggcctaacacccccgaatgtcctgacgatcagagagcctggaatatctgggaggtggaggactatggattcggcatttttacgacaaacatctggcttaagctccgcgattcttacacccaggtctgcgaccaccggctgatgagcgctgccattaaagattccaaggccgttcatgctgacatgggctattggatcgaaagcgagaaaaatgaaacatggaagctggccagagcgtctttcatcgaggtgaagacctgtatttggcccaaatcccacacactctggagcaacggggtgctggaatctgagatgatcattccgaagatctacggaggccctatttcccaacataattatcgccccgggtacttcacccagacggctggaccttggcaccttggcaaactggagctcgattttgacctgtgcgaagggaccacagtcgtggttgatgagcactgcggaaaccggggccccagcctgagaaccacaaccgtgacgggcaagatcatccatgaatggtgttgccggtcttgtacacttcctcccctccgcttcagaggggaggacggatgctggtacggcatggagattcggccggtcaaagaaaaggaggaaaatctggtcaagagcatggtttccgccgggagcggagaggtggactctttttccctgggcctcctgtgtatcagcattatgatcgaagaggtcatgagatcccgctggtctcggaaaatgcttatgaccgggacactggccgtgttctttctcctgattatgggacaggttacctggaacgatctgatcagactttgcattatggtgggcgctaatgccagcgaccgcatgggcatggggaccacatatctggcgctcatggctacgttcaagatgagacctatgtttgccgtcggactgcttttccggcgcctgacctccagagaggtgcttctgctcacaatcggcctgtctctggtggccagcgtcgaacttcccaactccctggaggaactcggggatggactggctatgggcatcatgattctcaaactgcttaccgactttcaatctcaccagctgtgggccacactcctgagcctgaccttcatcaagacgacattttcccttcattacgcttggaaaaccatggccatggttctgagcattgtgtctctcttccccctgtgtctctccaccacaagccagaagaccacatggctgcctgtgcttctggggtctctgggatgcaagccgctcacgatgtttctgatcgcggagaataaaatttggggccggaagtcctggccccttaacgaaggcatcatggccgtcgggatcgtgagcattctgctctcttccctgctcaaaaacgatgttcctctggctggaccccttatcgccggcgggatgctgattgcttgttatgtgatcagcggatccagcgccgacctgtctctcgagaaggccgctgaggtcagctgggaagaggaagcggagcactccggcgcctctcataatattctggtggaagttcaggatgacgggaccatgaaaatcaaggatgaggagcgcgacgatacacttaccatcctgctcaaagctacactgctcgccgtgagcggagtctaccctctgtccattcccgccacccttttcgtgtggtatttctggcaaaagaagaaacagagatctggcgtcctgtgggacacgcctagccctcccgaagtggagcgggctgttctggatgacggcatctaccgcattatgcagagagggctcctgggacggtcccaggtgggcgtcggggtgtttcaagaaaacgttttccacaccatgtggcacgtgacacgcggagccgtccttatgtatcagggcaagagactggagccctcttgggcgagcgtgaaaaaggacctcatctcctacgggggaggctggcggctgcagggcagctggaataccggggaggaagtgcaggttattgctgtcgagcccggcaagaaccctaagaatgtgcaaacagcccccggcacctttaagacaccggaaggggaggtgggagccatcgctctcgatttcaaacctggcacgtctgggtcccccattgtcaacagagaaggaaagatcgtgggcctgtacggcaatggggttgtgaccacaagcggaacctatgtctctgccatcgcgcaggctaaagcctcccaggagggccctcttcccgagattgaagacgaggtgtttcgcaagcggaacctgaccatcatggatctgcatcccgggagcggaaaaacaagacgctacctccctgccattgttcgggaagctatcaagagaaagctgcgcacgcttattctggccccgacccgggtggtcgcttccgagatggccgaagcgctcaaaggcatgcccatcagatatcaaacaaccgccgtgaagtctgagcacacagggaaagagatcgttgacctgatgtgccatgctaccttcacgatgcgcctgctcagccctgtgcgggtccccaattacaacatgattatcatggatgaagcccactttacagacccttccagcattgctgccagaggctatatctctacccgggtgggaatgggcgaggccgctgcgattttcatgaccgccacaccccctgggtccgtggaggcttttccgcagagcaatgccgccatccaggatgaggaacgcgacatccccgagagatcttggaacagcggatacgagtggattaccgatttccctggcaagacagtctggtttgttccctccatcaaatctgggaatgacattgctaactgtcttcggaagaatggaaagcgcgtgatccagctgagcagaaaaaccttcgatacggaatatcaaaagaccaagaacaacgactgggactacgtggtcaccacagatatttccgagatgggcgccaatttccgggcggacagagtgatcgatcctcgccggtgcctgaagcccgttattctcaaagacgggccggaaagagtgatcctggctggccctatgcccgtcaccgtggcctctgccgctcagcgccggggaagaatcggccgcaaccataataaggagggggatcagtacatttatatgggacagccccttaacaatgacgaggatcacgcccactggacggaagcgaagatgctgctcgacaacatcaatacccctgagggcattatccccgccctgtttgaacctgagcgggagaaaagcgctgccattgatggggagtacagactgcgcggagaggctagaaagacattcgttgaactcatgcggcgcggcgaccttccggtgtggctgtcctataaagtcgccagcgaggggtttcaatactctgatagacggtggtgcttcgacggcgaacgcaacaatcaggtgctggaggaaaacatggatgtcgagatctggaccaaggagggagaacgcaaaaagctccggcccagatggctggacgctcgcacatattccgaccctcttgccctgcgggagtttaaagagttcgcggccggcagacgcagcgtgtccggggatctcatcctggagattggaaagctgccccagcatctcacccagcgggctcaaaatgcccttgacaacctggttatgctgcacaattctgaacagggcgggagagcttaccggcatgccatggaggagctccctgatacaatcgaaaccctgatgcttctggccctcattgctgtgctgacgggaggcgtgacactgtttttcctcagcggccgcgggcttggaaagacctccatcggcctgctgtgtgtcatggcgtctagcgttctcctgtggatggcctccgtggagccccactggattgctgccagcatcatccttgaatttttcctgatggtgctcctgattccggagcctgacagacagcggacaccccaggataaccaactggcctatgtcgtgatcgggctcctttttatgattctgacagttgctgccaatgagatgggactgctcgaaaccaccaaaaaggacctgggcatcgggcacgtggcggtcgagaaccatcaccatgccgctatgcttgatgtggacctgcaccctgcctctgcttggacgctctacgccgtcgcgaccacaattatcacccccatgatgcgccatacaattgaaaacaccacggccaatatctccctgaccgctatcgccaaccaggctgccattctgatgggactcgataaaggctggcctatcagcaagatggacattggcgtgccccttctggctctggggtgctactctcaggttaatccgctcacactgaccgccgcggtgcttatgctggtcgcccactatgctatcattggacctggcctccaagccaaagctacaagagaggcccagaagcggaccgccgcggggatcatgaagaaccccacggtggatggaatcgttgctattgacctggatcccgtggtctacgacgccaaattcgaaaagcagctgggccagatcatgctccttattctgtgtacatcccaaatcctgctcatgcgcaccacatgggctctgtgcgagagcattacccttgccaccgggcctctgacaacgctctgggagggatctccgggcaaattttggaataccacaatcgccgtgagcatggctaacatcttcagaggctcctatctggccggggcgggactggccttctctctcatgaaaagccttggcgggggacggcgcggcaccggggctcagggagaaacactgggcgagaaatggaagagacagctgaatcagctctccaagagcgaatttaacacctacaaacggtccggcattatggaggtggacagatctgaagccaaggaggggctgaaacgcggagagacgacaaagcacgctgttagccggggcaccgccaaacttagatggttcgtcgaacgcaatctggtgaagcccgaggggaaggtgatcgatctcggatgtggcagagggggatggtcctattactgcgcgggcctgaaaaaggtcaccgaagttaaaggctatacaaaagggggacctggccatgaggaacccattcctatggccacctacgggtggaacctggtgaaactccactctggaaaggacgtgtttttcattccccctgagaaatgtgatacacttctgtgcgacattggcgagagctccccgaatcccacgatcgaagaggggagaaccctgcgcgtcctcaagatggtggaaccttggctgcggggaaaccaattttgtattaagatccttaatccctacatgccttctgttgtggagacactggagcagatgcagagaaaacatggcggcatgctcgtccgcaaccccctgagcagaaattccacccacgaaatgtattgggtgagctgcgggacaggaaacatcgtttctgctgtgaatatgacctccagaatgctgctcaaccgcttcacgatggcccaccggaagccgacctacgagagagatgtcgacctgggcgctgggacacgccatgtggccgtggaacctgaggtcgctaaccttgatattatcggacagagaattgaaaatatcaaacacgagcataagagcacctggcactatgacgaggataacccctacaaaacatgggcctatcatggctcttacgaagttaagccctccgggagcgcgtcttccatggtgaatggagtggtcaagctgctcaccaaaccttgggacgtgattcccatggttacacaaatcgccatgaccgatacgacaccttttggccagcagcgggtgttcaaggagaaagtcgacacccgcaccccgaaggctaaaagaggcacagcccaaatcatggaagtgacggctcggtggctgtgggggtttcttagcagaaacaagaagccccggatttgtacccgcgaggagttcacaagaaaagttcggtccaatgccgccatcggagcggtgtttgtcgacgagaaccagtggaatagcgctaaggaggccgtggaagatgagcgcttctgggacctggttcacagagaacgggagctccacaaacagggcaagtgcgccacatgcgtgtataacatgatggggaaacgcgaaaagaagctgggagagtttggcaaagctaaggggtctagagccatttggtacatgtggctgggcgctcggttcctcgagttcgaagccctgggatttatgaatgaggatcattggttcagccgcgaaaactccctttctggcgtcgagggggagggactgcacaaactcggctacatcctgagagacattagcaagatccctgggggaaatatgtatgcggatgacacagccggctgggatacccggatcacagaagacgatcttcagaacgaggctaaaattaccgacatcatggaacccgagcatgccctgctcgctaaggccatttttaaactgacgtaccaaaataaggtggtccgcgtgcagagacctgcgaagaacgggaccgttatggatgtgatctcccggcgcgaccagagaggctctggacaggtcggcacatatgggctgaataccttcacaaacatggaagcccaactcattcggcagatggagagcgagggaatcttttccccctctgaactggagaccccgaaccttgctgaaagagtgctggattggctcgagaaatacggcgtggaacgcctgaagcggatggccatcagcggggacgactgtgttgtgaaacctattgatgacagattcgctacggcccttacagctctgaatgatatgggaaaggtccgcaaagacatcccccagtgggagccttccaagggctggaacgattggcagcaagtgcccttttgcagccaccacttccatcagctcattatgaaggacgggcgggagatcgttgtgccttgtagaaatcaggatgaactggtcggccgcgcccgggtgtctcagggagcgggctggtccctgagagagaccgcctgcctcgggaaaagctatgctcaaatgtggcagctgatgtactttcaccgccgggaccttagactggccgccaacgctatttgttctgccgtccccgtggattgggttccgacatcccgcaccacgtggagcatccatgcgcaccatcagtggatgaccacagaagacatgctctccgtgtggaatcgggtctggattgaggaaaacccttggatggaggataagacccacatctctagctgggaggacgtgccctatctgggaaaaagagaagaccaatggtgcggctcccttatcgggctgacagctcgggccacctgggccacaaatattcaggttgctatcaaccaggtgagacgcctcattggaaatgagaactacctggattacatgaccagcatgaagcggttcaaaaatgaatctgaccccgagggcgccctgtggtga

SEQ ID NO: 19502 - RNA, 9879 nt, synthetic construct
  misc_feature 1..9879: note = derived and/or modified CDS sequence (opt5) from DENV-1__AY835999__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttccttacccaagatgaaaagggggtgacacagaacggacggctcatcacggctaatcccatcgtcaccgacaaagagaagcctgtgaacattgaagccgagcccccctttggcgagtcctatatcgtgattggggccggagaaaaagctctgaagctgagctggttcaagaaaggctctagcatcgggaagatgtttgaggccacagctagaggcgcccgccggatggcgattctcggagataccgcctgggacttcggctccgttgggggagtctttacatctgtgggcaaactggtgcatcagatcttcgggaccgcttacggagtcctttttagcggcgtgtcctggacgatgaagctggggatcggcgttctcctgacctggctgggacttaatagcagatctacatccctcagcatgacctgtattgccgtgggcctggtcacactgtacctcggggtgatggttcaggctgattctggatgcgtgatcaactggaaaggccgcgaactgaagtgtgggtccggaattttcgtcaccaatgaggtgcacacatggaccgaacaatataagtttcaggccgacagccctaaacggctttccgcggccatcggcaaggcttgggaggagggggtttgcggcattagatctgccacgcgcctggaaaacatcatgtggaaacagattagcaacgagctcaatcatatcctgctggaaaacgacatgaagttcacagtggtcgtgggagatgtggctggcatccttgtccaggggaaaaagatgattcggccgcaacccatggagtacaaatattcctggaagtcttggggaaaggccaaaatcattggcgccgacgttcagaatagcacctttatcattgatgggcctaacacccccgaatgtcctgacgatcagagagcttggaatatctgggaggtggaggactacggattcggcatctttacaaccaacatttggctcaagctgcgcgattcctatacgcaggtgtgcgaccaccggctgatgagcgcggccatcaaagattctaaggctgtccacgccgacatgggctactggattgaatccgagaaaaatgaaacatggaagctcgccagagctagcttcatcgaggtgaagacctgtatttggcccaaatctcatacactgtggtccaacggggttcttgaaagcgagatgatcatcccgaagatttatggaggccctatctctcaacacaattaccgccccgggtacttcacccagacagccggaccttggcatctgggcaaactcgagctggattttgacctgtgcgaagggaccacggtggtcgtggatgagcactgcggaaaccggggccccagccttagaaccacaaccgttacaggcaagattatccacgaatggtgttgccggtcctgtaccctccctcccctgcgcttcagaggggagaatggatgctggtatggcatggagattcggccggtgaaagaaaaggaggaaaacctggtcaagagcatggtgtctgcggggtccggagaggttgacagcttttccctcggcctgctttgtatctctatcatgattgaagaggtgatgagaagccgctggtcccggaaaatgctgatgacggggatcctcgctgtcttctttctgctgattatgggacagcttacatggaatgacctgatcagactctgcattatggtgggcgccaacgcctctgatcgcatgggcatggggaccacatacctggctctcatggccaccttcaagatgagacctatgtttgcggtgggactgcttttccggcgcctgaccagcagagaggtcctcctgctgacaatcggcctttccctggttgcttctgtggaactccccaatagcctggaggaactcggggacggactggccatgggcattatgatccttaaactgctcacggattttcaatcccatcagctgtgggccaccctgcttagcctgacattcatcaagaccacattttctctccactatgcttggaaaaccatggccatggtgctgtccattgtcagcctcttccccctgtgtctttctacgacatcccagaagaccacctggctgcctgtgctgctcgggagcctgggatgcaagccgcttacaatgtttctgatcgctgagaacaaaatttggggccggaagtcttggcccctcaacgaaggcatcatggccgttgggattgtgtccatcctgctcagctccctgcttaaaaatgacgtccctctggcgggacccctgatcgccggcgggatgctcattgcttgttacgtgatcagcggatctagcgccgatctgtcccttgagaaggctgccgaggtttcttgggaagaggaagccgagcatagcggcgcttcccacaacattctggtggaagtccaggacgatgggaccatgaaaatcaaggacgaggagcgcgatgacacactcacgattctgctcaaagcgaccctgcttgccgtgtctggagtctatcctctgagcatccccgctacactgttcgtgtggtacttctggcaaaagaagaaacagagatccggcgttctctgggataccccttctcccccggaagtggagcgggccgtcctggacgatggcatctatcgcattatgcagagagggcttctgggacggagccaggtgggcgttggggtgtttcaagaaaatgtcttccatacaatgtggcacgtgacccgcggagccgtgctcatgtaccagggcaagagactggagccttcctgggctagcgttaaaaaggacctcatctcttacgggggaggctggcggctgcagggctcctggaacacgggggaggaagtccaggtgattgccgtggagcccggaaaaaatcctaagaacgtccaaaccgcgcccggcacatttaagaccccggaaggggaggtgggagctatcgcccttgacttcaaacctggcacaagcgggtctcccattgttaatagagaaggaaagatcgtgggcctgtatggcaacggggtcgtgaccacatccggaacgtacgttagcgccattgctcagaccaaagcctcccaggagggccctctgcccgagatcgaagatgaggtgtttcgcaagcggaatctcacaatcatggacctgcaccccgggtctggaaaaaccagacgctatcttcctgcgattgtccgggaagctatcaagagaaagctgcgcaccctcattctggccccgacacgggtggttgccagcgagatggctgaagccctgaaaggcatgcccatcagataccaaacgaccgctgtgaagtccgagcatacagggaaagagattgtcgatctcatgtgccacgccaccttcacaatgcgccttctgagccctgtgcgggtgcccaactataatatgatcatcatggacgaagcgcattttaccgatccttcttccattgccgctagaggctacatcagcacgcgggtcggaatgggcgaggccgctgccattttcatgacagccaccccccctgggtctatggaagcttttccgcagagcaacgcggttatccaggacgaggaacgcgatattcccgagagatcctggaattctggatatgagtggatcaccgacttccctggcaagacagtgtggtttgtgcccagcatcaaagccgggaacgatattgctaattgtctgcggaagaacggaaagcgcgtcatccagctctccagaaaaaccttcgacacagaataccaaaagaccaaaaacaatgattgggactacgtggttacgacagacatttctgagatgggcgccaacttccgggccgatagagtgatcgaccctcgccggtgcctgaagcccgtcattcttaaagatgggccggaaagagtgatcctggctggccctatgcccgttaccgtggccagcgcggctcagcgccggggaagaattggccgcaatcacaacaaggagggggaccagtatatctacatgggacagcccctcaataacgatgaggaccatgcccactggacagaagccaagatgctgctggataatatcaacacccctgagggcattatccccgctctctttgaacctgagcgggaaaaatccgccgcgattgacggggagtatagacttcgcggagaggccagaaagacgttcgtcgaactgatgcggcgcggcgatctgccggtgtggctcagctacaaagtcgcttctgaggggtttcaatattccgacagacggtggtgcttcgatggcgaacgcaataaccaggtgctggaggaaaatatggacgttgagatctggaccaaggagggagaaagaaaaaagcttcggcccagatggctggatgcccgcacatacagcgaccctctcgctctgcgggagtttaaagaattcgccgctggcagacgctccgtgtctggggacctgattctcgagatcggaaagcttccccagcacctgacccagcgggcccaaaacgcgctggataatctcgtgatgctgcataacagcgaacagggcgggagagcctatcggcacgctatggaggagcttcctgacacaatcgaaaccctgatgctcctggccctgattgctgtcctcacaggaggcgttaccctttttttcctgtccggcaaggggctgggaaaaacgtctatcggcctcctgtgtgtgatggccagctccgtgcttctgtggatggccagcgtcgagccccattggattgctgcgtctatcattctcgaatttttcctgatggtgctgctcatcccggagcctgatcgccagagaacaccccaggacaatcaacttgcctacgttgtgatcgggctgctgtttatgattctcaccgtcgctgccaacgagatgggactgcttgaaaccacaaagaaagatctgggcatcgggcacgtggccgtcgagaaccaccatcacgctgccatgctcgacgtggatctgcatcctgcgtccgcctggaccctgtacgctgttgccacaacgattatcacccccatgatgcggcacacaattgaaaataccacagctaacatcagcctcaccgccattgcgaatcaggccgctatccttatgggactggacaagggctggcctatctctaaaatggatattggcgtgcccctgctcgccctggggtgctattcccaggtcaacccgcttacgctgaccgctgccctcctgatgctggtggctcattacgccatcattggacctggcctccaagcgaaggccacacgcgaggctcagaagagaaccgccgctgggatcatgaaaaatcccacaattgacggaatcgttgccatcgatcttgaccccgtggtctatgatgccaagttcgaaaaacagctgggccagattatgctgctcatcctgtgtaccagccaaattcttctgatgcggacgacatgggcgctctgcgagtctatcaccctggctacagggcctctgaccaccctctgggagggaagcccgggcaagttttggaacacaacgattgccgtgtccatggctaatatcttccgcggctcttaccttgccggggccggactggctttcagcctgatgaaatccctcggcgggggaagacggggcaccggggcccagggagaaacactgggcgagaagtggaagcgccagcttaaccagctgagcaaatccgaatttaatacctataagagatctggcatcatggaggtggaccggagcgaagcgaaagaggggctcaagagaggagagacaaccaaacacgccgtttcccgcggcacggctaagctgcggtggttcgtcgaaagaaacctggtgaagcccgaggggaaagtgattgacctcggatgtggccgcgggggatggtcttactattgcgccggccttaagaaagtcacagaagttaagggctacaccaaagggggacctggccacgaggaacccatccctatggctacctacgggtggaatctggtgaagctgcatagcggaaaagatgtgtttttcattccccctgagaagtgtgacacactcctgtgcgatatcggcgagtcctctccgaaccccaccattgaagaggggcggacacttagagtcctgaagatggtggaaccttggctccgcggaaatcaattttgtatcaaaattctgaacccctatatgcctagcgttgtggagacgctggagcagatgcagcggaagcacggcggcatgctcgtcagaaatcccctgtcccgcaacagcacccatgaaatgtactgggtgtcttgcgggacaggaaatatcgtttccgccgtgaacatgaccagccggatgcttctgaacagattcacaatggcgcaccgcaaaccgacctatgagcgggacgtcgatctcggcgccgggacgagacacgtggctgtggaacctgaggtcgccaatctggacatcattggacagcgcatcgaaaacattaagcatgagcacaaatctacctggcattacgatgaggacaatccctataagacatgggcttaccacggctcctatgaagttaagcccagcgggtctgcctccagcatggtgaacggagtggtcaaacttctgaccaagccttgggatgtgatccccatggttacacaaattgctatgaccgacacaaccccttttggccagcagagagtgttcaaagagaaggtcgatacgcggacaccgaaagccaagcgcggcaccgcgcaaatcatggaagtgaccgccagatggctctgggggtttctgtcccggaataagaaacccagaatctgtacacgggaggaattcacgcgcaaggttagaagcaacgctgccattggagctgtgtttgtcgacgagaatcagtggaactctgccaaagaggccgtggaagacgatcggttctgggacctggttcatcgcgagagagaactccacaagcagggcaaatgcgcgacctgcgtgtacaatatgatggggaagcgggagaagaaactgggagaatttggcaaggctaaagggagccgcgccatctggtacatgtggcttggcgccagattcctggagttcgaggctctcggatttatgaacgaagatcactggttctcccgggagaattctctgagcggcgtcgaaggggagggacttcataagctgggctatattctccgcgacatctccaaaattcctgggggaaacatgtacgccgatgacacagctggctgggataccagaatcacagaggacgatctgcagaatgaagccaagatcaccgacattatggagcccgaacacgcgcaactggccaaatctatctttaagctcacatatcagaacaaggtggtccgggtgcagcgccctgctaaaaatgggaccgttatggatgtgattagcagacgggaccagcgcggctccggacaagtcggcacgtacgggctgaacaccttcacaaacatggaggcccagcttatcagacagatggaatctgagggaatttttagccccaatgagctggaaaccccgaacctcgctgagcgggtgctggattggcttgaaaagtatggcgtggagagactgaaacgcatggccatctccggggacgactgtgttgtgaagcctatcgatgaccggttcgcgacagccctcaccgctctgaatgatatgggaaaagtcagaaaggacattccccagtgggaacctagcaagggctggaacgattggcaacaggtgcccttttgctctcatcacttccaccagctgatcatgaaagacgggcgcgagattgttgtgccttgtcggaatcaggatgagctcgtcggcagagcccgcgtgtcccaaggagctggctggagcctgcgggaaacggcctgccttgggaagtcttacgctcagatgtggcagctgatgtattttcatagacgcgacctccggctggccgcgaacgccatctgttccgctgtccccgtggattgggttccgacaagcagaaccacatggtccattcacgcccatcaccaatggatgaccacggaggacatgctttctgtgtggaatcgcgtctggatcgaagagaacccttggatggaagataaaacccggattagctcctgggaggacgtgccctacctgggaaagagagaggaccagtggtgcggcagcctcatcgggctgacagcccgggctacctgggccacaaatatccaggttgcgattaaccaggtgagacgcctgatcggaaatgaaaactactctgattatatgacctccatgaaacggttcaagaatgagagcgaacccgagggcgctctctggtga

SEQ ID NO: 19503 - RNA, 9879 nt, synthetic construct
  misc_feature 1..9879: note = derived and/or modified CDS sequence (opt5) from DENV-1__KP686070__SS-prME
  source 1..9879: mol_type = other RNA
agcgtgaccatgctgctcatgctgcttcccacagccctggctttccacctcacgacccggggcggggagcctcatatgattgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaagggggtgtcctatgtcatgtgtacgggcagcttcaaactggagaaggaagtggccgagacacagcacggaaccgttcttgtgcaggtcaagtacgagggcaccgatgcgccgtgcaaaattcctatctctacacaagacgaaaagggggtgacccagaacggacggctcatcacagctaatcccattgtgacggataaagagaagcctgttaacatcgaaaccgagccgcccttcggcgagtcctatattgtcatcggggccggagaaaaagccctgaagctgagctggtttaagaaaggctctagcattgggaagatgttcgaggctacagccagaggcgctcgccggatggccatcctcggagacaccgcgtgggattttggctccatcgggggagtgttcacatctgtgggcaaactggtccatcaggtgtttgggaccgcctacggagttcttttcagcggcgtgtcctggacgatgaagattgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctctccgccgcgattggcaaggcctgggaggagggggtgtgcggcatcagatctgctacgcgcctggaaaatatcatgtggaaacagattagcaacgagcttaatcatatcctgctcgaaaacgacatgaagtttacagtcgtggtgggagacgccaatggcattctgacccaggggaaaaagatgatccggccgcaacccatggagcacaaatactcctggaagtcttggggaaaggctaaaattatcggcgccgatacccagaacacaaccttcatcattgacgggcctgatacgcccgaatgtcctgacgatcagagagcctggaatatctgggaggtcgaggactatggatttggcgttttcacaaccaacatttggctgaaacttcgcgatagctacacacagatgtgcgaccaccggctcatgtccgctgcgatcaaagatagcaaggccgtgcatgctgacatgggctattggattgaatctgagaaaaatgaaacctggaagctggccagagcctcctttatcgaggtgaagacatgtatctggccccgcagccacaccctgtggtctaacggggtcctcgaatccgagatgattatcccgaaaatttacggaggccctatcagccaacataattatcggcccgggtacttcacgcagaccgctggaccttggcacctgggcaaacttgagctggatttcaacctctgcgaagggacaaccgtggttgtggacgagcactgcggaaatagaggcccctctctgcggacaaccacggtcacaggcaaaattatccatgaatggtgttgccgcagctgtaccctgcctccccttagatttagaggggaagatggatgctggtacggcatggagatcagaccggtgaaggaaaaagaggaaaacctcgttcgctccatggtgagcgccgggtctggagaggtcgactccttcagcctgggcctgctctgtgtgtccattatgatcgaagaggttatgcggtctagatggagccgcaagatgctgatgacagggacccttgcggtgtttttcctgctcattatgggacagctgacctggaatgacctgatcagactttgcattatggtcggcgctaacgtgtccgatcggatgggcatggggacaacgtatctggccctcatggccacctttaagatgcgccctatgttcgctgtgggactgctctttagacggctgacatctcgcgaggtccttctgctcaccatcggcctgagcctggttgcctccgtggaacttcccaactctctggaggaactcggggacggactggcgatgggcattatgatgctcaaactgcttacagatttccaaagccaccagctgtggaccacgctcctgtccctgacatttatcaagaccacccttagcctggactacgcttggaaaacaatggccatggtgctctctatcgtctccctgttccccctctgtctgagcaccacatctcagaagacgacctggcttcctgtgctgctggggtcctttggatgcaaaccgctcacaatgttcctgattaccgagaataagatctggggcagaaagagctggccccttaacgaaggcattatggccgttgggatcgtgtctattctgctctccagcctgctcaaaaatgatgtccctctggctggaccccttatcgccggcgggatgctgatcgcttgttatgtgatttccggaagctctgccgacctgagcctcgagcgggcggccgaggtttcctgggaagaggaagctgagcattctggcgccagccacaacatcctggtggaagtccaggatgacgggacaatgaagattaaagatgaggagcgcgacgatacccttacgatcctgctcaaggctaccctgctcgccgtgtccggagtctaccctatgtctattcccgccacactgtttgtgtggtatttctggcagaagaagaaacagagaagcggcgttctttgggacacccctagccctcccgaagtggagcgggctgtcctggatgacggcatctaccgcatcctgcagagagggctcctgggacggtctcaggtgggcgttggggtgttccaagacggagtctttcatacaatgtggcacgtgaccagaggcgcggtgcttatgtatcaggggaaacgcctggaacccagctgggcctccgttaagaaagatctcattagctacggaggcggctggcggttccaggggtcttggaatacaggagaggaggtccaggtgatcgctgtggaacccggcaagaaccctaaaaatgtccaaacgacccccgggacatttaagaccccggagggagaagtgggcgccattgccctggacttcaaacctgggacctccggaagccccatcgttaacagagagggcaagattgtgggcctctacgggaatggagtcgtgacaacgtctggcacctatgtttccgctatcgcccaggcgaaggctagccaggaagggcctctgcccgagattgaggatgaagtgtttaaaaagcgcaaccttacaatcatggacctgcaccccggatccggcaaaacccggagatacctgcctgccatcgtccgcgaggccattaagcggaaactcagaacactgatccttgctccgacccgcgtggttgcctctgaaatggcggaggctctgaaggggatgcccattcggtatcaaacgacagccgtgaagtccgaacataccggcaaagagatcgtcgatctcatgtgccacgccaccttcacaatgagactgctgtcccctgtgcgggtgcccaattacaacatgattatcatggacgaggctcattttaccgatcctgccagcatcgctgcccgcggatatatttctacaagagtcggcatgggggaagcggccgctatcttcatgaccgccacgccccctggatccgttgaggcttttccgcagagcaatgccgtgattcaggacgaagaacgggatatccccgaacgctcttggaacagcggctacgactggattacagatttccctgggaagaccgtgtggtttgtcccctccatcaaatctggaaatgacatcgccaactgtctcagaaagaacggcaaacgggtgattcagcttagcagaaagacattcgacaccgagtatcaaaagacgaaaaataacgattgggactacgttgtgaccacagatatctccgagatgggggctaatttccgcgcggaccgggtcattgatcctagacgctgcctgaagcccgtgatcctgaaagacggcccggaacgggttattctcgccggacctatgcccgtgaccgctgcctctgccgctcagagacgcggccggatcgggagaaaccagaataaggagggagatcagtacatttatatgggccaacccctgaacaatgacgaagatcacgcccattggacagaggcgaaaatgcttctggacaacatcaatacccctgaggggatcattcccgctctctttgaacctgagcgcgaaaagagcgccgccatcgatggagagtacagactgcggggcgaagctcgcaagacattcgtcgagctgatgagaagaggggacctcccggtgtggctttcctataaagtcgccagcgagggctttcagtactctgatcgcagatggtgcttcgacggagaacggaacaatcaggtgctggaggaaaacatggacgttgagatttggaccaaggaaggcgagcgcaagaagctgcgcccccggtggctcgatgcgagaacgtattccgaccctctggcccttcgcgagtttaaagagttcgctgccgggcggagaagcgtgtccggagatctgatcctcgagattggcaagctgccccagcacctgacactccgggctcaaaatgcccttgacaacctggtgatgctgcacaattctgaacaagggggaaaggcttaccgccatgccatggaggaactccctgataccatcgagaccctgatgcttctggcgctcatcgccgtcctgacaggcggcgttaccctgtttttcctcagcgggaagggacttggcaagacatccattgggctgctgtgtgtgatggcttctagcgtgctcctgtggatggcctccgtcgagccccactggatcgctgccagcattatccttgaatttttcctgatggtgctcctgattccggagcctgacagacagcggacgccccaggataaccaactggcctatgttgtgatcggactcctttttatgatcctgaccgtcgctgcgaacgaaatgggcctgctcgagacaaccaaaaaggacctggggattggacatgtggtcgccgagaatcaccaccatgctacaatgcttgatatcgacctgcaccctgcctctgcctggaccctctacgctgtggccacgaccattatcacacccatgatgcgccataccattgaaaacacaaccgcgaatatctccctgacggccattgctaaccaggccgctatcctgatgggcctcgataaaggctggcctatcagcaagatggacattggggttccccttctggccctgggatgctactctcaggtgaatccgctcacactgaccgcggccgtctccatgcttgtggctcactatgccatcattggccctgggctgcaagctaaagccacaagagaggctcagaagcggaccgccgcgggaatcatgaagaaccccaccgttgatggcattgtggccatcgacctcgaccccgtcgtgtacgatgctaaattcgaaaagcagctggggcagatcatgctgctcattctttgtacaagccaaatcctgctgatgcgcacgacctgggccctctgcgagtctattacactggctaccggacctcttacaaccctgtgggaaggcagcccgggcaaattttggaatacgacaatcgccgtgtccatggccaacattttcagagggtcttatctcgcgggagctggcctggccttcagcctgatgaagtccctcgggggaggccggcgcgggaccggagctcagggcgagacccttggcgagaaatggaagagacagctgaatcagctgagcaagtccgaatttaacacatacaaacggtctgggatcatggaggttgacagaagcgaagccaaggagggactcaaacgcggcgaaaccacaaagcatgccgtctcccgggggacggctaaactgagatggttcgtggagcgcaatcttgtgaagcccgagggaaaggtcatcgatctgggctgtgggcggggaggctggtcttattactgcgccggcctcaaaaaggttaccgaagtgaaagggtatacaaagggaggccctgggcacgaggaacccattcctatggcgacctacggatggaacatcgtgaaactgcacagcggcagagacgtctttttcacaccccctgagaagtgtgataccctgctctgcgacattggggaatcctctccgaatcccacgatcgaggagggacgcacccttcgggtgctgaaaatggttgaaccttggctgagaggcaaccaattttgtattaagatcctcaatccctacatgcctagcgtggtcgagacactggaacagatgcagcgcaagcatggcgggatgcttgtgcggaaccccctgtccagaaatagcacccacgagatgtattgggtttcttgcggaacaggcaacattgtgtccgccgtcaacatgaccagccgcatgctcctgaatcggttcacaatggctcatagaaaaccgacctacgagcgcgatgtggacctgggggccggaacgagacacgtggctgtcgaacctgagatcgccaacctcgatatcattggccagcggatcgaaaatattaagaacgagcacaaatctacatggcattatgacgaagataatccctacaagacctgggcgtatcacgggtcctacgaggttaaacccagcggatctgcctccagcatggtgaacggcgtggtccgcctgcttaccaagccttgggacgtgatccccatggttacacaaattgctatgacggacaccacaccttttggccagcagagagtgttcaaggagaaagtcgatacccggacaccgagacccaagcgggggaccgcccaaatcatggaagtgacagctaaatggctgtggggatttctctcccgcaataagaaacctagaatctgtacccgggaggagttcacgcgcaaggttagaagcaacgccgctattggcgccgtgtttgtcgacgagaatcagtggaactctgcgaaggaagccgtggaggatgagcggttctgggacctggttcatcgcgaaagagagcttcacaaacaggggaagtgcgctacctgcgtgtataatatgatgggaaaacgggaaaagaaactgggcgagtttgggaaggccaagggcagccgcgctatctggtacatgtggctcggagccagattcctggagttcgaggccctgggctttatgaacgaggatcattggttctcccgggaaaattctctcagcggggtcgagggagaaggcctgcacaaacttgggtacattctgcgcgacatctccaagattcccggaggcaacatgtatgcggatgacacagctgggtgggataccagaatcacagaggacgatctccagaatgaggccaaaatcaccgacattatggaacctgagcacgccctgcttgctacgtctatctttaagctgacataccaaaacaaagtggtccgggtgcagcgccccgccaagagcggcaccgttatggatgtgatttccagacgggaccagagaggatctggccaggtcgggacatatggactcaacaccttcacgaatatggaagtgcaactgatccgccagatggagagcgaaggcatcttttccccgagcgagctggagaactctaatctcgctgaacgggtgctggactggcttgagaaacatggggttgaaagactgaagcgcatggccatctccggagatgactgtgtggtcaagcctaccgatgaccggttcgcgacagccctcaccgctctgaacgatatgggcaaagtgagaaaggacatcccccagtgggagcctagcaaagggtggaatgattggcagcaagttcccttttgctctcaccatttccaccagcttattatgaaggacggccgcgaaatcgtggtcccttgtcggaaccaggatgagctggtgggacgggcccgcgtctcccagggcgctgggtggagcctccgggagacagcctgcctgggaaaatcctacgcgcaaatgtggcagctgatgtattttcacagacgcgacctccggctggccgctaatgccatttgttctgctgtgcccgttaactgggtgccgaccagcagaacaacctggtccatccatgcccaccatcagtggatgacgacagaagatatgcttagcgtctggaatcgggtgtggattgaggaaaacccttggatggaggacaagacccacgtttcttcctgggaagacgtgccctacctgggcaagagagaggatcaatggtgcgggagcctcatcggactgaccgctcgcgccacatgggcgaccaatattcaggtcgccatcaaccaggtgcggagacttatcggcaatgagaactatctggactacatgacatctatgaaacgcttcaagaatgaaagcgatcccgagggggctctctggtga

SEQ ID NO: 19504 - RNA, 9876 nt, synthetic construct
  misc_feature 1..9876: note = derived and/or modified CDS sequence (opt5) from DENV-1__KF672760__SS-prME
  source 1..9876: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttttggcgggcctatcagccaacataattaccggcccggatatttcacccagacggccggcccttggcacctcgggaagctggaacttgattttgacctgtgcgagggaaccacagtggttgtggatgaacactgcggcaacagaggcccctctctccggaccacaaccgtcacggggaaaattatccatgagtggtgttgccgcagctgtacactgcctcccctgagattccggggagaggacggctgctggtacgggatggaaattagaccggtgaaggagaaagaagagaatcttgttcgctccatggtgagcgcgggatctggcgaagtcgattcctttagcctcgggatcctgtgtgtgtccatgatgatcgaggaggttatgcggtctagatggagccgcaagatgctgatgaccggaacactcgctgtgttcctgcttctgattatgggccagctcacctggaacgacctgatcagactgtgcattatggtcggcgccaatgcctccgaccggatggggatgggaaccacataccttgctctgatggccacgtttaagatgcgccctatgttcgcggtgggcctcctgtttagacggctcacctctcgcgaagtgctgcttctgacaatcgggctcagcctggtcgcttgtgttgagctgcccaactcccttgaagagctgggagatggcctcgccatggggattatgatgctgaaactcctgaccgaattccaaccccaccagctttggacaaccctgctctctctgacgtttgtgaagacaaccctgagccttgactatgcctggaaaaccacagctatggtgctgtccatcgtcagcctcttccctctgtgcctctctaccacatcccagaagacgacctggctgccggtgcttctgggaagctttggctgtaaacccctgacaatgttcctcattaccgagaacaagatctggggcagaaagtcttggcctctgaatgaggggatcatggccattggaatcgtttccattcttctgagctctctcctgaaaaacgatgtgcccctcgctggccctctgatcgccgggggaatgcttattgcgtgctacgtcatctccggcagctccgccgacctgagcctggaaaaggctgccgaggtgtcttgggaacaggaggctgaacatagcggggcctcccacaatatcctcgttgaggtgcaagatgacggaacaatgaaaattaaggatgaggaacgggacgataccctgacgatccttctgaaagccaccctcctggctgtctctggcgtgtatcccatgagcattcctgcgacactcttcgtctggtacttttggcagaagaaaaagcagcgctccggcgtgctgtgggacaccccctctccgcctgaggttgaaagagccgtgcttgatgacgggatctatcggattctgcagcgcggactgctcggcagaagccaagtcggggtgggagttttccaggatggcgtgtttcatacaatgtggcacgtcacccggggggctgtgctgatgtaccagggaaagagacttgagccctcctgggcctctgtgaaaaaggacctgatcagctatggcggcgggtggcgcttccagggatcctggaacacaggcgaggaagttcaagtcatcgccgtggagcctgggaaaaatcccaagaacgtgcagacgaccccgggaacatttaaaacccctgaaggcgaggtcggggctattgccctcgacttcaagcccggaaccagcggctctcctatcgtgaatcgggaaggcaagattgttgggctgtacggaaacggcgtggtcacaacgtccgggacctacgtgagcgcgatcgctcaggccaaagcctctcaagagggacccctccccgagattgaagatgaggtttttaagaaaagaaatctgacaatcatggaccttcaccctggctccgggaagacccgccggtatctgccggctattgtgagagaagccatcaaacgcaagctgcggacactcatcctggcgcccaccagagtcgtggctagcgagatggccgaagcccttaagggcatgcctattcgctaccagacgacagctgttaaatccgagcataccggacgggagatcgtggatctgatgtgtcacgccaccttcacaatgagactcctgtctcccgtccgggtgcctaactataatatgattatcatggacgaagctcattttaccgatcccgccagcattgcggcccgcggctacatctccacaagagtggggatgggagaggctgccgctatcttcatgaccgccacgcctccgggcagcgtcgaagcctttccccagtctaacgctgttattcaggacgaggaacgggatatccctgagcgctcctggaatagcgggtatgactggattacagatttccccggaaagaccgtgtggttcgtgccttctatcaaaagcggcaacgacattgcgaattgcctgagaaagaacgggaaacgggtcatccaactctccagaaagacatttgataccgagtaccagaagacgaaaaacaatgactgggactatgtggttaccacagatatctctgaaatgggcgccaacttccgcgctgaccgggtgattgatcccagacgctgccttaagccggtcatcctgaaagacggacctgagcgggtgattctggccggccccatgcccgttaccgtggccagcgctgcccagagacgcgggcggatcggaagaaatcagaacaaggaaggcgatcaatacgtctacatggggcagcctctcaataacgacgaggatcacgcgcattggacagaggctaaaatgctgcttgacaatattaacacccccgaaggaatcattcctgccctgtttgagccggaacgcgagaagtccgccgctatcgatggcgaatatagactccggggggaggcccgcaagacattcgtggagctgatgagacggggcgacctgcccgtctggctctcttacaaagtggcgagcgaaggatttcagtattccgatcgcagatggtgtttcgacggcgagcggaataaccaggttcttgaagagaatatggatgtggaaatctggaccaaggagggggagagaaaaaagctgcgccctcggtggctggacgccagaacgtacagcgaccccctcgctctgcgcgaatttaaagagttcgccgctggacggagatctgtgtccggcgatcttattctggaaatcgggaagctccctcaacacctgacactgcgggcccagaacgctctcgacaatcttgtcatgctgcacaacagcgagcagggaggcaaagcctatcgccatgcgatggaagagctgcccgataccattgagaccctcatgctgcttgccctgatcgctgttctcacaggcggggtgaccctgtttttcctgtccggaaagggcctcgggaagacatctattggacttctgtgcgtgacggccagctccgctctgctctggatggcctctgtcgaaccgcactggatcgccgctagcatcattctggagtttttccttatggtgctgctcatccctgaacccgacagacagcggacccctcaagataatcagctggcgtacgttgtgattggcctgctctttatgatccttacagtcgccgctaacgagatggggctgctggagaccacaaaaaaggacctcggaattggctatgtggccgccgaaaaccatcagcacgctaccatgctggatgtcgaccttcaccccgcctccgcgtggacgctgtacgccgtggctaccacagttatcacccctatgatgcgccatacaatcgagaataccacggccaacattagcctcacagctatcgccaatcaagcggccattctgatgggcctggataaagggtggcccatctctaagatggacattggagtgccgctccttgctctgggctgttactcccaggtcaaccctctgaccctcacagccgctgtgctgatgcttgttgcccactatgctatcattgggcccggactgcaggccaaagcgaccagagaagcccagaagcggaccgctgccggcatcatgaagaatcccacagtggatgggatcgtcgctattgacctcgatcctgtggtgtacgacgccaaattcgagaagcaactgggacagatcatgctgctcattctttgcacgagccagatcctgctgatgcgcaccacatgggccctctgtgaatctattaccctggcgacaggcccgcttaccacgctgtgggagggctcccccgggaaattctggaacacaaccatcgctgttagcatggccaatatctttagaggatcttatctcgctggcgccgggctggccttcagcctgatgaagtccctcggaggcgggcggcgcggaaccggcgctcagggcgagacacttggggaaaaatggaagagacaactgaaccagctgtctaagagcgagtttaatacctacaaacggtccggaattatggaagtcgacagaagcgaggccaaggaaggcctcaaacgcggggagacaacgaagcatgcggtgtcccggggaaccgccaaactgagatggttcgtggagcgcaaccttgtcaagcctgaaggcaaggttatcgatctggggtgcggacggggcggctggtcttattactgtgctgggctcaaaaaggtgacagaggtgaaaggatataccaagggcgggcccggacacgaagagcctattcccatggccacatacggctggaatctggtcaaactgcatagcgggaaggacgtgtttttcatgcctccggaaaaatgcgataccctcctttgtgacatcggagagtcctctcccaaccctacgattgaggaaggcagaaccctgcgcgttctgaagatggtggagccctggctccggggcaatcagttttgcatcaagatcctgaacccttacatgcccagcgtcgtggaaacacttgagagaatgcagcgcaaacacgggggaatgctggttcggaatccgctctccagaaactctacccacgagatgtattgggtgagctgtggcacagggaatattgtctccgctgtgaacatgaccagccgcatgctgctgaaccggttcacaatggcccatagaaagcctacctacgaacgcgatgtggacctcggagcgggcacgagacacgtcgccgttgagcccgaagtggctaatctggatatcattgggcaacggatcgagaacattaaaaatgaacataagtctacatggcactatgacgaggataacccctacaaaacctgggcctatcacggatcctacgaggtgaagcctagcggctctgcttccagcatggtcaatggcgtggttcgccttctgaccaagccctgggacgtgatccctatggtcacacagattgccatgacggataccacaccgtttgggcagcaaagagtgttcaaagaaaaggttgacacccggacacccagagctaaacggggaaccacacagatcatggaggtgaccgccaagtggctctggggctttctgtctcgcaacaaaaagcctagaatctgcacgcgggaagagttcacccgcaaggtcagatccaatgcggccattggggctgtgtttgttgacgaaaaccagtggaatagcgccaaagaggctgtggaggatgaacggttctgggaccttgtccatcgcgagagagaactgcacaagcagggaaaatgcgccacatgtgtgtataacatgatgggcaagcgggagaaaaagctcggggaattcggcaaggccaaaggatcccgcgcgatctggtacatgtggctgggcgctagatttctggagttcgaggccctcgggtttatgaatgaagatcattggttcagccgggagaactctctgagcggagtcgaaggcgaggggcttcacaagctgggatacattctccgcgacatctccaaaattcccggcgggaatatgtatgccgatgacaccgctggctgggatacaagaatcaccgaggacgatctgcaaaacgaagccaagatcacggacattatggagcctgaacatgctcttctggccacatctatctttaaactcacctaccagaataaggtggttcgggtgcagcgccccgcgaaaaacggaacagtcatggatgtgattagcagacgggaccagagaggctccgggcaagtgggaacctatggcctgaacacgttcaccaatatggaggttcagctgatccgccagatggaatctgaggggatttttctcccgagcgagctggaaacacctaaccttgccgagcgggctctggattggctcgaaaagcacggagccgagagactgaagcgcatggctatctccggcgacgactgcgtggtcaaacccatcgatgaccggttcgccaccgcgcttacagccctgaatgatatggggaaggtgagaaaagacattcctcagtgggaaccctctaagggctggaacgattggcaacaggttcctttttgtagccaccatttccaccagctcatcatgaaagacggacgcgagattgtggtcccctgccggaatcaggatgagctggtgggcagagctcgcgtctcccaaggggccggatggagcctgcgggaaaccgcttgtctcggcaagtcttacgcccagatgtggcagctgatgtattttcatagacgcgaccttcggctggctgccaacgcgatctgctccgccgtgccggttgattgggtgcctgctagcagaacaacctggtctattcacgcccaccatcaatggatgacgacagaggacatgctctccgtctggaatcgggtgtggatcgaagagaacccctggatggaagataagacccacgttagctcctgggaggaggtgccctacctggggaaaagagaagaccagtggtgtggatctcttatcggcctgaccgcccgcgctacatgggccaccaatattcaggtcgcgatcaaccaggtgcggagactcattgggaatgagaactatctggactacatgacaagcatgaagcgcttcaaaaatgaatccgatcctgagggcgctctgtgg

SEQ ID NO: 19505 - RNA, 9876 nt, synthetic construct
  misc_feature 1..9876: note = derived and/or modified CDS sequence (opt5) from DENV-1__KF672759__SS-prME
  source 1..9876: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaaagctcgagggaaaaattgtgcagtacgaaaacctgaagtattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagccccagaacaggccttgatttcaacgaaatggtcctgctcaccatgaaagagaagtcttggctggtgcataaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcacaccgctctgacaggggccacggaaattcagaccagcggaacaaccacaatctttgccggccatcttaagtgccgcctgaaaatggacaagctcaccctgaaagggatgtcctatgtcatgtgtacgggcagcttcaagctggagaaggaagtggctgagacacagcacggaaccgttcttgtgcaggtcaaatacgagggcaccgatgccccgtgcaagattcctttcctcacacaagacgaaaaaggggtgacccagaacggaagactgatcacagcgaatcccatcgtgacggataaggagaaacctgttaacattgaaaccgagcccccctttggcgagtcttatatcgtcgtgggggctggagaaaaggccctgaagctctcctggttcaaaaagggcagctctattgggaaaatgtttgaggccacagctcggggcgccagacgcatggctatcctgggagacaccgcctgggatttcggcagcattgggggactttttacatccgtgggcaagctgatccatcaggtcttcgggaccgcgtacggagtgctcttttctggcgttagctggacgatgaaaatcgggattggcatcctgctgacctggcttggactcaattcccggagcacatctctgtccatgacctgtattgccgtgggcatggtcacactgtacctcggggtgatggttcaggctgacagcggatgcgtgatcaactggaagggcagagaactgaagtgtgggtctggaattttcgtcaccaacgaggtgcacacatggaccgaacaatataaatttcaggccgattcccctaagcgccttagcgctgccatcggcaaagcgtgggaggagggggtttgcggcattcggtccgccacgagactggaaaatatcatgtggaagcagatctctaacgagctcaattacattctgctggaaaacgacatgaaattcacagtggtcgtgggagacgtgaatggcatccttgctcaggggaagaaaatgattcgcccgcaacccatggagcataagtatagctggaagtcctggggaaaagccaagatcattggcgctgatatccagaacaccacctttatcattgacgggcctgatacacccgaatgtcctgacgatcagcgggcctggaatatctgggaggtcgaggactacggattcggcatttttaccacgaacatctggctcaaactgagagattctcacacacagatgtgcgaccaccgcctgatgagcgccgctattaaggattccaaagcggttcatgccgacatgggctattggatcgaaagcgagaagaatgaaacctggaagctcgctcgggcctctttcatcgaggtgaaaacatgtatttggcccaagtcccacaccctgtggagcaacggggtgcttgaatctgagatggtcatcccgaaaatttacggaggccctatctcccaacataattatagacccgggtacttcacacagaccgccggaccttggcacctgggcaagctcgagctggattttgacctgtgcgaagggacgaccgtggttgtggatgagcactgcggataccgcggccccagccttcggacaaccacagtcaccggcaaaattatccatgaatggtgttgcagatcttgtacgctccctcccctgcggttccgcggggaggacggatgctggtatggcatggagatcagaccggtgaaggaaaaggaggaaaacctggttcggagcatggtgtccgctgggagcggagaggtcgactctttttccctcggcattctgtgtgtgagcatccttattgaagaggttatgagatcccgctggtctcggaaaatgctgatgacagggaccctcgccgtgttcctgctgcttatcatgggacagctgacatggaatgatctcattagactgtgcatcatggtcggcgcgaacgctagcgaccgcatgggcatggggaccacctacctcgccctgatggccacatttaagatgagacctatgttcgctgtgggacttctgtttcggcgcctcacgtgtagagaggtgctgctgcttaccgtcggcctgtccctcgttgcctctgtggaactgcccaatagcctcgaggaactgggggatggacttgcgatgggcattatgatgctgaaactcctgacagacttccaaccccaccagctgtggaccacacttctgtccctcacctttatccggacgtctctgagcctcgattatgcttggaagacaatggccatggccctgtccatcgtgagccttttccctctgtgcctgtctaccacctcccagaaaacaacctggctcccggtcctgcttgggagctttggatgtaagcccctgacaatgttcctcattacggagaacaagatctggggccgcaaatcttggcctattaacgaaggcatcatggctgtggggattgtttccatcctgctcagctctctgcttaagaatgacgtgcccctggccggacctctgatcgctggcgggatgctcattgcctgctacgtcatctccggaagctccgcggatctgagccttgagaaagccgctgaggtgtcttgggaagaggaagccgagcatagcggcacctcccacaacattctggttgaagtgcaggacgatgggacaatgaagatcaaagacgaggagagagatgacaccctcacaattctgctcaaggctaccctgcttgccgtctctggagtgtatcccatgagcatccctgccacgctgtttgtctggtacttctggcaaaaaaagaagcagcggtccggcgtgctgtgggataccccctctccgcctaaagttgaacgcgctgtgctcgacgacggcatctatagaattctgcagcgggggcttctgggacgcagccaggtcggcgtgggggttttccaagatggagtgtttcatacaatgtggcacgtcaccagaggcgcggtgctcatgtaccaggggaagcggctggagccctcctgggcctctgtgaaaaaggacctcatcagctacggaggcggctggagattccaggggtcctggaatacaggagaagaggttcaggtcattgctgtggagcctggcaaaaaccccaagaatgtgcaaaccacaccggggacgtttaagacccctgaaggagaggtcggcgccatcgccctggatttcaaacccgggacaagcggatctcctattgtgaaccgcgaaggcaagatcgttggcctttatgggaatggagtggtcaccacctccggcacatacgtgagcgctattgcccaggcgaaagctacgcaggaggggcccctgcccgaaatcgaggacgaggtttttaagaaacggaacctgaccatcatggatctccaccctggatctggcaagacaagacgctatctgccggccattgtgcgggaagccatcaagagaaaacttcgcaccctgattctcgctcccacacgggtcgtggcctccgagatggcggaagctctgaaggggatgcctatcagataccaaaccacggccgttaaaagcgagcatacaggccgcgaaattgtggacctgatgtgtcacgccaccttcaccatgcggctcctttcccccgtcagagtgcctaattataacatgatcatcatggatgaggctcattttacagaccccgcctctattgctgcccggggatacatcagcacccgcgtgggcatgggggaggcggccgctattttcatgacagccacccctccgggatccgtcgaagcttttccccagagcaatgccgttatccaggatgaggaaagagacattcctgagcggtcttggaactccggctatgattggatcacggacttccccgggaagacagtgtggtttgtgcctagcatcaaatctggaaatgacattgccaactgcctgcgcaagaatggcaagagagtcatccagctgagccggaaaaccttcgatacagaataccaaaagaccaaaaacaacgactgggattacgtggttacgaccgacatttccgagatgggggctaatttcagagcggatcgcgtgatcgacccccggagatgcctcaagccggtcattctgaaagagggccctgaacgcgtgatccttgccggacccatgcccgttacagtggcttctgccgcccagcggagaggccgcattgggcggaaccagaataaggagggagatcagtatatctacatgggccaacctctgaacaatgacgaagatcacgctcattggaccgaggccaagatgctcctggacaacatcaatacacccgaggggattatccctgcgctgtttgaaccggagagagaaaaaagcgctgccattgatggagagtatcgcctcagaggcgaagcccggaagaccttcgtcgagcttatgcgcagaggggacctgcccgtgtggctgtcctacaaagtcgcttctgagggctttcagtatagcgatcggcgctggtgtttcgacggagaaagaaacaatcaggtgctcgaggaaaacatggacgttgagatctggacaaaggaaggcgagcggaaaaagctgagacctcgctggcttgatgcccggacctactccgaccccctggcgctcagagagtttaaagaattcgccgctgggcgccggagcgtgtctggagatctgattctggagatcggcaagctccctcagcaccttacgctgagagcccaaaatgctctggacaacctcgtgatgctgcacaattccgaacaggggggaaaggcctatcggcatgctatggaggaacttcccgatacaatcgagaccctgatgctcctggccctgattgcggtcctcaccggcggcgttacactttttttcctgagcgggaaaggactgggcaagacctccatcgggctcctgtgcgtgatggcctctagcgctcttctgtggatggcctccgtggagccgcactggattgctgcctctatcattctcgaatttttcctgatggtcctgctcatccctgagcccgaccgccagagaacacctcaggataaccaacttgcctacgtggttatcggactgctgtttatgattctcacggtggctgcgaatgaaatgggcctgcttgagaccacaaaaaaggacctggggatcggacatgtcgccgtggagaaccaccaccatgctaccatgctcgatgtcgacctgcggcccgccagcgcctggacactgtacgctgtggccaccacggttattacccctatgatgcgccacacaatcgaaaacaccacagcgaatatttccctcaccgccatcgctaaccaggccgctattcttatgggcctggataaaggctggcccatcagcaagatggacatcggggtgccgctgctcgccctgggatgttattctcaggtcaatcctcttacgctgacagcggccgtgctcatgctggttgctcattacgccattatcggccccgggctgcaagctaaggccaccagagaggctcagaaacggacagccgcgggaattatgaagaaccccaccgtggatggcatcgtcaccattgacctcgaccctgtggtgtatgatgccaaattcgaaaagcagcttgggcagatcatgctgctgatcctctgcacatcccaaattctgcttatgcgcacgacctgggctctgtgtgagagcatcacactcgccaccggaccgctgacaaccctgtgggaaggctctcccggcaaattttggaatacgacaattgctgtttccatggccaacatcttcagagggagctacctcgccggagcgggccttgctttctctctgatgaagagcctggggggaggccggcgcgggaccggagcccagggcgagaccctcggcgagaagtggaaaagacagctgaatcagctttccaagtctgaatttaacacatataaaaagagcgggattatggaggtcgaccggtccgaagctaaagagggactgaagagaggcgaaaccacaaagcacgccgtgagccgcgggacggccaaactccggtggttcgtggagagaaatctggtcaagcctgagggaaaagttatcgatctgggctgcgggcgcggaggctggtcctactattgtgctggcctcaagaaagtgaccgaagtgaaggggtacacaaaaggaggccccgggcatgaggaacctatccccatggccacctacggatggaaccttgtcaagctgcactctggcaaggacgtgtttttcacacctccggagaaatgcgataccctgctctgtgacattggggaaagctcccccaatcctacgatcgaggagggacggaccctgagagttcttaagatggtggaaccctggctgcgcggcaaccaattttgcattaaaatcctcaatccttatatgccctctgtcgtggagacactggaacagatgcagcggaagcacggcgggatgctggttagaaacccgctcagccgcaattccacccatgagatgtactgggtgtcttgtggaacaggcaacattgtcagcgcggtgaatatgacctcccggatgctgcttaacagattcacaatggcccaccgcaaacctacctatgagcgggatgtggacctgggggctggaacgagacatgtcgccgttgaacccgaggtggctaacctcgatatcattggccagcgcatcgaaaatatcaagaacgagcacaagagcacatggcactacgacgaagataatccctataaaacctgggcctaccatgggtcttatgaggtgaagccttccggaagcgcgtcttccatggtcaacggcgtggttagactgcttaccaaaccctgggacgtgattcctatggtcacacaaatcgccatgacggacaccacaccgtttggccagcagcgggtgttcaaggagaaagttgatacccgcacacccagagctaagcgggggaccgcccaaattatggaagtgacagctaagtggctgtggggatttctcagcagaaataaaaagcctcggatctgcacccgcgaggaattcacgagaaaagtccggtctaacgccgctattggcgccgtgtttgttgacgagaatcagtggaactccgcgaaggaagccgtggaggatgagcgcttctgggacctggtccacagagaacgggagctgcataaacaggggaagtgcgctacctgtgtgtacaatatgatgggaaagcgcgaaaaaaagctcggcgagtttgggaaagccaagggcagcagagctatctggtacatgtggctgggagcccggttccttgaattcgaggccctgggctttatgaacgaggatcactggttctcccgcgaaaatagcctctctggggtcgagggagaaggcctgcataaacttgggtatatcctgagagacattagcaagatccccggaggcaacatgtacgcggatgacacagctgggtgggatacccggattacagaggacgatctccagaatgaggccaaaatcaccgacattatggaacctgagcacgccctgctggctacgtccatctttaagctcacatatcaaaacaaggtggttcgcgtgcagagacccgccaaatctggcaccgtcatggatgtgatcagccggcgcgaccagagaggatccggccaggtggggacatacggactgaataccttcacgaacatggaagttcaacttattcggcagatggagtctgaaggcatctttagcccgtccgagctggagacccctaacctcgctaagaaagtgctggactggcttgaaaagcacggggccgagagactgaaacgcatggcgatttctggagatgactgcgtcgtgaagcccatcgatgaccggttcgccacagctctcaccgccctgaatgatatgggcaaggttagaaaagacattcctcagtgggaacccagcaaggggtggaacgattggcagcaagtgcctttttgttcccatcacttccatcagctgatcatgaaagacggccgcgagatcgtcgtgccctgccggaatcaggatgaactcgtcggaagagctcgcgtgagccagggcgccgggtggtctctgcgggagacagcgtgtcttggaaagtcctatgcccaaatgtggcagctgatgtactttcacagacgcgacctccggctggctgccaacgctatttgcagcgccgttccggtggattgggtccctacctctagaacaacctggtccatccacgctcatcaccagtggatgacgacagaggacatgcttagcgtgtggaatcgcgtttggattgaagagaacccctggatggaagacaaaacccatgtgtcctcttgggaggaagtcccctatctgggcaagcgggaggatcaatggtgtgggagcctcatcggactgaccgccagagcgacatgggccaccaatattcaggtggctatcaaccaggtgcggagactgattggcaatgagaactacctcgactacatgacatccatgaagcgcttcaaaaatgaaagcgatcctgagggggccctgtgg

SEQ ID NO: 19506 - RNA, 9876 nt, synthetic construct
  misc_feature 1..9876: note = derived and/or modified CDS sequence (opt5) from DENV-1__KF672761__SS-prME
  source 1..9876: mol_type = other RNA
agcgtgaccatgctgttcatgctcctgcccacagcccttgcttttcacctgacgaccagaggcggggagcctcatatgatcgtctccaagcaggaacggggaaaatctctcctgttcaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgggcacagacgggacaagcgctctgtcgccctggctcctcatgtgggactgggcctcgagacaagaaccgagacgtggatgagctccgaaggcgcctggaaacagattcagaaggttgagacatgggctctgcggcaccccgggtttaccgtgatcgcccttttcctggcgcatgccattggaacatctatcacccagaagggcatcatttttatcctcctgatgcttgtcacccctagcatggctatgcgctgcgtggggattggaaacagagatttcgttgaaggcctgtccggggccacatgggtggacgtcgtgctcgagcacggaagctgtgtgacgaccatggctaaaaataagcccacactggatatcgagctgctcaaaaccgaagtcacaaaccctgccgttctgcggaagctttgcattgaggcgaaaatctctaataccacgacagactcccgctgtccgacccaaggcgaagccaccctggtggaggaacaggatgctaactttgtgtgcagacggacattcgtcgaccgcggctgggggaatggatgtggcctctttgggaagggaagcctgcttacctgcgccaagttcaaatgcgtgacaaagctggagggcaaaattgttcagtacgagaacctcaagtattctgtgatcgtcacggtgcacaccggggatcagcatcaagttggaaatgaaacaaccgagcacggcacaatcgctaccattacgccccaggcccctacctccgaaatccagctgacagactacggcgccctgaccctcgactgtagccccagaacagggctggattttaacgagatggtgcttctgaccatgaaagaaaagtcttggctcgtccataaacagtggttcctggaccttcctctgccctggacgtccggagctagcacatcccaagagacctggaatcggcaggatctcctggtgacatttaagaccgcgcacgccaagaaacaggaggtcgtggttctgggctctcaagaaggggctatgcacaccgccctcacaggagccacggagattcagaccagcggcacaaccacaatcttcgctgggcatctgaagtgccgccttaaaatggacaagctgaccctcaaaggcacgtcctatgtgatgtgtacaggaagcttcaagctggaaaaggaggtcgccgaaacccagcacggcaccgtgctggttcaggtgaaatacgaggggacagatgcgccgtgcaagattcctttttctacccaagacgagaaaggagtcacacagaacggcagacttatcacggctaatcccatcgtgaccgataaggaaaaacctgtgaacattgagacagaaccccccttcggggagtcctatatcgttgtcggagccggcgagaaggccctcaagctgagctggtttaaaaaggggtctagcattggcaaaatgttcgaagctaccgcccggggagctagacgcatggccatcctgggcgacacagcgtgggattttgggtccattggaggcgtgttcacctctgtggggaagctcgtccatcaggtgtttggaacggcctacggcgttctgttcagcggggtgtcctggaccatgaaaatcggcatcggaattcttctgacatggctcggcctgaatagccggtctacctccctgagcatgacatgtatcgctgtcgggatggtgaccctttacctcggagttatggtgcaggccgactctggctgcgtcattaactggaaggggagagagctgaagtgtggatccggcatctttgtgacaaacgaagttcacacctggacggagcaatataaattccaggctgatagccctaagcgcctgtccgccgcgattgggaaagcctgggaagagggcgtgtgcggaatccggtctgctacaagactcgagaatattatgtggaagcagatcagcaacgaactgaatcatatccttctggagaacgacatgaaatttaccgtcgtggtgggcgacgccaatgggattctcgctcagggaaagaaaatgatccgcccgcaacccatggaacacaagtactcctggaagtcttggggcaaagccaagattatcggggccgatattcagaacaccacattcatcatcgacggacctgatacccccgagtgtcctgacgaacagcgggcttggaatatttgggaggtcgaggattatggctttggcatcttcacgacaaacatttggctgaaactgagagacagctacacccagatgtgcgatcaccgccttatgtccgcggccatcaaggacagcaaagctgttcatgccgatatggggtattggattgaatctgagaagaatgaaacatggaagctcgcccgggcttccttcatcgaggtgaaaacctgtatctggcccaagagccacacactgtggtctaacggagtgctggaatccgagatgattatcccgaaaatttacggcgggcctatcagccaacataattatagacccggatactttacccagacggccggcccttggcacctcgggaagctggagcttgacttcgatctgtgcgaaggaaccacagtcgtggttgacgagcactgcggcaaccgcggcccctctctccggaccacaaccgtgacggggaaaattatccatgaatggtgttgcagaagctgtacactgcctcccctgcggtttcgcggagaggatggctgctggtacgggatggagatcagaccggtcaaggaaaaggaggaaaatcttgtgcggtccatggttagcgcgggatctggcgaggtggactccttcagcctcgggattctgtgtgtctccatcatgattgaagaggtgatgagatctcgctggagccggaaaatgctgatgaccggaacactcgctgtttttctgcttctgatcatgggccagctcacctggaacgacctgattagactgtgcatcatggtgggcgccaatgcctccgataagatggggatgggaaccacatatcttgctctgatggccacgttcaaaatgcgccctatgtttgcggtcggcctcctgttcagacggctcacctctcgcgaggtgctgcttctgacaattgggctcagcctggtggcttccgtcgaactgcccaactctcttgaggaactgggagacggcctcgccatggggatcatgatgctgaagctcctgaccgagtttcaaccccaccagctttggacaaccctgctcagcctgacgttcatcaaaacaaccctgtcccttgattacgcctggaagaccacagctatggttctgagcattgtgtctctctttcctctgtgtctctccaccacaagccagaagacgacctggctgccggtgcttctgggatctttcggctgcaaacccctgacaatgtttctcatcaccgaaaacaagatttggggcagaaaatcctggcctctgaatgaggggatcatggccattggaatcgtcagcatccttctgtcttccctcctgaagaacgacgtgcccctcgctggccctctgattgccgggggaatgcttatcgcgtgttatgttattagcggctccagcgccgatctgtctctggagaaagctgccgaagtgagctgggaggaagaggctgaacattccgggacatctcacaatatcctcgtcgaggtgcaggacgatggaaccatgaagattaaagacgaggaacgggatgacacgctgaccatccttctgaaggccacactcctggccgttagcggcgtgtaccccatgtccatccctgctaccctcttcgtctggtatttctggcaaaagaaaaagcagcgctctggcgtgctgtgggatacacccagcccgcctgaggtcgaaagagcggtgcttgacgatgggatttaccggatcctgcagcgcggactgctcggcagatcccaggttggggtgggagtctttcaagacggcgtgttccataccatgtggcacgttacacggggggccgtgctgatgtatcagggaaaacgccttgagccctcttgggctagcgtcaagaaagacctgatttcctacggcggcgggtggagatttcagggaagctggaacacgggcgaggaagtgcaggtgatcgccgttgagcctgggaagaatcccaagaacgtccaaaccacaccgggaaccttcaaaacccctgaaggcgaggtgggggccattgctctcgattttaagcccggaacatctggctcccctatcgtgaatcgggaaggcaaaattgtcgggctgtacggaaacggcgtggttacgaccagcgggacatatgtgtctgccatcgcgcaggctaaggcctcccaggagggacccctccccgagatcgaagacgaggtcttcaaaaagagaaatctgaccattatggatcttcaccctggcagcgggaagacacgccggtacctgccggccatcgtgagagaagctattaaacgcaagctgcggaccctcatcctggcccccacgagagttgtggcgtccgagatggctgaagcccttaaaggcatgcctattcgctatcaaacaaccgccgtcaagtctgagcataccggacgggagatcgtggacctgatgtgccacgctacatttaccatgagactcctgagccccgttcgcgtgcctaactacaatatgatcattatggatgaagcccatttcacagaccccgcttccatcgccgcgcggggctatattagcaccagagtcgggatgggagaggccgctgccatctttatgacggctacacctccgggctctgtggaagccttcccccagtccaacgccgtgattcaggatgaggaacgggacatccctgagcgcagctggaattctgggtacgattggatcaccgactttcccggaaaaacagtctggttcgttcctagcattaagtccggcaacgatatcgctaattgtctgagaaagaacgggaaacgggtgattcagctctctcgcaagaccttcgacacggagtatcaaaaaaccaagaacaatgactgggattacgtggtcacaaccgacatcagcgaaatgggcgcgaactttagagccgatcgggtgattgaccccagacgctgccttaaaccggttatcctgaaggatggacctgagcgggtgattctggctggccccatgcccgtcacagtggcctccgccgctcagagacgcgggcggatcggaagaaatcagaacaaggaaggcgaccagtacgtttatatggggcaacctctcaataacgatgaggaccacgcccattggaccgaggcgaaaatgctgcttgataatatcaacacacccgaaggaattatccctgctctgttcgagccggaacgcgagaagtctgccgccattgacggcgaataccggctcagaggggaggctcgcaaaacctttgtggagctgatgagacggggcgatctgcccgtctggctcagctataaggtggcctccgaaggattccagtacagcgaccgcagatggtgctttgatggcgagcggaataaccaggtccttgaagagaatatggacgtggaaatctggacgaaagagggggagcgcaagaaactgagacctcggtggctggacgcgagaacatattctgatcccctcgccctgcgcgaattcaaggagtttgctgccggacggagatccgttagcggcgaccttattctggaaatcgggaagctccctcagcacctgaccctgcgcgctcaaaacgccctcgataatcttgtgatgctgcacaactccgagcagggaggcaaagcttaccggcatgccatggaagagctgcccgacaccatcgagacactcatgctgcttgcgctgattgccgtgctcaccggcggggtcacactgttctttctgtctggaaagggcctcgggaaaacgagcatcggacttctgtgtgttaccgcttcctctgccctgctctggatggctagcgtggaaccgcactggattgccgcctccatcattctggagttctttcttatggtgctgctcatccctgaacccgatagacagcggacacctcaggacaatcaactggcttatgtcgtgatcggcctgctcttcatgattcttaccgttgcggccaacgagatggggctgctggagacaaccaagaaagatctcggaatcggccatgtggctgccgaaaaccaccagcacgccacgatgctggacgtcgatcttcgccccgctagcgcctggaccctgtacgcggtggccacaaccgtcattacacctatgatgagacataccatcgagaatacgacagctaacatttctctcaccgccatcgctaatcaggccgcgattctgatgggcctggacaaggggtggcccatctccaagatggatatcggagtgccgctccttgccctgggctgctacagccaagttaaccctctgacactcaccgctgccgtgctgatgcttgtcgctcactatgccattatcgggcccggactgcaggctaaagccacccgggaagcgcagaagcgcacagccgctggcattatgaaaaatcccacggtggacgggatcgttgccattgatctcgaccctgtggtctacgacgctaagtttgagaaacagctgggacaaatcatgctgctcatcctttgtacctctcagattctgctgatgagaacaacctgggccctctgcgaatccatcacactggccaccggcccgcttacgacactgtgggagggcagccccgggaagttctggaacaccaccattgcggtgtctatggctaatatcttccggggaagctatctcgccggcgctgggctggccttttccctgatgaagtctctcggaggcgggcgcagaggaacaggcgcccagggcgagacccttggggaaaaatggaagcggcagctgaaccaactgagcaaatccgagttcaatacatacaagcgcagcggaattatggaagtggatagatccgaggctaaagaaggcctcaagcggggggagacgaccaagcatgccgtttctagaggaacagcgaaactgcgctggtttgtcgagcggaaccttgtgaagcctgaaggcaaagtgatcgacctggggtgtggaagaggcggctggagctattactgcgccgggctcaagaaagtcaccgaggttaagggatatacaaaaggcgggcccggacacgaagagcctatccccatggctacctacggctggaatctggtgaagctgcattccgggaaggatgtgttctttatgcctccggaaaaatgtgacacgctcctttgcgatattggagagtctagccccaaccctaccatcgaggaaggccgcacactgcgggtcctgaagatggtggagccctggctcagaggcaatcagttctgtattaaaatcctgaacccttacatgccctccgttgtggaaacccttgagcagatgcagcgcaagcacgggggaatgctggtccggaatccgctctctagaaacagcacacacgagatgtattgggtgtcctgcggcaccgggaatattgttagcgccgtgaacatgacatctcgcatgctgctgaaccggtttaccatggctcatagaaaacctacgtacgaacgcgacgtcgatctcggagccggcacacggcacgtggcggtggagcccgaagtcgccaatctggacatcattgggcaaagaatcgagaacatcaagaatgaacataagtccacctggcactatgatgaggacaacccctacaaaacctgggcttatcacggaagctacgaggttaagccttctggctccgccagctctatggtgaatggcgtggtccgccttctgacaaaaccctgggatgtgattcctatggttacgcagatcgctatgaccgacacaaccccgttcgggcagcaaagagtgtttaaggaaaaagtcgacacacggaccccccgcgccaagagaggaacagctcagattatggaggtgaccgccaagtggctctggggcttcctgtcccggaacaaaaagcctagaatctgtacgcgggaagagtttacccgcaaagttagaagcaatgcggccattggggctgtgttcgtcgatgaaaaccagtggaattccgccaaggaggctgtggaggacgaacggttttgggatcttgttcatcgcgagagagaactgcacaaacagggaaagtgcgccacatgcgtgtataacatgatgggcaagcgggagaaaaagctcggggaattcggcaaagccaagggaagccgcgcgatctggtacatgtggctgggcgctagattcctggagtttgaggccctcgggttcatgaatgaagaccattggttttctcgggagaacagcctgtccggagtcgaaggcgaggggcttcacaaactgggatacatcctccgcgatatttctaagatccccggcgggaatatgtatgccgacgataccgctggctgggacacaagaattaccgaggatgacctgcaaaacgaagccaaaatcacggatattatggagcctgaacatgctcttctggccacaagcatcttcaagctcacctaccagaataaggtggtccgggtgcagcgccccgcgaaaaacggaacagttatggacgtgatctccagacgggatcagcgcggctctgggcaagtcggaacctatggcctgaacacgtttaccaatatggaggtgcagctgattagacagatggaaagcgaggggatcttcctcccgtccgagctggaaacacctaaccttgccgagcgggtgctggactggctcgaaaagcacggagctgagagactgaaacgcatggccatttctggcgacgattgtgttgtgaagcccatcgacgatcggtttgctaccgcccttattgcgctgaatgacatggggaaagtcagaaaggatatccctcagtgggaacccagcaagggctggaacgactggcaacaggtgcctttctgctcccaccattttcaccagctcatcatgaaagatggacgcgagattgttgtgccctgtcggaatcaggacgagctggtcggcagagcccgcgtgagccaaggggctggatggtctctgcgggaaacagcctgcctcggcaagtcctacgctcagatgtggcagctgatgtatttccatagacgcgatcttcggctggccgctaacgccatctgtagcgcggtcccggtggactgggttcctacctctagaacaacctggtccattcacgcccaccatcaatggatgacgacagaggatatgctcagcgtgtggaatcgcgtctggatcgaagagaacccctggatggaagacaaaacccacgtgtcctcttgggaggaggttccctacctggggaagcgggaagaccagtggtgcggaagccttattggcctgaccgctagagccacatgggccaccaatatccaggtggctattaaccaggtccggagactcatcgggaatgagaactatctggattacatgacatccatgaaacgctttaagaatgaaagcgaccctgagggcgccctgtgg

SEQ ID NO: 19507 - RNA, 9876 nt, synthetic construct
  misc_feature 1..9876: note = derived and/or modified CDS sequence (opt5) from DENV-1__KF672762__SS-prME
  source 1..9876: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcattgatgcgccgtgcaagatccctttctctacacaagacgaaaaaggggtcacccagaacggaagactcatcacagctaatcccattgtgacggataaggagaaacctgtgaacatcgaaaccgagcccccctttggcgagtcctatattgttgtcggggccggagaaaaggccctgaagctgagctggttcaaaaagggctctagcatcgggaaaatgtttgaggctacagcccggggcgctagacgcatggccattctcggagacaccgcgtgggatttcggctccatcgggggagtgtttacatctgtgggcaagctggtccatcaggtgcttgggaccgcctacggagttctgttcagcggcgtgtcctggacgatgaaaatcgggattggcatcctcctgacctggctgggacttaatagccggtctacatccctcagcatgacctgtattgctgtcggcatggtgacactgtacctgggggttatggtgcaggccgactctggatgcgtcatcaactggaagggcagagaactcaagtgtgggtccggaatttttgtgaccaacgaggttcacacatggaccgaacaatataaattccaggctgatagccctaagcgcctgtccgccgcgatcggcaaagcctgggaggagggggtgtgcggcattcggtctgctacgagacttgaaaatatcatgtggaagcagatcagcaacgagctgaatcatattctcctggaaaacgacatgaaatttacagtcgtggtgggagacgccaatggcatcctggctcaggggaagaaaatgattcgcccgcaacccatggagcacaagtactcctggaagtcttggggaaaagccaagatcattggcgccgatatccagaacaccaccttcatcattgacgggcctgatacacccgaatgtcctgacgagcagcgggcttggaatatctgggaggtcgaagattatggatttggcattttcaccacgaacatctggcttaaactcagagacagctacacacagatgtgcgatcaccgcctgatgtccgcggccattaaggacagcaaagctgttcatgccgatatgggctattggatcgagtctgaaaagaatgagacctggaagctggcccgggcttcctttatcgaagtgaaaacatgtatttggcccaagagccacaccctctggtctaacggggtgctggagtccgagatgatcattccgaaaatctacggaggccctattagccaacataattatagacccgggtacttcacacagaccgccggaccttggcaccttggcaagctggaactcgacttcgatctgtgcgaggggacgaccgtcgtggttgacgaacactgcggaaaccgcggcccctctctgcggacaaccacagtgaccggcaaaatcatccatgagtggtgttgcagaagctgtacgcttcctcccctccggtttcgcggggaggatggatgctggtacggcatggaaattagaccggtcaaggagaaggaagagaatctggtgcggtccatggttagcgcggggtctggagaagtggactccttcagcctgggcatcctctgtgtctccattatgatcgaggaggtgatgagatctcgctggagccggaaaatgctgatgacagggacccttgctgtttttctgctcctgattatgggacagctgacatggaacgaccttatcagactgtgcattatggtgggcgccaatgcctccgataagatgggcatggggaccacctatctcgctctgatggccacattcaaaatgcgccctatgtttgcggtcggactcctgttcagacggcttacgtctcgcgaagtgctgctcctgaccatcggcctgagccttgtggcttccgtcgagctgcccaactctctcgaagagctgggggacggactcgccatgggcatcatgatgctgaagcttctgacagaatttcaaccccaccagctctggaccacactgctgagccttaccttcattaaaacgacactgtccctcgattacgcctggaagaccaccgctatggttctgagcatcgtgtctctctttcctctgtgtctttccacaaccagccagaagacaacgtggctgccggtgctgctcgggtctttcggatgcaaacccctgaccatgtttcttattacagagaacaagatctggggcagaaaatcctggcctctgaatgagggcattatggccatcgggatcgtcagcattctcctgtcttccctcctgaagaacgacgtgccccttgctggacctctgatcgccggcgggatgctgattgcgtgttatgttatcagcggatccagcgccgatctctctctggaaaaagctgccgaggtgagctgggaagaggaagctgagcattccggcacctctcacaatattcttgtcgaggtgcaggacgatgggacaatgaagatcaaagacgaagagcgggatgacaccctgacgatcctcctgaaggccaccctcctggccgttagcggagtgtaccccatgtccattcctgctacacttttcgtctggtatttttggcaaaagaaaaagcagcgctctggcgtgctgtgggatacccccagcccgcctgaagtcgagagagcggtgctggacgatggcatctaccggattctccagcgcgggctgcttggaagatcccaggttggcgtgggggtcttccaagacggagtgttccatacaatgtggcacgttacccggggcgccgtgctgatgtatcaggggaaacgcctcgagccctcttgggctagcgtcaagaaagacctgatctcctacggaggcggctggagatttcaggggagctggaacacaggagaagaggtgcaggtgattgccgttgaacctggcaagaatcccaagaacgtccaaacgaccccggggacattcaaaacccctgagggagaagtgggcgccatcgctctcgattttaagcccgggacctctggatcccctattgtgaatcgggagggcaaaatcgtcggcctgtacgggaacggagtggttacaacgagcggcacctatgtgtctgccatcgcgcaggctaaggcctcccaggaggggccccttcccgaaattgaggacgaagtcttcaaaaagagaaatctgacaatcatggatctgcaccctggaagcggcaagacccgccggtacctcccggccattgtgagagaggctatcaaacgcaagctgcggacacttattctggcccccaccagagttgtggcgtccgaaatggctgaggccctcaaagggatgcctatccgctatcaaacgacagccgtcaagtctgagcataccggccgggaaatcgtggacctgatgtgccacgctacctttacaatgagactgctcagccccgttcgcgtgcctaactacaatatgattatcatggatgaggcccatttcaccgaccccgcttccattgccgcgcggggatatatcagcacaagagtcggcatgggggaagccgctgccatttttatgaccgctacgcctccgggatctgtggaggccttcccccagtccaacgccgtgatccaggatgaagagcgggacatccctgagcgcagctggaattctggctacgattggattacagactttcccgggagaaccgtctggttcgttcctagcatcaaatccggaaacgatattgctaattgtcttcggaagaacggcaagcgcgtgatccagctgtctagaaaaacatttgacaccgaatatcaaaagacgaaaaacaatgactgggattacgtggtcaccacagacattagcgagatgggggcgaacttccgggccgatagagtgatcgacccccgccggtgcctgaagccggttattctcaaagatggccctgaaagagtgatcctggctggacccatgcccgtcaccgtggcctccgccgctcagcgccggggcagaatcgggcgcaatcagaacaaggagggagaccagtacgtttatatgggccaacctcttaataacgatgaggaccacgcccattggacagaagcgaagatgctgctcgataatattaacacccccgaggggatcattcctgctctgttcgaaccggagcgggaaaaatctgccgccatcgacggagagtacagactgcgcggcgaggctagaaagacatttgtggaactcatgcggcgcggggatcttcccgtctggctgagctataaagtggcctccgagggcttccagtacagcgacagacggtggtgctttgatggagaacgcaataaccaggtcctggaggaaaatatggacgtggagatttggaccaaggagggcgaaagaaaaaagctccggcctagatggctggacgcgcgcacgtattctgatccccttgccctgcgggagttcaaagaatttgctgccgggagacgctccgttagcggagacctcatcctggagatcggcaagctgcctcagcacctcacacttcgggctcaaaacgccctggataatctggtgatgctccacaactccgaacaggggggaaaggcttacagacatgccatggaggagctgcccgacaccattgaaacccttatgctgctcgcgctgatcgccgtgctgacaggcggcgtcaccctcttctttctttctgggaaaggactgggcaagacaagcattgggctgctctgtgttacggcttcctctgccctgctttggatggctagcgtggagccgcactggatcgccgcctccattatcctggaattctttctcatggtgctgctgatccctgagcccgatcggcagcgcacccctcaggacaatcaactcgcttatgtcgtgattggacttctgttcatgatcctgacagttgcggccaacgagatgggcctcctggaaaccacaaaaaaggatcttgggattggacatgtggctgccgagaaccaccagcacgccaccatgctggacgtcgatctcagacccgctagcgcctggacgctgtacgcggtggccaccacagtcatcacccctatgatgcggcatacaattgaaaataccacggctaacatctctctgacagccattgctaatcaggccgcgatcctcatgggccttgacaaaggctggcccatctccaagatggatattggggtgccgctgctggccctcggatgctacagccaagttaaccctctgacccttacagctgccgtgctgatgctcgtcgctcactatgccatcattggccccgggctgcaggctaaggccacccgcgaggcgcagaaaagaaccgccgctggaatcatgaagaatcccacagtggacggcattgttgccatcgatctggaccctgtggtctacgacgctaaatttgaaaagcagctcgggcaaatcatgcttctgattctgtgtacgtctcagatcctcctgatgcggaccacatgggccctttgcgagtccattaccctggccacaggaccgctcaccacgctgtgggagggcagccccggcaaattctggaacacaaccatcgcggtgtctatggctaatatttttcgcgggagctatctggccggagctggcctcgccttctcccttatgaagtctctggggggaggcagacgggggaccggagcccagggcgaaacactgggcgagaagtggaaacgccagctcaaccaactgagcaagtccgaattcaatacctacaaaagaagcgggatcatggaggtggatcggtccgaagctaaggagggacttaaaagaggcgagacaacgaagcatgccgtttctcgcgggaccgcgaagctgcggtggtttgtcgaaagaaacctcgtgaaacctgagggaaaggtgatcgacctgggctgtgggcgcggaggctggagctattactgcgccggcctgaaaaaggtcacagaagttaaagggtataccaagggaggccccgggcacgaggaacctattcccatggctacatacggatggaatctcgtgaaacttcattccggcaaggatgtgttctttatgcctccggagaagtgtgacaccctgctgtgcgatatcggggagtctagccccaaccctacgattgaagagggacggaccctcagagtcctgaaaatggtggaaccctggcttcgcggcaatcagttctgtatcaagattctgaacccttacatgccctccgttgtggagacactcgagcagatgcagcggaaacacggcgggatgctggtcagaaatccgctgtctcgcaacagcacccacgaaatgtattgggtgtcctgcggaacaggcaatatcgttagcgccgtgaacatgacctctcggatgctcctgaacagatttacaatggctcatcgcaagcctacctacgagcgggacgtcgatcttggggccggaacgagacacgtggcggtggaacccgaggtcgccaatctggacattatcggccaacgcatcgaaaacattaaaaatgagcataagtccacatggcactatgatgaggacaacccctacaagacctgggcttatcacgggagctacgaagttaaaccttctggatccgccagctctatggtgaatggcgtggtcagactcctgaccaagccctgggatgtgatccctatggttacacagattgctatgacggacaccacaccgttcggccagcaacgggtgtttaaagagaaggtcgacacccgcacacccagagccaaacgggggaccgctcagatcatggaagtgacagccaagtggctttggggattcctgtccagaaacaagaaacctcggatttgtacccgcgaggaatttacgagaaaggttcggagcaatgcggccatcggcgctgtgttcgtcgatgagaaccagtggaattccgccaaagaggctgtggaagacgagcgcttttgggatctcgttcatagagaacgggagctgcacaagcaggggaaatgcgccacctgcgtgtataacatgatgggaaagcgcgaaaagaaactgggcgagttcgggaaggccaaaggcagcagagcgatctggtacatgtggctcggagctcggtttctggagttcgaagcccttggcttcatgaatgaggaccattggttttctcgcgaaaacagcctgtccggggtcgagggagagggcctccacaagctggggtacattcttagagatatctctaaaattcccggaggcaatatgtatgccgacgatacagctgggtgggacacccggatcacagaagatgacctgcaaaacgaggccaagattaccgatatcatggaacctgagcatgctctcctggccacgagcatcttcaaactgacataccagaataaggtggtccgcgtgcagagacccgcgaagaacggcaccgttatggacgtgatttcccggcgcgatcagagaggatctggccaagtcgggacatatggactcaacacctttacgaatatggaagtgcagctgatccggcagatggagagcgagggcattttccttccgtccgaactggagacccctaacctcgccgaaagagtgctggactggcttgagaaacacggggctgaacgcctgaagcggatggccatctctggagacgattgtgttgtgaaacccattgacgatagatttgctacagccctcatcgcgctgaatgacatgggcaaggtccgcaaagatatccctcagtgggagcccagcaaggggtggaacgactggcaacaggtgcctttctgctcccaccattttcaccagctgattatgaaggatggccgggagatcgttgtgccctgtagaaatcaggacgaactcgtcggacgcgcccgggtgagccaaggcgctgggtggtctctgagagagaccgcctgccttggaaaatcctacgctcagatgtggcagctgatgtatttccatcgccgggatctcagactggccgctaacgccatttgtagcgcggtcccgatcgactgggtgcctacatctcgcaccacatggtccattcacgcccaccatcaatggatgaccacggaagatatgcttagcgtttggaatcgggtgtggatcgaggaaaacccctggatggaggacaaggctcacgtctcctcttgggaggaagtgccctacctgggcaaaagagaggaccagtggtgcgggagcctcattggactgacagcccgggccacctgggctaccaatatccaggttgccatcaaccaggtgagacgcctgattggcaatgaaaactatctcgattacatgacatccatgaagcggtttaaaaatgagagcgaccctgagggggcgctgtgg

SEQ ID NO: 19508 - RNA, 9879 nt, synthetic construct
  misc_feature 1..9879: note = derived and/or modified CDS sequence (opt5) from DENV-1__JF459993__SS-prME
  source 1..9879: mol_type = other RNA
agcgtgaccatgctgttcatgctcctgcccacgtcccttgcctttcacctgacgaccagaggcggggagcctcatatgatcgtgtctaagcaggaacggggaaagagcctcctgttcaagacctccgctggcgttaacatgtgcacccttatcgccatggacctgggggagctctgtgaagatacaatgacctacaagtgcccgcgcatcacagagaccgaacccgacgatgtggactgttggtgcaatgcgacggagacctgggtgacatatggaacctgttctcagacaggcgagcacagacgggataagcgcagcgtcgctctggcccctcatgtggggctgggactcgaaaccagaacggagacatggatgtcctctgaaggcgcctggaagcagattcagaaggttgagacctgggctctgggccaccccgggtttacagtgatcgcccttttcctggctcatgccattggaaccagcatcacccagaagggcatcatttttatcctcctgatgcttgtcacaccttccatggcgatgcggtgcgtggggattggaaaccgcgacttcgttgagggcctgagcggggccacgtgggtggatgtcgtgctcgaacacggatcttgtgtgaccacaatggctaaagacaagcccaccctggatatcgagctgctcaaaacagaagtcaccaatcctgccattctgagaaaactttgcatcgaggctaaaatttccaacacgacaaccgacagccggtgtccgacccaaggcgaagccacactggttgaggagcaggataccaattttgtgtgccgcagaacattcgtggaccggggctgggggaacggatgtggcctctttgggaagggatctctgatcacgtgcgcgaagttcaaatgcgtcaccaaacttgaaggcaaaatcgtgcagtacgagaatctgaagtattccgttattgtgacagtccacaccggggatcagcatcaagtgggaaacgaaacaaccgagcacggcacgaccgccacaatcacaccccaagctcctaccagcgaaattcagctcaccgactacggcgccctgacgctggactgttctccccgcacagggctcgattttaatgagatggttctgcttaccatgaaagagaagtcctggctggtgcataaacagtggttcctcgacctgcctcttccctggacaagcggagcttccacctctcaagaaacctggaacagacaggatctgctcgtcacatttaagacggcccacgccaagaaacaggaggtggtcgtgctgggcagccaagaaggggctatgcacaccgcgctgacaggagccaccgagatccagacatccggcaccacgacaattttcgctgggcatctcaagtgccggctgaaaatggacaaacttaccctgaaaggcgttagctatgtgatgtgtaccggatctttcaagctcgaaaaggaggtcgccgagacacagcacggcaccgtgctggttcaggtgaaatacgaagggacagatgccccgtgcaagatccctttttccagccaagacgagaaaggagtcatccagaatggccgcctgattacggctaaccccatcgtgaccgataaggaaaaacctgtgaatattgaggccgagccgcccttcggggaatcttatatcgttgtcggagcgggcgagaaggctcttaagctcagctggtttaaaaaggggtcctctattggcaaaatgttcgaagccacagccagaggagctcggagaatggccatcctgggcgacaccgcttgggattttgggagcatcggaggcgtgttcacatccgtggggaagctggtccatcagatttttggaaccgcctacggcgtcctgttcagcggggtttcttggacgatgaaaatcggcattggaatcctgcttacctggctgggcctcaactcccgcagcacatctctgtccatgacctgtattgcggtggggatggtcacactgtaccttggagtgatggttcaggccgacagcggctgcgtgatcaattggaaggggcgggagctcaagtgtggatccggcatttttgtcaccaacgaagtgcacacatggaccgagcaatataaattccaggctgattctcctaagagactgagcgccgctatcgggaaagcctgggaggaaggcgtttgcggaatccgctccgcgacgcggctggagaacattatgtggaagcagatctctaatgaactcaaccatattctgcttgagaatgacatgaaatttacagtggtcgtgggcgacgtggccgggatcctggctcagggaaagaaaatgattagaccgcaacccatggaatacaagtatagctggaagtcctggggcaaagccaagatcatcggggctgatgtccagaacgccaccttcattatcgacggacctaatacccccgagtgtcctgatgaccagcgcgcctggaacatttgggaggttgaagattacggctttggcatcttcacaaccaatatttggctcaaactgcgggacagctatacacaggtgtgcgatcacagactgatgtctgctgcgatcaaggactccaaagccgtgcacgctgatatggggtactggatcgagagcgaaaagaacgagacatggaaacttgcccgcgcctctttcattgaagtcaaaacctgtgtgtggcccaagtcccatacactctggagcaatggagttctggagtctgagatgatcattccgaaaatctatggcgggcctattagccaacacaaccatcggcccggatactttacccagacagctggcccttggcacctggggaagctcgaactggacttcgatctttgcgagggaaccacggtggtcgtggacgaacactgcggcaatagaggcccctccctgcgcaccacaaccgttacagggaaaatcatccatgagtggtgttgccggagctgtaccctccctcccctgagatttcggggagaggatggctgctggtacgggatggaaattcgcccggtgaaggagaaggaagagaacctggtcaaatctatggtgtccgccggaagcggcgaagttgactccttctctcttgggctcctgtgtatcagcattatgatcgaggaggtgatgagatcccggtggtctagaaagatgctgatgacgggaacactcgcggtctttttcctgcttattatgggccagctgacctggaatgacctcatccgcctgtgcattatggtgggcgctaacgccagcgatcggatggggatgggaacaacctatctggcccttatggctacctttaaaatgagacctatgttcgccgtgggcctgctctttcgcagactgacatcccgggaagtcctcctgcttacgatcgggctgtctctcgttgcgagcgtggagctgcccaattccctggaggaacttggagacggcctggctatggggatcatgattctcaagctgctcaccgatttccaaagccaccagctgtgggccacacttctgtctctcacctttatcaaaacaaccttctccctgcattacgcctggaagacgatggctatggtgctgagcattgtctctctttttcccctgtgtctctccacaaccagccagaagaccacatggctgcctgtgctcctgggatctcttggctgcaaaccgctgaccatgttcctgatcgccgaaaacaagatttggggccgcaaatcctggcccctcaacgaggggatcatggctgttggaatcgtgagcattctgctttccagcctgctcaagaatgacgtccctctggccggccccctcatcgccgggggaatgctgattgcctgttatgtgatctctggcagctccgctgatctttctctggagaaagccgctgaagttagctgggaggaagaggccgaacactccggggcctctcataacattctggtggaggtccaggacgatggaacaatgaagatcaaagacgaggaaagagatgacacgctcaccatcctgcttaaggctacactgctcgcggtgagcggcgtctaccctctgtccattcccgccaccctcttcgtgtggtatttttggcaaaagaaaaagcagcggtctggcgttctgtgggatacacctagccctcccgaggtggaacgcgctgtccttgacgatgggatctacagaattatgcagcggggactgctgggccgctcccaggtgggggttggagtgttccaagagaatgtctttcacaccatgtggcacgtgacgagaggcgccgtgctcatgtatcaggggaaacggctggagcccagctgggcctctgttaagaaagaccttatctcctacggaggcggctggcgcctgcaggggagctggaacaccggagaagaggtccaggtgattgctgtggaacccggcaagaatcctaagaacgtccaaacagcccccgggaccttcaaaacaccggagggagaagtgggcgcgatcgctctcgactttaagcctgggacctctggatcccccattgttaatagagagggcaaaatcgtgggcctgtacgggaacggagtcgtgacaacgagcggcacctatgtttccgccatcgcccaggctaaggcctctcaggaggggcctctccccgaaattgaggatgaagtgttccggaaaagaaatctgacaatcatggaccttcatcccggaagcggcaagacccgccggtacctgcctgcgattgtcagagaggctatcaagcgcaaactgcggaccctcattctggccccgacaagagtggttgcctccgaaatggctgaggcccttaaggggatgcccatccgctatcaaacgaccgctgtgaaaagcgagcacacaggcaaggaaatcgtcgatctgatgtgccatgccacctttacaatgcggctcctgtctcctgtgagagtgcccaactacaatatgattatcatggacgaggcgcacttcaccgatccttccagcattgccgctcgcggatatatctctacgcgggtcggcatgggggaagccgctgccatttttatgacagccacaccccctggaagcgttgaggctttcccgcagtccaacgcggtgatccaggacgaagagagagatatccccgagcggtcttggaatagcggctacgaatggattaccgactttcctgggaaaacagtgtggttcgtcccctccatcaagtctggaaacgatattgccaattgtctgcgcaagaacggcaaaagagtgatccagctcagccggaagaccttcgacacagagtatcagaagaccaagaacaatgattgggactacgttgtgacgacagacatttccgaaatgggggctaactttcgcgccgatagagtcatcgaccctcggagatgccttaaacccgtgattctgaaggatggcccggagcgcgttatcctggccggacctatgcccgtgaccgtcgctagcgccgcgcagcggagaggccgcatcgggcggaatcataacaaggagggagaccagtacatttatatgggccagcccctcaataacgatgaagaccacgctcactggacagaggccaaaatgctgcttgataatatcaacacccctgaagggattatccccgccctgttcgagcctgaaagagagaagtctgctgccattgacggagagtaccgcctccggggcgaagcgagaaaaacgtttgtggagctgatgcgcagaggggatctgccggtctggctctcctataaggtggccagcgaaggcttccaatactccgaccggcgctggtgctttgatggagagagaaataaccaggttcttgaagagaatatggacgtggagatctggaccaaagaaggcgagcggaagaaactgcgccccagatggctggatgctcggacatattctgaccctctcgccctgagagagttcaaggagtttgctgccgggcgccggagcgtgtccggagaccttatcctggaaattggcaagctcccccagcatctgacccagagagctcaaaacgccctggataatctcgtcatgcttcacaactctgagcaagggggacgcgcgtaccggcatgccctggaggaactgcctgacacaatcgagaccctcatgctgcttgctctgattgccgttctcacaggcggcgtgaccctgttctttctgagcgggagaggactcggcaaaacgtccatcgggcttctgtgtgtgatggctagctctgccctgctctggatggcctccgtcgaaccccactggattgctgcgagcatcatcctggagttctttcttatggtgctgctcattccggagcctgatcggcagcgcacaccccaggacaatcaactggcctatgttgtgatcggactcctcttcatgattcttaccgtcgctgccaacgaaatgggcctgctggagaccacaaagaaagatctcgggatcggacacgtggccgtcgaaaaccatcaccatgcttctatgctggacgtggatcttcaccctgcctccgcgtggaccctgtacgccgttgctacaacgattatcacccccatgatgagacatacaattgagaataccacagccaacatcagcctcaccgctatcgccaatcaggcggccattctgatgggcctggacaagggctggcctatctctaaaatggatattggggtgcccctccttgctctgggatgctacagccaggtcaacccgctgacgctcaccgccgctgtgctgatgcttgttgcccactatgctatcattggccctgggctgcaagccaaggcgacacgggaagcccagaagcgcaccgctgccggaatcatgaaaaatcccacagtggacggcatcgtcgctattgatctcgaccccgtggtgtacgatgccaagtttgagaaacagctggggcagatcatgctgctcattctttgtacctcccaaatcctgctgatgagaacgacatgggccctctgcgagtctattaccctggcgacaggacctcttaccaccctgtgggaaggcagcccgggcaagttctggaacacaacgatcgctgtttccatggccaatatcttccgggggagctatctcgctggagccggcctggccttttccctgatgaaatctctcgggggaggccgcagagggaccggagctcagggcgagacacttggcgaaaagtggaagcggcagctgaaccagctgagcaaatccgagttcaatacctacaagcgctctgggattatggaagtcgacagaagcgaggccaaagagggactcaagcggggcgaaacaaccaaacacgcggtgtccagagggacggccaagctgcgctggtttgtggagcggaaccttgtcaagcccgaaggaaaagttatcgacctgggctgtgggagaggaggctggtcttattactgcgctggcctcaagaaagtgacagaggtgaaggggtataccaaaggaggccctgggcatgaggaacccattcctatggccacctacggatggaatctggtcaagctgcacagcggcaaagatgtgttctttattccccctgagaagtgtgacacactcctttgcgatattggggaatccagcccgaaccccaccatcgaggaaggacgcacactgcgggttctgaagatggtggagccttggctcagaggcaatcaattctgtattaaaatcctgaacccctacatgccttctgtcgtggagacgcttgaacagatgcagcgcaagcatggcgggatgctggttcggaatcccctctccagaaacagcacccacgagatgtattgggtgtcttgcggaacaggcaatatcgtctccgctgtgaacatgaccagccgcatgctgctgaaccggtttacaatggcccacagaaaaccgacctacgaacgcgacgtggatctcggggcgggaacgcggcatgtcgccgttgagcctgaagtggctaatctggacattatcggccagagaattgagaacatcaagcacgagcataaatctacctggcactatgatgaagacaatccctacaagacatgggcctatcatgggtcctacgaggtgaagcccagcggatccgctagctctatggtcaacggcgtggttaaacttctgaccaagccttgggatgtgattcccatggtcacacaaatcgccatgaccgacacaacccctttcggccagcagcgcgtgtttaaagaaaaggttgatacgagaacaccgaaagctaagcgggggaccgcccaaatcatggaggtgaccgcgcgctggctctggggattcctgagcagaaataagaaaccccggatttgtacaagagaagagtttacgcggaaggtccgctccaacgccgctatcggcgccgtgttcgttgacgagaatcagtggaactctgctaaagaagccgtggaggacgaaagattttgggatcttgtccaccgggagcgcgaactgcacaagcaggggaaatgcgcgacctgcgtgtataatatgatgggaaagagagagaagaaactcggcgagttcgggaaggcgaaaggcagccgggctatttggtacatgtggctgggagcccgcttcctggaatttgaggccctcggcttcatgaacgaagaccattggttttccagagaaaattctctgagcggggtcgagggagaaggccttcacaagctggggtacatcctccgggatatttccaaaatccctggaggcaacatgtatgctgacgatacagccgggtgggacacccgcatcacagaggatgacctgcagaatgaagctaagattaccgatatcatggagcccgaacatgcccttctggcgaaatctattttcaagctcacataccaaaacaaggtggttagagtgcagcggcctgccaaaaatggcaccgtcatggacgtgatcagccgcagagatcagcggggatccggccaggtggggacgtatggactgaacacctttacaaacatggaggctcaactgattcgccagatggagagcgaagagatcttctctccctccgaactcgagaccccgaatctggccgaaagagttcttgactggctggagaagtacggcgtggagcggctcaaaagaatggctatcagcggggatgactgtgtcgtgaagcctattgacgatcgctttgccacagcgctgaccgcccttaacgacatgggaaaagttcggaaggatatcccccagtgggaaccttctaagggctggaatgactggcagcaagtgcccttctgctcccaccactttcatcagctgattatgaaagatgggagagaggtcgtggtcccttgtcgcaaccaggacgaactcgtgggccgggctagagttagccagggagccggctggtccctgcgcgagacggcttgcctggggaagtcttatgcccaaatgtggcagctcatgtacttccaccggagagatctgcgccttgctgccaatgcgatctgtagcgccgtgcccgtcgactgggtgccgacatcccggaccacatggagcattcatgctcaccatcagtggatgaccacggaagatatgctgtctgtttggaacagagtgtggatcgaggagaatccttggatggaagacaaaacccacgtctccagctgggaggatgtgccctatctcggaaagcgcgaagaccaatggtgcggctctctgattgggcttacagcccgggccacctgggctacaaacatccaggtggccatcaatcaggttagacggctgattggaaacgagaattacctcgactacatgaccagcatgaaaagatttaagaacgagtccgatcccgaaggcgcgctgtggtga

SEQ ID NO: 19509 - RNA, 9876 nt, synthetic construct
  misc_feature 1..9876: note = derived and/or modified CDS sequence (opt5) from DENV-1__KF672763__SS-prME
  source 1..9876: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagcccccctttggcgagtcctatatcgttgtcggggtgggagaaaaggccctgaagctgagctggttcaaaaagggctctagcattgggaaaatgtttgaggccaccgctcggggcgccagacgcatggctatcctcggagacacagcctgggatttcggctccattgggggagtgtttacctctgtcggcaagctggtgcatcaggttttcgggacggcgtacggagtgctttttagcggcgtctcctggaccatgaaaatcgggatcggcattctgctcacatggctgggactgaatagccggtctacctcccttagcatgacatgtatcgccgtgggcatggttaccctctacctgggggtgatggtccaggctgactctggatgcgtgattaactggaagggcagagaactgaagtgtgggtccggaatcttcgttacaaacgaggtgcacacctggacggaacaatataaatttcaggccgatagccctaagcgcctctccgctgccattggccgggcgtgggaggagggggtctgcggcatcagatctgccacacgcctggaaaatattatgtggaaacagatcagcaacgagcttaatcatatcctgctcgaaaacgacattaagttcaccgtggtggtcggaaatgctgacggcatcctggcccaggggaaaaagatgattcggccgcaacccatggagcacaaatactcctggaagtcttggggaaaggctaaaatcattggcgccgatatccagaacaccacatttatcattgacgggcctgatacccccgaatgtcctgacgagcagagagcctggaatatctgggaggttgaagattatggattcggcatttttacgacaaacatctggctgaagcttcgcgacagctacacccagatgtgcgatcaccggctcatgtccgctgcgattaaagacagcaaggccgtgcatgctgatatgggctattggatcgagtctgaaaaaaatgagacatggaagctggccagagcctccttcatcgaagtgaagacctgtatttggcccaaaagccacacactgtggtctaacggggtcctcgagtccgagatgatcattccgaagatgtacggaggccctatcagccaacataattatcgccccgggtacttcacccagacggctggaccttggcacctgggcaaacttgaactggactttgatctctgcgaggggaccacagtggttgtggacgaacactgcggatctcggggccccagcctgagaaccacaaccgtcacgggcaagattatccatgagtggtgttgccggtcctgtacactgcctccccttcgcttcagaggggaggatggatgctggtacggcatggaaatccggccggtgaaagagaaggaagagaacctcgttagaagcatggtgtctgccgggtccggagaagtcgacagcttttccctgggcattctgtgtgtgtctatcatgattgaggaggttatgcgcagccggtggtccagaaagatgctcatgaccgggacactggcggtgttccttctgctcatcatgggacagctgacctggaatgacctgattcgcctttgcatcatggtcggcgctaacgcctctgataaaatgggcatggggaccacatatctggccctcatggctacgtttaagatgagacctatgttcgccgtgggactgctctttcggcgcctgaccagcagagaagtgcttctgctcacaattggcctgtccctgatggcgtctgtcgagcttcccaatagcctggaagagctcggggacggactggctatgggcatcatgatgctcaaactgcttaccgaattccaaccccaccagctgtggacaaccctcctgtccctgacgtttatcaagacaacccttagcctggattacgcctggaaaaccacagccatggttctctctattgtgtccctgttccctctctgtctgagcaccacatctcagaagacgacctggcttccggtgctgctggggtcctttggatgcaagcccctcacaatgttcctgatcaccgagaacgagatttggggccggaaaagctggcctcttaacgaaggcatcatggctattgggatcgtctctatcctgctctccagcctgctcaagaatgacgtgcccctggccggacctcttattgctggcgggatgctgatcgcctgttatgttatttccggaagctctgcggatctgagcctcgagaaagccgctgaagtgtcctgggaggaagaggccgagcattctggcacaagccacaacatcctggtcgaagtgcaggacgatgggaccatgaagattaaagacgaggaacgcgatgacacgcttaccatcctgctcaaggctacactgctcgccgtttccggagtgtaccccatgtctatccctgccaccctgtttgtctggtatttctggcaaaaaaagaagcagagaagcggcgtgctttgggatacaccctccccgcctgaggtcgagcgggctgtgctggacgatggcatttaccgcatcctgcagagagggctcctgggacggtctcaggttggcgtgggggtcttccaagacggagtgtttcataccatgtggcacgttacacgcggcgcggtgcttatgtatcaggggaaaagactggaacccagctgggcctccgtcaagaaagacctcattagctacggaggcggctggcggttccaggggtcttggaatacgggagaggaagtgcaggtgatcgctgttgagcctggcaagaaccccaaaaatgtccaaaccacaccggggacctttaagacccctgaaggagaggtgggcgccattgccctggatttcaagcccgggacatccggaagccctatcgtgaacagagagggcaaaattgtcggcctctacgggaatggagtggttacgacctctggcacatatgtgtccgctatcgcccaggcgaaggctagccaggaagggcccctgcccgagatcgaagacgaggtctttaaaaagcgcaaccttaccattatggatctgcaccctggatccggcaaaacacggagatacctgccggccatcgtgcgcgaagccattaagcggaagctcagaaccctgatccttgctcccacgcgcgttgtggcctctgagatggcggaggctctgaaagggatgcctattcggtatcaaacaaccgccgtcaagagcgaacataccggcagagagatcgtggacctcatgtgccacgccacattcaccatgcgcctgctgtcccccgttcgggtgcctaattacaacatgatcattatggatgaagctcattttacagaccccgccagcatcgctgccagaggatatatttctacccgggtcggcatgggggaggcggccgctatcttcatgacggccacacctccgggatccgtggaagcttttccccagagcaatgccgtgattcaggatgaggagcgcgacatccctgaaagatcttggaacagcggctacgattggatcaccgacttccccgggaaaacagtctggtttgttccttccattaagtctggaaatgatatcgccaactgtctccggaaaaatggcaagcgcgtgattcagcttagcagaaagaccttcgacacggagtatcaaaaaaccaagaacaacgactgggattacgtggtcacaaccgacatctccgaaatgggggctaatttccgggcggatagagtgattgacccccgccggtgcctgaaaccggttatcctgaaggatggccctgagagagtgattctcgccggacccatgcccgtcacagtggcttctgccgcccagcgccggggcagaatcgggcgcaaccagaataaagagggagaccagtacgtttatatgggccaacctctgaacaatgatgaagaccacgctcattggaccgaggccaagatgcttctggataacatcaatacacccgaagggattatccctgcgctctttgagccggaacgggagaagagcgctgccattgacggagagtacagactgcgcggcgaagccagaaaaaccttcgtggagctgatgcggcgcggggatctccccgtctggctttcctataaggtggctagcgaaggctttcagtactctgacagacggtggtgcttcgatggagagcgcaacaatcaggtcctggaagagaacatggacgtggagatctggacgaaagaaggcgagagaaagaaactgcggcctagatggctcgacgcccgcacatattccgatcccctggcgcttcgggaatttaaggagttcgccgctgggagacgcagcgtttccggagacctgattctcgaaatcggcaaactgcctcagcacctgaccctccgggcccaaaatgctcttgataacctggtgatgctgcacaattctgagcaggggggaaaggcctacagacatgctatggaggaactccccgacaccatcgagacactgatgcttctggccctcattgcggtgctgaccggcggcgtcacactgtttttcctcagcgggaagggacttggcaaaacgtccatcgggctgctgtgtgttaccgcctctagcgctctcctgtggatggcctccgtggaaccgcactggattgctgccagcatcattcttgagtttttcctgatggtgctcctgatccctgagcccgatcggcagcgcacacctcaggacaaccaactggcctatgtcgtgatcggactcctttttatgattctgaccgttgctgcgaatgaaatgggcctgctcgagacaaccaagaaagatctggggatcggacatgtggccgctgaaaaccaccagcacgccacgatgcttgacgtcgatctgcatcccgcctctgcttggaccctctacgccgtggcgacaaccgtcattacacctatgatgagacacaccatcgagaacacgacagccaatatttccctgaccgctatcgccaaccaggctgccattctgatgggcctcgacaagggctggcccatcagcaaaatggatcttggggtgccgctgctggcgctcggatgctactctcaagttaatcctctgacacttaccgccgctgtgctgatgctcgtcgcccattatgctatcattggccccgggctgcaggccaaggctacccgggaagcccagaagcgcacagcggccggaatcatgaaaaaccccacgattgacggcatcgtggctattgatctggaccctgttgtgtacgacgccaagttcgagaaacagctcgggcaaatcatgcttctgatcctgtgtacctcccagattctcctgatgagaacaacctgggctctttgcgagagcatcacactggccaccggaccgctcacgacactgtgggaaggctctcccggcaagttttggaataccaccattgccgtcagcatggcgaacatcttccgggggtcctatctggctggagccggcctcgctttctctcttatgaaaagcctggggggaggccgcagagggacaggagcccagggcgagaccctgggcgaaaagtggaagcggcagctcaatcaactgtccaaaagcgagtttaacacatacaagcgctccgggattatggaagtggatagatctgaggccaaagagggacttaagcggggcgaaacgaccaaacacgctgtgagcagagggacagccaagctgcgctggttcgttgagcggaatctcgtcaagcctgaaggaaaagtgatcgacctgggctgtgggagaggaggctggtcctattactgcgcgggcctgaagaaagtgaccgaggtcaaggggtatacaaaaggaggccccgggcatgaagagcctatccccatggccacctacggatggaacctcgttaagcttcactctggcaaagatgtgtttttcatgcctccggagaagtgtgacacgctgctgtgcgatattggggaaagctcccccaatcctaccatcgaggaaggacgcacactccgggtgctgaagatggtcgagccctggcttagaggcaaccagttttgtattaaaatcctgaatccttacatgccctctgtggttgagaccctcgaacagatgcagcgcaagcacggcgggatgctggtgcggaacccgctgagcagaaattccacacatgagatgtattgggtcagctgcggaaccggcaacattgtgtctgctgttaatatgacatcccgcatgctcctgaaccggttcaccatggcccacagaaaacctacgtacgaacgcgacgtggatcttggggctggaacacggcatgtcgccgtggagcccgaagtggcgaacctggacatcattggccaaagaatcgagaatatcaagaacgagcacaaaagcacctggcactatgatgaagacaatccctacaagacctgggcctatcatgggtcttacgaggtcaagccttccggaagcgcttcttccatggttaacggcgtggtgcgcctcctgacaaaaccctgggatgtcattcctatggtgacgcagatcgccatgaccgacacaaccccgtttggccagcaaagagttttcaaggaaaaagtggacacacggaccccccgcgctaagagagggacagcccagattatggaggtcaccgctaaatggctttggggatttctgagccggaataagaagcctagaatctgtacgcgggaagagttcacccgcaaagtgagatccaacgccgcgattggcgccgtttttgtggatgagaatcagtggaacagcgctaaggaagccgtcgaggacgaacggttctgggatctcgtgcaccgcgagagagaactgcataaacaggggaagtgcgctacatgcgtttataatatgatgggaaaacgggagaagaagctgggcgagtttgggaaagccaagggctctcgcgccatctggtacatgtggctcggagcgagattcctggaattcgaggctcttggctttatgaacgaagaccactggttcagccgggagaattccctgtctggggtggagggagaaggcctccataaactggggtacatccttcgcgatattagcaagatccccggaggcaacatgtatgccgacgataccgccgggtgggacacaagaattaccgaggatgacctgcggaatgaagctaaaatcacggatattatggagcctgaacacgccctcctggctacatccatctttaagctgacctaccaaaacaaagtcgtgcgcgtccagagacccgccaagaatggcacagtgatggacgttatctctcggcgcgatcagagaggaagcggccaggtggggacctatggactcaacacgttcaccaacatggaggtccaactgattcggcagatggagtccgaaggcatctttttcccgtctgagcttgaaagccctaatctggcggagagagtgctcgactggctggaaaagcacggggccgagcgccttaaacggatggctatttccggagacgattgtgtggttaagcccatcgacgatagatttgccacagctctgattgccctcaacgacatgggcaaagtgcgcaaggatatccctcagtgggagcccagcaaagggtggaatgactggcagcaagtccctttctgctctcatcactttcatcagctgatcatgaaggatggccgggaaattgtggttccctgtagaaaccaggacgagctggtgggacgcgcgcgggtctcccagggcgccgggtggagcctcagagaaaccgcttgcctgggaaagtcttacgcccaaatgtggcagcttatgtatttccaccgccgggatctgagactcgctgccaatgctatctgttccgccgtgccggtcgactgggtgcctacaagccgcaccacatggtccattcacgcgcatcaccagtggatgaccacggaggatatgctgtctgtttggaaccgggtgtggatcgaagagaatccctggatggaggacaaaacacatgtcagctcctgggaagaggtgccctaccttggcaagagagaagaccaatggtgcgggagcctgattggactcaccgcccgggctacctgggccacaaacatccaggttgccattaatcaggtgagacgcctgatcggcaacgagaattatctggattacatgacctctatgaaacggtttaagaacgagtccgaccctgaaggggctctctgg

SEQ ID NO: 19510 - RNA, 9876 nt, synthetic construct
  misc_feature 1..9876: note = derived and/or modified CDS sequence (opt5) from DENV-1__KF672764__SS-prME
  source 1..9876: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagcccccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacattaagttcaccgtcgtggtgggaaatgccaacggcatcctgacccaggggaaaaagatgattcggccgcaacccatggagcacaaatactcctggaagtcttggggaaaggctaaaatcattggcgccgacatccagaatacaacctttatcattgatgggcctgacacgcccgaatgtcctgatgagcagagagcctggaacatctgggaggtcgaagactatggattcggcatttttacaaccaatatctggctgaagcttcgcgatagctacacacagatgtgcgaccaccggctcatgtccgctgcgattaaagatagcaaggccgttcatgctgacatgggctattggatcgagtctgaaaaaaacgagacctggaagctggccagagcctccttcatcgaagtgaagacatgtatttggcccaaaagccacaccctgtggtctaatggggtgctcgagtccgagatgatcattccgaagatgtacggaggccctatcagccaacataactatcgccccgggtacttcacgcagaccgctggaccttggcacctgggcaaacttgaactggattttgacctctgcgaggggacaaccgtcgtggttgatgaacactgcggatctcggggccccagcctgagaacaaccacggtgacaggcaagattatccatgagtggtgttgccggtcctgtaccctgcctccccttcgcttcagaggggaggacggatgctggtacggcatggaaatccggccggtcaaagagaaggaagagaatctcgtgaagagcatggtttctgccgggtccggagaagtggatagcttttccctgggcattctgtgtgtctctatcatgattgaggaggtgatgagaagccgctggtcccggaaaatgctcatgacagggaccctggcggttttccttctgctcatcatgggacagctgacctggaacgacctgattagactttgcatcatggtgggcgctaatgcctctgacaagatgggcatggggacaacgtatctggccctcatggctacctttaaaatgcgccctatgttcgccgtcggactgctctttagacggctgacaagccgcgaagtgcttctgctcaccattggcctgtccctggtggcgtctgtcgagcttcccaacagcctggaagagctcggggatggactggctatgggcatcatgatgctcaagctgcttacagaattccaaccccaccagctgtggaccacgctcctgtccctgacatttatcaaaaccacccttagcctggactacgcctggaagacaaccgccatggttctctctattgtgtccctgttccctctctgtctgagcacaacgtctcagaagaccacatggcttccggtgctgctggggtcctttggatgcaaacccctcaccatgttcctgatcacagagaacaagatttggggcagaaaaagctggcctcttaatgagggcatcatggctattgggatcgtctctatcctgctctccagcctgctcaagaacgatgtgcccctggccggacctcttattgctggcgggatgctgatcgcctgttatgttatttccggaagctctgcggacctgagcctcgaaaaagccgctgaggtgtcctgggaagaggaagccgagcattctggcaccagccacaatatcctggtcgaggtgcaggatgacgggacgatgaagattaaagatgaagagcgggacgatacccttacaatcctgctcaaggctaccctgctcgccgtttccggagtgtaccccatgtctatccctgccacactgtttgtctggtatttctggcaaaagaaaaagcagcgcagcggcgtgctttgggacaccccctccccgcctgaagtcgagagagctgtgctggatgacggcatttaccggatcctgcagcgcgggctcctgggaagatctcaggttggcgtgggggtcttccaagatggagtgtttcatacaatgtggcacgttacgcggggcgcggtgcttatgtatcaggggaaacgcctggagcccagctgggcctccgtcaagaaagacctcattagctacggaggcggctggagattccaggggtcttggaacaccggagaagaggtgcaggtgatcgctgttgaacctggcaagaatcccaagaacgtccaaacaaccccggggacctttaaaacacctgagggagaagtgggcgccattgccctggacttcaagcccgggacgtccggaagccctatcgtgaatcgggagggcaaaattgtcggcctctacgggaacggagtggttaccacatctggcacctatgtgtccgctatcgcccaggcgaaggctagccaggaggggcccctgcccgaaatcgaggatgaagtctttaaaaagagaaatcttacaattatggacctgcaccctggatccggcaagacccgccggtacctgccggccatcgtgagagaggccattaaacgcaagctccggacgctgatccttgctcccacaagagttgtggcctctgaaatggcggaggctctgaaagggatgcctattcgctatcaaaccaccgccgtcaagagcgagcatacaggccgggaaatcgtggatctcatgtgccacgccaccttcacaatgagactgctgtcccccgttcgcgtgcctaactacaatatgatcattatggacgaggctcattttaccgatcccgccagcatcgctgcccggggatatatttctacgagagtcggcatgggggaagcggccgctatcttcatgacagccacccctccgggatccgtggaggcttttccccagagcaacgccgtgattcaggacgaagagcgggatatccctgagcgctcttggaatagcggctacgactggatcacagatttccccgggaaaaccgtctggtttgttccttccattaagtctggaaacgacatcgccaattgtctcagaaagaacggcaaacgggtgattcagcttagccgcaagacgttcgataccgaatatcaaaaaacaaagaacaatgactgggactacgtggtcaccacagatatctccgagatgggggctaacttcagagcggaccgggtgattgatcccagacgctgcctgaaaccggttatcctgaaggacggccctgaacgggtgattctcgccggacccatgcccgtcaccgtggcttctgccgcccagagacgcggccggatcgggagaaatcagaacaaggagggagatcagtacgtttatatgggccaacctctgaataacgacgaggatcacgctcattggacagaagccaaaatgcttctggacaatatcaacacccccgaggggattatccctgcgctctttgaaccggagcgcgaaaagagcgctgccattgatggagagtaccggctgagaggcgaggcccgcaaaacgttcgtggaactgatgagacggggggacctccccgtctggctttcctataaggtggctagcgagggctttcagtactctgatcgcagatggtgcttcgacggagaacggaataaccaggtcctggaggaaaatatggatgtggagatctggacaaaagagggcgaacgcaagaaactgagacctcggtggctcgacgccagaacctattccgaccccctggcgcttcgcgagtttaaggaattcgccgctgggcggagaagcgtttccggagatctgattctcgagatcggcaagctgcctcagcacctgaccctccgcgcccaaaacgctcttgacaatctggtgatgctgcacaactctgaacaggggggaaaagcctaccggcatgctatggaggagctccccgatacaatcgaaaccctgatgcttctggccctcattgcggtgctgacaggcggcgtcacgctgtttttcctcagcgggaagggacttggcaaaacctccatcgggctgctgtgtgttacagcctctagcgctctcctgtggatggcctccgtggagccgcactggattgctgccagcatcattcttgaatttttcctgatggtgctcctgatccctgagcccgacagacagcggacccctcaggataatcaactggcctatgtcgtgatcggactcctttttatgattctgacagttgctgcgaacgagatgggcctgctcgaaaccacgaagaaagacctggggatcggacatgtggccgctgagaaccaccagcacgccaccatgcttgatgtcgacctgcatcccgcctctgcttggacactctacgccgtggcgaccacagtcattacccctatgatgcgccacacgatcgaaaatacaaccgccaacatttccctgacagctatcgccaatcaggctgccattctgatgggcctcgataagggctggcccatcagcaagatggaccttggggtgccgctgctggcgctcggatgctactctcaagttaaccctctgacccttaccgccgctgtgctgatgctcgtcgcccattatgctatcattggccccgggctgcaggccaaagctacaagagaggcccagaagcggacggcggccggaatcatgaaaaatcccaccgtggatggcattgttgctatcgacctggatcctgtggtctacgacgccaagttcgaaaaacagctcgggcaaattatgcttctgatcctgtgtacatcccagatcctcctgatgcgcaccacatgggctctttgcgagagcattaccctggccacgggaccgctcacaaccctgtgggagggctctcccggcaagttttggaacaccacaatcgccgtgagcatggcgaatattttcagagggtcctatctggctggagccggcctcgctttctctcttatgaagagcctggggggaggccggcgcgggaccggagcccagggcgaaacactgggcgagaaatggaagagacagctcaaccaactgtccaaaagcgaatttaatacgtacaagcggtccgggatcatggaggtggaccgcaccgaagccaaagagggacttaagagaggcgagacaaccaagcacgctgtttctcgggggacagccaaactgagatggttcgtcgaacgcaacctcgtgaagcctgagggaaaagtgattgatctgggctgtgggcggggaggctggagctattactgcgcgggcctgaagaaagtcaccgaagttaaggggtatacgaaaggaggccccgggcatgaggaacctatccccatggccacctacggatggaatctcgtgaagcttcactccggcaaggacgtgtttttcatgcctccggagaaatgtgatacactgctgtgcgacatcggggagtctagccccaaccctaccattgaagagggaagaacactccgcgtcctgaagatggtggaaccctggcttcggggcaatcagttttgtatcaaaattctgaacccttacatgccctccgttgtggagaccctcgagcagatgcagagaaagcacggcgggatgctggtccgcaatccgctgtctcggaacagcacacatgaaatgtattgggtgtcctgcggaaccggcaatatcgttagcgctgtgaacatgacgtctagaatgctcctgaaccgcttcacaatggcccaccggaaacctacctacgagagagatgtcgaccttggggctggaacccgccatgtggccgtggaacccgaggtcgcgaatctggatattatcggccaacggattgaaaacatcaagaatgagcacaagtccacatggcactatgacgaggataacccctacaaaacgtgggcctatcatgggagctacgaagttaagccttctggatccgctagctctatggtgaatggcgtggtcagactcctgaccaaaccctgggacgtgatccctatggttacacagattgccatgaccgatacaaccccgtttggccagcaacgcgtgttcaaggagaaagtcgacacaagaaccccccgggctaagcgcgggacggcccagatcatggaagtgaccgctaagtggctttggggatttctgtccagaaacaaaaagcctcggatttgtacaagagaggaattcacccggaaagttcgcagcaatgccgcgatcggcgccgtgtttgtcgacgagaaccagtggaattccgctaaggaggccgtggaagatgagagattctgggacctcgttcaccgggaacgcgagctgcataaacaggggaagtgcgctacatgcgtgtataacatgatgggaaagagagaaaaaaagctgggcgagtttgggaaagccaagggcagccgggccatttggtacatgtggctcggagcgcgcttcctggagttcgaagctcttggctttatgaatgaggatcactggttctctagagaaaacagcctgtccggggtcgagggagagggcctccataaactggggtacatccttcgggacatctctaagattcccggaggcaatatgtatgccgatgacaccgccgggtgggatacgcgcatcacagaagacgatctgcaaaacgaggctaaaattaccgacatcatggaacctgagcacgccctcctggctacaagcatttttaagctgacctaccagaataaggtggtcagagtgcagcggcccgccaaaaacggcacggttatggatgtgatctcccgcagagaccagcggggatctggccaagtcgggacctatggactcaacacattcaccaatatggaagtgcagctgatccgccagatggagagcgagggcatttttttcccgtccgaacttgagtctcctaacctggcggaaagagtgctcgattggctggagaagcacggggccgaacggcttaaaagaatggctatcagcggagacgactgtgttgtgaagcccattgatgaccgctttgccacagctctgatcgccctcaatgatatgggcaaagtccggaaggacattcctcagtgggagccctccaaggggtggaacgattggcaacaggtgcctttctgcagccatcactttcatcagctgatcatgaaagacggcagagagatcgttgtgccctgtcgcaatcaggatgaactggtcggacgggcgagagtgtctcaaggcgccgggtggtccctccgcgagaccgcttgcctgggaaagagctacgcccagatgtggcagcttatgtatttccaccggagagacctgcgcctcgctgccaacgctatttgttctgccgtcccggtggattgggttcctacatcccggaccacgtggagcatccacgcgcatcaccaatggatgacaaccgaagacatgctgtccgtgtggaatagagtctggattgaggaaaacccctggatggaggataaaacccatgtgtctagctgggaggaagttccctaccttggcaagcgcgaggaccagtggtgcgggtccctgatcggactcacagcccgggctacctgggccacaaatattcaggtggccatcaaccaggtcagacggctgattggcaatgaaaactatctggactacatgacgagcatgaaaagatttaagaatgagtctgatcctgagggggctctctgg

SEQ ID NO: 19511 - RNA, 9879 nt, synthetic construct
  misc_feature 1..9879: note = derived and/or modified CDS sequence (opt5) from DENV-1__EU863650__SS-prME
  source 1..9879: mol_type = other RNA
agcgtgaccatgctgctcatgctgcttcccaccgtgctgacgttccacctcaccacaagaggcggggagcctcatatgatcgtttccaagcaggaacggggaaagtctctgctttttaagaccagcgccggcgtgaatatgtgcacactgattgctatggacctcggggagctgtgtgatgacaccatgacatacaagtgccccagaatcaccgaaacggagcccgatgacgtggattgttggtgcaatgccaccgaaacatgggtgacctatggaacatgttcccagaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaggaacaagacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcacaccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacatccggggccagcacctcccaagagacctggaaccgccaggacctcctggtcacattcaaaacggctcacgccaagaagcaggaagtggttgtgctgggatctcaagagggcgccatgcacaccgctctcacaggggcgaccgaaatccagacaagcggaaccacgacaatttttgccggccatctgaaatgcagacttaagatggataaactgaccctcaaggggatctcctatgtcatgtgtaccggcctgttcaaactggagaaggaagtggctgagacacagcacggaaccgttcttgtgcaggtcaagtacgagggcacagacgccccgtgcaaaatccctttcagctctcaagatgaaaagggggccacgcagaatggacggctcgtgaccgctaaccccattgtgacagacaaagagaagcctgttaatatcgaagccgagccgccctttggcgagtcctatattgtcgtgggggcgggagaaaaagctctgaagctgagctggttcaagaaaggctctagcatcgggaagatgtttgaggccaccgccagaggcgctcgccggatggccattctcggagatacagcttgggacttcggctccatcgggggagtgtttacctctgtcggcaaactggtgcatcagatcttcgggacggcctacggagttctttttagcggcgtgtcctggaccatgaagattgggatcggcattctgctcacatggctgggactgaacagcagatctacctcccttagcatgacatgtatcgcggtcggcatggtgaccctctacctgggggttatggtgcaggccgattctggatgcgtcattaattggaaaggccgcgaactgaagtgtgggtccggaatcttcgtgacaaacgaggttcacacctggacggaacaatataagtttcaggctgacagccctaaacggctctccgccgctattggcaaggcctgggaggagggggtgtgcggcatcagatctgcgacacgcctggaaaacatcatgtggaaacagattagcaatgagcttaaccatatcctgctcgaaaatgacatgaagttcaccgtcgtggtgggagatgtctccggcattctggcccaggggaaaaagaccatccggccgcaacccatggagcacaaatactcttggaaaagctggggaaaggctaagattatcggcgccgacgttcagaacacaacctttatcattgatgggcctaatacgcccgaatgtcctgacgatcagagagcttggaacatctgggaggtggaggactatggattcggcatttttacaaccaatatctggctgaaacttcgcgattcctacacacaggtgtgcgaccaccggctcatgagcgccgccattaaagattctaaggctgtccatgcggacatgggctattggatcgaatccgagaaaaacgaaacctggaagctggccagagctagcttcatcgaggtgaagacatgtgtttggcccaaatctcacaccctgtggtcccatggggtgctcgaaagcgagatgattatcccgaagatttacggaggccctatctctcaacacaattatcgccccgggtacttcacgcagaccgccggaccttggcacctgggcaaacttgagctggattttgacctctgcgaagggacaaccgtcgtggttgatgagcattgcggaaaccggggccccagcctgagaacaaccacggtgacaggcaagattatccacgaatggtgttgccggtcctgtaccctgcctccccttcgcttcaaaggggaggacggatgctggtacggcatggagatcagaccggtcaaggaaaaggaggaaaatctcgtgaaaagcatggtttctgccgggtccggagaggtggacagcttttccctgggcctgctctgtatttctatcatgattgaagaggtcatgcggagcagatggtcccgcaagatgctgatgacagggacccttgtggtgttcctgctcctgaccctgggacagcttacatggaacgatctgatccggctctgcattatggtcggcgctaatgcctctgacaacatgggcatggggacgacctatctggcgctcatggctacatttagaatgcgccctatgttcgccgttggactgctttttagacggctgaccagccgcgaggtgctcctgctgacagtgggcctttccctggtcgcctctgtggaactccccaatagcctggatgagctcggggacggactggctatgggcatcatgattcttaaactgctcaccgatttccaatcccatcagctgtgggccacgctgcttagcctgacatttgttaagaccaccctctctctgcactacgcgtggaaaacaatggctatgatcctctccatcgtgagcctgcttcccctgtgtctgtctaccacatcccagaagacgacctggctccctgtcctgcttgggagcctgggatgcaagccgctcacaatgttcctgattaccgaaaacaaaatctggggcagaaagtcttggcccctcaacgagggcattatggccgtggggatcgtttccattctgcttagctccctgctgaaaaatgacgtgcctctcgccggacccctgatcgctggcgggatgcttatcgcctgttatgtcattagcggatctagcgctgatctgtccctcgaaaaggccgcgaaagtgtcttgggaggaggaagccgagcatagcggcgcttcccacaacatcctggtcgaaattcaggacgatgggacaatgaagatcaaagacgaggaacgggatgacaccattacgatcctcctgaaggccacccttctggctatctctggagtgtaccctatgagcattcccgccacactgtttgtttggcacttctggcaaaagaaaaagcagcgctccggcgtgctctgggataccccttctcccccggaggtcgagaaagccgtgctggacgacggcatctatcgcattcttcagcgggggctgctcggacgcagccaggttggcgtgggggtctttcaagaaggagtgttccatacaatgtggcacgtgaccagaggcgctgttctgatgtaccaggggaagcggctcgagccttcctgggcgagcgtcaaaaaggatctgatctcttatggaggcggctggcgcttccaggggtcctggaatacaggagaagaggtccaggtgattgccgtcgagcccggcaagaaccctaaaaatgtgcaaacggctcccgggacctttaagacaagcgaaggagaggttggcgccatcgcccttgacttcaaaccggggacctctggatcccctattgtgaacagagaaggcaagatcgtcggcctgtacgggaatggagtggttaccacaagcggcacgtacgtgtccgctatcgcccaggcgaaggcttctcaggaggggcccctgcctgaaattgaggatgaggtctttcggaagagaaacctcaccatcatggacctgcatcccggaagcggcaagacacgccggtatcttcccgccattgtgagagaagccatcaaacgcaagctgcggaccctcgttctggctcctacaagagtggtcgcctccgagatggcggaagctctgaaagggatgccgattcgctaccaaaccacggccgtcaagagcgagcacacaggcaaagaaatcgtggatctcatgtgccatgccaccttcaccatgcggcttctgtctcccgtcagagttcctaattataacatgatcattatggacgaggctcactttacagatcccgcctccatcgctgcccgcggatacattagcacccgggtgggcatgggggaggcggccgctatcttcatgacagccacccctcccggatctgtggaggcttttcctcagagcaatgccgtcattcaggacgaggaaaaggatatcccggagagatcctggaactctggctatgactggatcacggatttccccgggaagacagtgtggtttgttcctagcattaaatccggaaatgacatcgccaactgtctgcggaagaatggcaaacgcgtgattcagctctctagaaagaccttcgacacagaataccagaagaccaagaacaacgattgggactatgtcgtgacgaccgatatcagcgagatgggggctaattttcgggcggaccgcgttattgatcccagacggtgcctgaagcctgtgatccttaaagacggccccgagagagtcattctggccggaccgatgcctgtgacagtcgcttccgccgcccagcgccggggcagaatcgggcgcaaccagaataaggaaggagatcagtacatctacatgggccaacccctcaacaatgacgaggatcacgctcattggaccgaagccaaaatgctgctggacaacattaatacacccgaggggatcattcctgcgctgttcgagcccgaacgggaaaagagcgctgccatcgatggagaatatagacttcgcggcgaggcccggaaaaccttcgtggaactgatgagacgcggggacctgcctgtttggctctcttacaaggtggcttccgagggctttcagtatagcgatagacggtggtgcttcgacggagagcgcaacaatcaggtgctggaagagaacatggacgtcgaaatttggacaaaagagggcgaaagaaagaaacttcggccgcgctggctggatgccagaacctactccgaccccctcgcgctgcgggagtttaaagagttcgccgctgggagacgctctgttagcggagatctgatcctcgaaatcggcaaacttcctcagcacctgacgcaacgggcccagaaagctctggacaatctcgtgatgctgcataactccgagcaagggggaaaggcctatagacacgctatggaggaacttcccgatacaattgaaaccatcatgctgctcgccctgattgcggtgctgaccggcggcgtcacactctttttcctttctgggcgcggactgggcaaaaccagcatcgggctgctctgtgtgacatccagctctgccctgctttggatggcttccgttgagcctcactggattgccgctagcatcatcctggagtttttcctcatggtgctgctgattcccgaaccggaccggcagagaacgcctcaagataatcagctcgcctacgtcgtgatcggacttctgtttatgattctgaccgtcgccgctacagagatgggcctcctggaaaccacaaagaaggaccttgggatcggacatgcggccgctgagaaccaccatcacgccgccatgctggatgtggacctccatcccgcttctgcctggaccctgtatgcggttgccacgaccattatcacacctatgatgcggcacaccattgagaatacaaccgctaacatctccctgacggccatcgctaaccaggccgcgattctcatgggccttgataaaggctggcccatcagcaagatggacattggggtgcctctgctggccctcggatgctactctcaagtcaatcccctgacacttaccgctgccgtgctgatgctcgttgctcactacgccatcattggcccggggctgcaggctaaagccacacgcgaagcgcagaagagaaccgccgctggaatcatgaaaaaccctaccgtggatggcatcgtcgccattgacctggaccccgtggtgtatgatgctaagttcgagaagcagctcgggcaaatcatgcttctgattctgtgtacaagccagatcctcctgatgcggacgacctgggccctttgcgaatccattacactggccaccggacccctcacaaccctgtgggagggctctcctggcaaattttggaatacgacaatcgcggttagcatggctaacatcttccgcgggtcctacctggccggagctggcctcgcctttagccttatgaagtccctcgggggaggcagacgggggaccggagcccagggcgaaaccctgggcgagaaatggaagcgccagctcaatcaactgtctaaaagcgagttcaagacatataagagatccgggattatcgaagtcgaccggtctgaggctaaagaaggacttaagcgcggcgagaccacaaaacatgccgtgagcagagggacggcgaagctgcggtggttcgtggaaagaaacctcgtcaaaccggagggaaaggttattgatctgggctgtgggcgcggaggctggtcctactattgcgccggcctgaaaaaggtgaccgaggtgaaggggtctacaaaaggaggccccgggcacgaggaacctatccccatggctacctacggatggaatctcgtcaaacttcatagcggcaaagacgtgtttttcattcctcccgaaaagtgtgatacactgctgtgcgacatcggggagtccagccctaacccgaccattgaagagggacggacgctcagagttctgaaaatggtggagccctggcttcgcggcaatcagttttgtatcaagatcctgaacccttatatgccctctgtcgtggaaaccctcgagcagatgcagcggaagcacggcgggatgctggttagaaatcctctgtcccgcaacagcacacacgaaatgtactgggtgtcttgcggaaccggcaatattgtctccgccgtgaacatgacaagccggatgctcctgaatagattcaccatggctcatcgcaaacccacatacgagcgggatgtggaccttggggccggaaccagacacgtcgcggttgagccggaagtggccaacctggatatcattggccaacgcatcgagaatattaagaacgaacataaatctacgtggcactatgacgaggataacccttacaagacatgggcttatcatgggtcctacgaagtgaaacccagcggatccgccagctctatggtcaatggcgtggttcggctcctgaccaagccctgggacgtgatccctatggtcacccagatcgctatgacagacacgaccccctttggccagcaaagagtgttcaaggagaaagttgatacacgcacccctaaggccaaaagagggacagctcagattatggaggtgaccgccaagtggctttggggatttctgagccggaacaaaaagccgcgcatctgtacaagagaagagttcacccggaaggtcagatccaatgcggccattggcgctgtgtttgttgacgaaaaccagtggaactctcccaaagaggccgtggaagatgagcggttctgggacctcgtccaccgcgagagagaactgcacaagcaggggaaatgcgctacgtgcgtgtataacatgatgggaaagcgggagaaaaagctgggcgaatttgggaaagccaagggcagccgcgccatctggtacatgtggctcggagcgagattcctggagtttgaagctcttggcttcatgaatgaggatcattggttctcccgggagaactctctgagcggggtcgaaggagagggcctccacaagctggggtatattcttcgcgacatctccaaaatccctggaggcaatatgtacgccgatgacaccgccgggtgggatacaagaattaccgaagacgatctgcaaaacgaggctaagatcacagacattatggagcccgaacatgccctcctggctacctctatctttaaactgacgtaccagaataaggtggttcgggtgcagcgccctgccaaaaacggcacagtcatggatgtgattagcagacgggaccagcgcggatccggccaagtggggacctatggactcaatacattcaccaacatggaggcgcagctgatcagacagatggaaagcgagggcatctttcttccctctgaactggagccgcctaatctcgccgggcgggttcccgactggctggagaagcacggaacggaacgccttagacggatggctatttccggcgatgactgtgtggtcaagcctatcgatgacagattcgccaccgctctgacagccctcaacgatatggggaaagtgcgcaaggacattccccagtgggagcctagcaaaggctggaacgattggcaacaggttcccttttgctctcaccatttccaccagctgatcatgaaggacggacgggaaattgtggtcccgtgtagaaatcaggatgagctggtgggccgcgcgcgggtctcccaaggggccggatggagcctcagagaaaccgcttgcctgggcaaatcctacgcccagatgtggcagcttatgtattttcatcgccgggacctgagactcgctgccaacgctatctgttctgccgtgcctgttgattgggtgcccacaagccgcaccacatggtccattcacgcgcatcaccaatggatgaccacggaggacatgctgagcgtctggaatcgggtgtggatcgaggaaaacccctggatggaggacaagacacacgtttcttcctgggaagatgtgccttaccttgggaagagagaggaccagtggtgcggaagcctgatcggcctcaccgcccgcgctacctgggccacaaatattcaggtcgccatcaaccaggtgcggagactgattgggaatgaaaactatctggattacatgacctctatgaaacggttcaagaatgagagcgacccggagggcgctctctggtga

SEQ ID NO: 19512 - RNA, 9879 nt, synthetic construct
  misc_feature 1..9879: note = derived and/or modified CDS sequence (opt5) from DENV-1__KU365900__SS-prME
  source 1..9879: mol_type = other RNA
agcgtgaccatgctgctcatgctgatgcccacagcccttgctttccacctgacgacccggggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagcacaaatactcttggaaaagctggggaaaggccaagattatcggcgctgacgtgcagaataccacctttatcattgatgggcctaacacacccgaatgtcctgacgatcagagagcgtggaatatctgggaggtcgaggactatggattcggcatttttaccacgaacatctggctgaagctgcgcgattcctacacacaggtttgcgaccaccggcttatgagcgccgctattaaagattctaaggccgtgcatgccgacatgggctattggatcgaatccgagaaaaatgaaacctggaagctcgctagagccagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgcgggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcagaggggaggacggatgctggtacggcatggagattcggccggtgaaagaaaaggaggaaaatcttgttaagagcatggtgtctgctgggcctggagaggtcgactcctttagcctcggcctgctgtgtatctccattatgatcgaagaggtgatgagatctcgctggagccggaaaatgctcatgacagggaccctggccgttttctttcttctgattatgggacagctcacatggaacgatctgatcagactgtgcattatggtgggcgccaatgcttccgaccgcatgggcatggggaccacctatcttgccctgatggcgacattcaagatgagacccatgtttgctgtcggactcctgctccggcgcctgacgtctagagaggtgcttctgctcaccatcggcctgagcctggtggcctccgtcgaacttcccaactctctggaggaactcggggatggactggccatgggcatcatgattctcaaactgcttacagacttccaaagccaccagctgtgggctaccctcctgtccctgacatttatcaagaccacgttcagccttcattacgcctggaaaacaatggctatggttctgtctattgtgtccctctttcctctgtgtctcagcaccacctctcagaagacaacctggctgccggtgcttctggggtccctgggatgcaagcccctcacaatgttcctgatcgccgagaataaaatttggggcagaaagagctggcctcttaacgaaggcatcatggcggtcgggatcgtgtctattctgctctccagcctgctcaaaaacgatgttcccctggccggacctcttatcgctggcgggatgctgattgcctgttatgtgatctccggaagctctgctgacctgagcctcgagaaggccgccgaggtctcctgggaagaggaagctgagcactctggcgcgagccataatattctggtggaagttcaggatgacgggacgatgaaaatcaaggatgaggagcgcgacgatacccttacaatcctgctcaaagccaccctgctcgctgtgtccggagtctaccccctgtctattcctgccacactttttgtgtggtatttctggcaaaagaagaaacagagaagcggcgtcctgtgggacaccccctccccgcctgaagtggagcgggccgttctggatgacggcatctaccgcattatgcagagagggctcctgggacggtctcaggtgggcgtcggggtgttccaagaaaacgtttttcacacgatgtggcacgtgacccgcggagctgtccttatgtatcagggcaagagactggagcccagctgggcctccgtgaaaaaggacctcatcagctacgggggaggctggcggctgcagggctcttggaatacaggggaggaagtgcaggttattgcggtcgagcctggcaagaatcccaagaatgtgcaaaccgctccgggcacattcaagacccctgaaggggaggtgggagccatcgccctcgattttaaacccggcacatccgggagccctattgtcaacagagaaggaaagatcgtgggcctgtacggcaatggggttgtgacgacctctggaacatatgtctccgctatcgcccaggcgaaagctagccaggagggcccccttcccgagattgaagacgaggtgttccgcaagcggaacctgaccatcatggatctgcatcctgggtccggaaaaaccagacgctacctcccggccattgttcgggaagccatcaagagaaagctgcgcacacttattctggctcccacgcgggtggtcgcctctgagatggctgaagccctcaaaggcatgcctatcagatatcaaaccacagcggtcaagagcgagcacaccgggaaagagatcgttgacctgatgtgccatgccacatttaccatgcgcctgctctcccccgtgcgggtccctaattacaacatgattatcatggatgaagctcacttcacggaccccagctctattgccgctagaggctatatctccacacgggtgggaatgggcgaggccgccgctatttttatgaccgcgacccctccggggagcgtggaagccttcccccagtctaatgctgtcatccaggatgaggaacgcgacatccctgagagaagctggaactccggatacgagtggattacagattttcccggcaagaccgtttggttcgtgccttctatcaaaagcgggaatgacattgccaactgtcttcggaagaatggaaagcgcgtgatccagctgtccagaaaaacatttgataccgaatatcaaaagacgaaaaacaacgactgggactacgtcgtgacaaccgatatttctgagatgggcgccaatttccgggctgacagagttatcgatccccgccggtgcctgaagccggtgattctcaaagacgggcctgaaagagtcatcctggccggccccatgcccgtgacagttgcgagcgctgcccagcgccggggaagaatcggccgcaaccataataaggagggggatcagtacatttatatgggacagcctcttaacaatgacgaggatcacgcccactggaccgaagctaagatgctgctcgacaacatcaatacgcccgagggcattatccctgccctgttcgaaccggagcgggaaaaatccgcggccattgatggggagtacagactgcgcggagaggctagaaagacctttgtggaactcatgcggcgcggcgaccttcccgtctggctgagctataaagtggcctctgaggggttccaatactccgatagaaagtggtgctttgacggcgaacggaacaatcaggtcctggaggaaaacatggatgtggagatctggacaaaagagggagaacgcaagaaactcagacctcggtggctggacgctagaacctatagcgacccccttgccctgcgcgagttcaaggaatttgctgccggccggagatccgtttctggggatctcatcctggagattggaaagctgcctcagcatctcacacagcgcgcgcaaaatgcccttgacaacctggtgatgctgcacaatagcgaacagggcgggcgggcttacagacatgccatggaggagctccccgataccatcgaaacactgatgcttctggctctcattgccgtgctgaccggaggcgtcacgctgttctttctctccggccgggggcttggaaaaacatctatcggcctgctgtgtgttatggccagctccgtgctcctgtggatggctagcgtggagccgcactggattgcggcctctatcatccttgagttctttctgatggtcctcctgattcctgagcccgaccgccagagaacccctcaggataaccaactggcttatgtggttatcgggctccttttcatgattctgaccgtggccgccaatgagatgggactgctcgaaacaaccaagaaagacctgggcatcgggcacgtcgctgtggagaaccatcaccatgccacaatgcttgatgtcgacctgcaccccgcgtccgcctggacgctctacgctgtggccaccacaattatcacccctatgatgcggcatacaattgaaaacaccacggctaatatcagcctgaccgccatcgcgaaccaggccgctattctgatgggactcgataagggctggcccatctctaaaatggacattggcgttccgcttctggccctggggtgctactcccaggtgaatcctctcacactgaccgctgccgtccttatgctggtggctcactatgccatcattggacccggcctccaagcgaaggccacacgcgaggctcagaagagaaccgccgctgggatcatgaaaaaccccacggttgatggaatcgtggccattgacctggatcctgtcgtgtacgacgccaagtttgaaaaacagctgggccagatcatgctccttattctgtgtacaagccaaatcctgctcatgcggaccacatgggcgctgtgcgagtctattacccttgctaccgggccgctgacaacgctctgggagggaagccccggcaagttctggaataccacaatcgccgtgtccatggctaacatctttcgcggctcttatctggccggggccggactggctttcagcctcatgaaatcccttggcgggggaagacggggcaccggggcccagggagaaacactgggcgagaagtggaagcgccagctgaatcagctcagcaaatccgagttcaacacctacaagagatctggcattatggaggttgaccggagcgaagcgaaagaggggctgaagagaggagagacgacaaaacacgccgtctcccgcggcaccgctaaacttcggtggtttgtggaaagaaatctggtgaagcctgaggggaaagtcatcgatctcggatgtggccgcgggggatggtcttattactgcgccggcctgaagaaagttaccgaagtgaagggctatacaaaagggggacccggccatgaggaacctattcccatggctacctacgggtggaacctggtgaagctctacagcggaaaagacgtcttctttatccctccggagaagtgtgatacacttctgtgcgacattggcgagtcctctcccaatcctacgatcgaagaggggcggaccctgagagtgctcaagatggttgaaccctggctgcgcggaaaccaattctgtattaaaatccttaatccttatatgcccagcgtggtcgagacactggagcagatgcagcggaagcacggcggcatgctcgtgagaaacccgctgtcccgcaatagcacccatgaaatgtactgggtttcttgcgggacaggaaacatcgtgtccgccgtcaatatgaccagccggatgctgctcaacagatttacgatggcgcaccgcaaacctacctatgagaaggatgtggacctgggcgccgggacacggcacgtggctgtcgaacccgaggttgccaaccttgatattatcggacagagaattgaaaatatcaaacatgagcacaagtctacctggcattacgacgaggataacccctataagacatgggcttaccacggctcctatgaagtgaaacctagcgggtctgcctccagcatggtgaatggagtcgtgaagctgctcaccaaaccctgggacgttattcctatggtgacacaaatcgctatgaccgatacgacaccgttcggccagcagcgcgtctttaaggagaaagtggacaccagaacccccaaggccaagcggggcacagcgcaaatcatggaagttacggcccgctggctgtgggggttcctttccagaaacaaaaagcctcggatttgtaccagagaggaatttacacggaaagtgcgcagcaatgctgccatcggagctgtcttcattgacgagaaccagtggaactctgccaaggaggccgtggaagatgagagattttgggacctggttcatcgggaacgcgagctccacaaacagggcaagtgcgcgacctgcgtgtacaacatgatggggaagagagagaaaaagctgggagagttcggcaaagctaaggggagccgggccatctggtacatgtggctgggcgcccgctttctcgagttcgaagctctgggattcatgaatgaggatcactggttttccagagaaaactctcttagcggcgtcgagggggagggactgcataaactcggctatattctgcgggacatctccaagatctctgggggaaatatgtacgccgatgacacagctggctgggatacccgcattacagaagacgatcttcagaacgaggccaaaatcaccgacattatggaacccgagcacgcgctgctcgccaaggctatcttcaagctgacgtatcaaaataaagtggtcagagtgcagcggcctgccaagaacgggaccgttatggatgtgattagccgcagagaccagcggggctccggacaggtcggcacatacgggctgaatacctttacaaacatggaagctcaactcatccgccagatggagtctgagggaatcttcagcccctccgaactggagaccccgaaccttgccgaaagagtgctggattggctcggcaaatatggggtggagcggctgaagagaatggcgattagcggagacgactgtgttgtgaaacctatcgatgaccgctttgccacggctcttacagccctgaatgatatgggcaaggtccggaaggacattccccagtgggaaccttctaaagggtggaacgattggcagcaagtgcccttctgctcccatcactttcaccagctcatcatgaaggacggcagagagattgttgtgccttgtcgcaatcaggatgagctggtcggacgggctagagtgagccagggcgccgggtggtctctgcgcgaaaccgcttgcctcggaaaatcctacgcccaaatgtggcagctgatgtatttccatcggagagaccttcgcctggcggccaacgctatctgtagcgccgtccccgtggattgggttccgacatcccggaccacgtggtctattcacgcccatcaccagtggatgaccacagaggacatgctcagcgtgtggaatagagtctggatcgaagagaacccttggatggaagataagacccatatctccagctgggaggacgtgccctacctgggcaaacgcgaggaccaatggtgcgggtctcttattggactgacagctcgggccacctgggcgacaaatatccaggttgctattaaccaggtgagacggctcatcggcaatgaaaactacctggattatatgacctccatgaagagatttaagaatgagagcgaccccgaaggggccctgtggtga

SEQ ID NO: 19513 - RNA, 9879 nt, synthetic construct
  misc_feature 1..9879: note = derived and/or modified CDS sequence (opt5) from DENV-1__FJ176779__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttgtggcgatggacctgggggagctctgtgaagatacaatgacctacaaatgcccgcgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccgtgctgcgcaaactttgcatcgaagcgaagatttccaataccacgacagatagcagatgtccgacccaaggagaggccaccctggtggaagagcaggacgctaacttcgtctgccggcgcacatttgtggatagaggctggggcaatgggtgtggactcttcggcaaagggtctctgcttacctgcgccaagtttaagtgcgttacaaaactggagggaaagatcgtgcagtacgaaaacctcaaatattccgtcattgtgacggttcacaccggcgaccagcatcaagtggggaatgagagcacagaacacggaaccacagctaccatcacgccccaggcccctaccacagagatccagctgaccgactacggcgccctgacactcgattgttctccccggaccggcctggacttcaacgaaatggtccttctgacgatgaaggagaaatcctggctcgtgcataagcagtggtttctggatcttcctctgccctggacaagcggggcttccacctctcaagagacatggaatcgccaggacctcctggtcaccttcaaaaccgcgcacgccaagaagcaggaagtggttgtgctgggaagccaagagggcgctatgcacacagccctcacgggggccaccgaaattcagacatccggaaccacaaccatctttgctggccatctgaaatgcagacttaagatggataaactgacgctcaaggggatgagctatgtcatgtgtacaggctctttcaaactggagaaggaagtggccgagacccagcacggaaccgttctggtgcagattaagtacgagggcacagacgcgccgtgcaaaatccctttctccacccaagatgaaaagggggtcacacagaacggacggcttattacggctaatcccatcgtgaccgacaaagagaagcctgtgaacatcgaagccgagcccccctttggcgagagctatattgttatcggggtcggagaaaaagccctcaagctgtcttggttcaagaaaggcagctccattgggaagatgtttgaggctacagccagaggcgctcgccggatggccatcctgggagataccgcgtgggacttcggctctattgggggagtgtttacaagcgtgggcaaactcgtccatcagatcttcgggaccgcctacggagtgctgttttccggcgttagctggacgatgaagatcgggattggcgtgcttctgacctggctcggactgaattctagatccacaagcctgtctatgacctgtatcgctgtcggccttgtgacactctacctgggggttatggtgcaggccgattccggatgcgtcattaactggaaaggccgcgaactgaagtgtgggagcggaatcttcgtgaccaatgaggttcacacatggaccgaacaatataagtttcaggctgactcccctaaacggctctctgccgcgattggcaaggcctgggaggagggggtgtgcggcatcagaagcgctacgcgcctggaaaacattatgtggaaacagatctccaacgagcttaatcatatcctgctcgaaaacgacatgaagttcacagtcgtggtgggagatgtcgccggcattctggctcaggggaaaaagatgatccggccgcaacccatggagcacaaatactcttggaagaattggggaaaggccaaaattatcggcgccgacgttcagaacagcacctttattatcgatgggcctaatacccccgaatgttccgacgatcagagagcttggaacatctgggaggtggaggactatggattcggcatttttacaaccaatatctggctgaagcttcgcgatagctacacgcaggtgtgcgaccaccggctcatgtctgcggccattaaagattccaaggctgtccatgccgacatgggctattggatcgaaagcgagaaaaacgaaacatggaagctggccagagcttctttcattgaggtgaagacctgtatctggcctaaatcccacacactgtggagcaatggggttctcgaatctgagatgatcattcccaagatctacggaggcccgattagccaacataactatcgccctgggtacttcacccagacagccggaccctggcacctgggcaaacttgagctggattttgacctctgcgaagggaccacggtggtcgtggatgagcactgcggaaatcggggcccttccctgagaaccacaaccgttacaggcaagatcattcatgaatggtgttgccggagctgtaccctgccccctcttcgcttcagaggggaggacggatgctggtacggcatggagatccggcccgtgaaagaaaaggaggaaaacctcgtcaagtctatggtgtccgcggggagcggagaggttgactccttttctctgggcctgctctgtatcagcattatgatcgaagaggtgatgagatcccgctggtctcggaaaatgctgatgacggggacacttgctgtcttctttctgctcattatgggacagctgacctggaatgatctgatcagactttgcattatggtgggcgccaacgccagcgaccgcatgggcatggggacaacctatctggctctcatggccaccttcaagatgagaccgatgtttgcggtgggactgctcttccggcgcctgacatccagagaggtccttctgctcacgatcggcctgtctctggttgctagcgtggaacttcctaattccctggaggaactcggggatggactggccatgggcattatgatcctcaaactgcttaccgactttcaaagccaccagctgtgggccacactcctgtctatgaccttcatcaagacaaccttttccctgcattacgcttggaaaacgatggccatggtgcttagcattgtctctctgttccccctctgtctgtccacaaccagccagaagaccacatggctccccgtgctgcttgggtctctgggatgcaagcctctgaccatgtttctcatcgctgagaacaaaatttggggccggaagtcctggccgctgaacgaaggcatcatggccgttgggattgtgagcatccttctgtccagcctcctgaaaaatgatgtccccctcgcgggacctctgatcgccggcgggatgcttattgcttgttatgtgatctctggaagctccgccgacctgtctctggagaaggctgccgaggttagctgggaagaggaagccgagcactccggcgcttctcataacattctcgtggaagtccaggatgacgggacaatgaaaatcaaggatgaggagcgcgacgatacgctgaccattcttctgaaagcgacactcctggccgtgagcggagtctaccccctctccatccctgctaccctgttcgtgtggtatttctggcaaaagaagaaacagagatctggcgttctttgggacacacccagccctcccaaggtggaacgggccgtcctggatgacggcatctaccgcattatgcagagagggctgctcggacggtcccaggtgggcgttggggtgtttcaagagaatgtcttccacaccatgtggcacgtgacgcgcggagccgtgctgatgtatcagggcaaaagacttgaaccgagctgggcttctgttaagaaagacctgatctcctacgggggaggctggcggctccagggcagctggaacaccggggaggaggtccaggtgattgccgtggaacctggaaagaatcccaagaacgtccaaacagcgcctggcacctttaaaacacccgagggggaagtgggagctatcgccctggatttcaagccgggcacctctgggtcccctattgttaatagagagggaaaaatcgtgggcctctacggcaacggggtcgtgacaacgagcggaacctatgtttccgccattgctcaggccaaggcgtctcaggaaggccccctgcctgagatcgaggacgaagtgtttcgcaaacggaatcttacaatcatggatctgcatcccgggagcggaaagaccagacgctacctgcccgctattgtccgggaggccatcaagagaaaaatgcgcaccctcattctggcccctacacgggtggttgcttccgaaatggccgaggctcttaagggcatgccgatcagatatcaaacgaccgccgtgaaaagcgaacacacagggaaggagattgtcgacctgatgtgccatgcgaccttcacaatgcgcctcctgtctcccgtgcgggtgcctaactacaatatgatcatcatggatgaggcccactttaccgacccctccagcattgctgccagaggctatatctctacgcgggtcggaatgggcgaagctgccgccattttcatgacagctacccctcccgggagcgttgaggcgtttcctcagtccaacgccgtgatccaggatgaagagcgcgacattccggaaagatcttggaatagcggatacgagtggatcaccgagttccccggcaaaacagtgtggtttgtcccttccatcaaggctgggaacgatattgccaattgtctgcggaagaacggaaaacgcgtgatccagctctctagaaagaccttcgacacagaatatcaaaaaaccaagaacaatgattgggactacgttgtgacgacagacattagcgagatgggcgccaacttccgggctgatagagtcatcgacccccgccggtgccttaaacctgtgattctgaaggatgggcccgaaagagttatcctggccggcccgatgcctgtgaccgtcgcgtccgctgcccagcgccggggaagaattggccgcaatcataacaaggagggggaccagtacatctatatgggacagcccctcaataacgatgaggaccacgcccactggacagaagctaaaatgctgcttgataatatcaacacccccgagggcattatccctgccctgtttgaacccgagcgggaaaagagcgcggccattgacggggagtacagactccgcggagaggctagaaaaacgttcgtggaactgatgcggcgcggcgatctgcctgtctggctctcttataaggtggcctccgaggggtttcaatacagcgacagacggtggtgcttcgatggcgaacgcaataaccaggttcttgaggaaaatatggacgtggagatctggaccaaagagggagaaagaaagaaactgcggccgagatggctggatgctcgcacatattccgaccccctcgccctgcgggagtttaaggaattcgctgccggcagacgctctgtgagcggggaccttattctggagatcggaaagctccctcagcatctgacccagcgggcgcaaaacgccctggataatctcgtcatgcttcacaactccgaacagggcgggagagcttaccggcatgccatggaggagctgcccgacacaatcgaaaccctgatgctcctggctcttattgccgttctgacaggaggcgtgaccctctttttcctgtctggcaaagggctgggaaagacgagcatcggcctcctttgtgtgatggcctccagcgtcctgctgtggatggcttctgtggagcctcactggattgcggcctccatcattctcgaatttttcctgatggttcttctgatccccgagccggatcgccagagaacacctcaggacaatcaactcgcttatgtggtcatcgggctgctgtttatgattctcaccgtggccgccaacgagatgggacttctggaaaccacaaaaaaggatctgggcatcgggcacgtcgctgtggagaaccatcaccatgccgcgatgctcgacgttgatctgcaccccgccagcgcttggaccctttacgccgtggctacaacgattatcacccctatgatgcggcatacaattgaaaataccacagccaacatctctctgaccgcgattgccaatcaggctgccatcctcatgggactggacaaaggctggcccatctccaagatggatattggcgtccctctgctcgctcttgggtgctacagccaggtgaaccccctgacgctgaccgccgctgttctcatgctggtggcccactatgcgatcattggaccgggccttcaagccaaggctacacgcgaggcccagaaaagaaccgctgccgggatcatgaagaatcctacaattgacggaatcgtcgccatcgatctggaccccgtggtgtacgatgcgaaattcgaaaagcagctcggccagattatgctgctgatcctctgtacctctcaaattcttctgatgcggacgacatgggctctgtgcgagagcatcaccctcgccacagggcccctgaccaccctttgggagggatcccctggcaaattttggaacacaacgattgctgtttctatggccaatatcttccgcggcagctatctggccggggctggactcgccttctccctgatgaagagcctgggcgggggaagacggggcaccggggcgcagggagaaacactcggcgagaagtggaaacgccagcttaaccagctgtccaagtctgaatttaatacctacaaaagaagcggcatcatggaggtcgaccggtccgaagccaaggaggggctgaaaagaggagagacaaccaagcacgctgtgtctcgcggcacggccaagctccggtggttcgtggaaagaaacctggtcaaaccggaggggaaggttattgaccttggatgtggccgcgggggatggagctattactgcgctggcctgaaaaaggtgacagaagtgaaaggctataccaaggggggacccggccatgaggaacctatccccatggccacctacgggtggaatctcgtcaaactgcactccggaaaggatgtgtttttcattcctcccgagaagtgtgacacactgctctgcgatatcggcgagtctagccctaacccgaccattgaagaggggcggacacttagagttctgaaaatggtggaaccctggctgcgcggaaatcaattttgtatcaagattctcaacccttacatgccctccgtcgtggagacgctggagcagatgcagcggaaacatggcggcatgcttgttagaaatcctctgagccgcaactctacccacgaaatgtattgggtgtcctgcgggacaggaaatatcgtcagcgcggtgaacatgacctctcggatgctcctgaacagattcacaatggcccaccgcaagcccacctacgagcgggacgtggatctgggcgctgggacgagacatgtcgccgttgaaccggaggtgaccaatctcgacatcattggacagcgcatcgaaaacattaaatatgagcacaagtccacatggcattacgatgaggacaatccttataagacctgggcttaccacggcagctatgaagtgaaaccctctgggtccgccagctccatggtcaacggagtggttaagctgcttacaaaaccctgggatgtgatccctatggtcacccaaattgctatgacagacaccacgccctttggccagcagagagtgttcaaggagaaagttgatacacggacccctaaggccaagcgcggcaccgcgcaaatcatggaagtgacagccagatggctgtggagctttctctctcggaataaaaagccgagaatctgtacgcgggaggaattcacccgcaaagtcagaagcaacgctgccattggggctgtgtttgttgacgagaatcagtggaactccgccaaggaggccgtggaagacgatcggttctgggacctggtccatcgcgagagagaacttcacaaacagggaaagtgcgcgacatgcgtgtacaatatgatgggcaagcgggagaaaaagctgggggaatttggaaaagctaagggctctcgcgccatctggtacatgtggctcggggccagattcctggagttcgaggctctgggctttatgaacgaagatcactggttcagccgggagaattccctctctggagtcgaaggcgaggggctgcataaacttggatatattctgcgcgacatcagcaagattcccggcgggaacatgtacgccgatgacaccgctggatgggatacaagaatcaccgaggacgatctccagaatgaagccaaaatcacagacattatggagcctgaacacgcgctgcttgccaagtccatctttaagctgacctatcaaaacaaagtggttcgggtgcagcgccccgctaagaatggcacggtcatggatgtgatttctagacgggaccagcgcgggagcggccaggtgggaacctacggcctcaacacattcaccaacatggaggcccaactgatcagacagatggaatccgaggggatttttagccctaatgagctggaaacacccaacctcgctgagcgggttctggattggcttgaaaaatatggagtggagagactgaagcgcatggccatctctggcgacgactgtgtcgtgaaaccgatcgatgaccggttcgcgaccgccctcacggctctgaatgatatggggaaggttagaaaggacattcctcagtgggaaccctccaaaggatggaacgattggcagcaagtgcctttttgcagccatcacttccaccagcttatcatgaaggacggccgcgagattgtcgtgccctgtcggaatcaggatgagctggtcgggagagcccgcgtgtctcagggcgctggatggtccctccgggaaacagcctgcctgggcaaaagctacgctcaaatgtggcagctgatgtattttcatagacgcgacctccggctggccgcgaacgccatctgttccgctgttcctgtggattgggtccccacctctagaacaacctggagcattcacgcccatcaccagtggatgacgaccgaggacatgctttccgtgtggaatcgcgtttggatcgaagagaacccgtggatggaagataagacacggattagctcttgggaggacgtgccttacctggggaaaagagaggaccaatggtgcggatccctcatcggcctgaccgcccgggctacatgggccaccaatatccaggtcgcgattaaccaggtgagacgccttatcgggaatgaaaactacagcgattatatgacatctatgaagcggttcaagaatgagagcgaacccgagggagctctgtggtga

SEQ ID NO: 19514 - RNA, 9879 nt, synthetic construct
  misc_feature 1..9879: note = derived and/or modified CDS sequence (opt5) from DENV-1__FJ176780__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaatatgtgcacccttattgcgatggacctgggggagctctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatatctgggaggtcgaggactacggattcggcatttttaccacgaacatctggctgaagctgcgcgattcctatacacaggtttgcgaccaccggcttatgagcgccgctattaaagattctaaggccgtgcacgccgacatgggctactggatcgaatccgagaaaaatgaaacctggaagctcgctagagccagcttcatcgaggtgaagacatgtatttggcccaaatctcataccctgtggtccaacggggtcctggaaagcgagatgatcattccgaagatctatggaggccctatttctcaacacaattaccgccccgggtacttcacacagaccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggaaaatgctcatgacagggaccctggccgttttctttcttctgattatgggacagctcacatggaacgatctgatcagactgtgcattatggtgggcgccaatgcttctgaccgcatgggcatggggaccacctaccttgccctgatggcgacattcaagatgagacctatgtttgctgtcggactcctgttccggcgcctcacgagcagagaggtgctgcttctgaccatcggcctctccctggtggcctctgtcgaactgcccacaagccttgaggaactgggggatggactcgccatgggcatcatgattctgaaactcctgaccgactttcaatcccatcagctttgggctacactgctcagcctgaccttcgttaagacgacattttctctgcactatgcctggaaaaccatggctatggtgctttccatcgtgagcctgttccccctctgtctgtctaccacatcccagaagaccacatggctccctgtcctgcttgggagcctgggatgcaagccgctgacgatgtttctcattgccgagaacaaaatctggggccggcgctcttggcccctgaatgaaggcattatggcggtggggatcgtttccatccttctgagctccctcctgaagaacgatgtgcctctcgccggacccctgattgctggcgggatgcttatcgcctgttacgtcattagcggatctagcgctgacctgtccctggagaaagccgccgaggtgtcttgggaagaggaagctgagcatagcggcgcgtcccacaacatcctcgttgaagtgcaggatgacgggaccatgaagattaaagatgaggagagagacgatacactgaccatccttctgaaggccacactcctggctgtctctggagtgtatcctctcagcatccccgccaccctgttcgtctggtacttctggcagaagaagaagcagcggtccggcgtgctttgggacacgccttctcccccggaagttgagcgcgccgtgctggatgacggcatttatagaatcatgcagcgggggctgctcggacgcagccaggtcggcgtgggggtttttcaagaaaatgtgttccataccatgtggcacgtcacaagaggagctgtgctgatgtaccagggcaaacggcttgagccttcctgggccagcgtgaagaaagacctgatttcttacgggggaggctggagactccagggctcctggaacaccggggaggaagttcaggtcatcgcggtggagcccggaaagaatcctaaaaacgtgcaaacagctcccggcacctttaagacaccggaaggggaggtcggagccattgccctggatttcaagcctggcacgagcgggtctcccatcgtgaatcgcgaaggaaaaattgttggcctctatggcaacggggtggtcaccacatccggaacctacgtgagcgctatcgcccaggcgaaggcttcccaggagggccctctgcccgagatcgaagacgaggtttttcggaaaagaaatcttaccattatggatctgcaccccgggtctggaaagacacgccggtatctgcctgccatcgtgagagaagccattaaacgcaagctccggacgctgatccttgctccgaccagagtcgtggccagcgagatggctgaagccctgaagggcatgcccattcgctaccaaacaaccgcggttaaatccgagcatacagggaaggagatcgtggacctcatgtgccacgccaccttcacgatgcggctgctgagccctgtcagagtgcccaactataatatgatcattatggatgaagctcattttacagacccttcttccatcgccgctcggggctacattagcacccgcgtgggaatgggcgaggccgccgctatcttcatgaccgcgacaccccctgggtctgtcgaagcctttccgcagagcaacgctgttattcaggatgaggaaagagacatccccgagcggtcctggaactctggatatgagtggatcaccgatttccctggcaaaacagtgtggtttgtgcccagcattaagtccgggaacgacatcgccaattgtctccgcaaaaacggaaagagagtcattcagctttctcggaagaccttcgatacggaataccagaaaacaaagaataacgactgggactacgtggttaccacagatatcagcgagatgggcgccaacttcagagctgaccgcgtgattgatcctcggagatgcctgaaacccgtcatcctgaaggacgggccggaacgcgtgattctcgccggccctatgcccgttaccgtggcgtccgctgcccagcggagaggacgcatcggccggaatcacaacaaagagggggatcagtatatctacatgggacagcccctgaataacgacgaggatcatgcccactggacggaagctaagatgcttctggacaatattaacacccctgagggcatcattcccgccctctttgaacctgagagagaaaagagcgcggccatcgatggggagtatcgcctgagaggagaggctcggaaaacattcgtcgaactgatgcgcagaggcgacctcccggtgtggctttcttacaaggtcgcctccgaggggtatcaatacagcgatcggcgctggtgctttgacggcgaaagaaataaccaggtgctggaggaaaatatggatgttgagatttggaccaaagagggagaacggaagaaactgagaccccgctggctcgacgctcggacatattccgaccctctggcccttagagagttcaaggaatttgctgccggccgccggtctgtgagcggggatctgatcctcgagatcggaaaactgccccagcacctgacccagagagcgcaaaacgccctcgacaatcttgtgatgctgcataactccgaacagggcgggcgggcttaccgccacgccatggaggagctgcctgatacaattgaaaccctcatgctgcttgctctgatcgccgtcctcacgggaggcgttacactgttctttctgtctggcagagggctcggaaagaccagcattggccttctgtgtgtgatggcctccagcgtgctgctctggatggcttctgtcgagccccattggatcgcggcctccattatcctggagttctttcttatggtgctgctcatcccggagcctgaccggcagcgcacaccccaagataatcaactggcttacgttgtgattgggctcctgttcatgatccttaccgtcgccgccaacgagatgggactgctggaaaccacaaagaaagacctcggcattgggcacgtggctgtcgagaatcaccatcacgccgcgatgctggatgtggaccttcatcctgccagcgcttggacgctgtatgccgttgctaccacaatcattacccccatgatgagacacacaatcgaaaacaccacggccaacatttctctcaccgcgatcgccaatcaggctgccatcctgatgggactggataagggctggcctatttccaaaatggacatcggcgtgcccctccttgctctggggtgctacagccaggtcaacccgctgacactcaccgccgctgtgctgatgcttgttgcccattatgcgattatcggacctggcctgcaagccaaggctacacgggaggcccagaaacgcaccgctgccgggattatgaagaatcccacggtggatggaatcgtcgccatcgacctcgatcccgtggtgtacgacgcgaagtttgaaaaacagctgggccagattatgctgctcatcctttgtacatctcaaattctgctgatgagaaccacatgggctctctgcgagagcatcaccctggccaccgggcctcttacaacgctgtgggagggatccccgggcaagttctggaacaccacaattgctgtttctatggccaatatctttcggggcagctatctcgccggggctggactggccttctccctgatgaaaagcctcggcgggggacgcagaggcaccggggcgcagggagaaacacttggcgagaagtggaaacggcagctgaaccagctgtccaagtctgagttcaatacctacaagagaagcggcatcatggaggtcgaccgctccgaagccaaagaggggctcaagcggggagagacgacaaaacacgctgtgtctagaggcaccgccaagctgcgctggtttgtggaacggaaccttgtcaaacccgaggggaaggttattgatctgggatgtggcagagggggatggagctattactgcgctggcctcaagaaagtgaccgaagtgaagggctacacaaaagggggacctggccacgaggaacccatccctatggccacctatgggtggaatctggtcaagctgcattccggaaaagacgtgttctttattccccctgagaagtgtgatacactcctttgcgacatcggcgagtctagcccgaaccccacgattgaagaggggcgcaccctgcgggttctgaaaatggtggaaccttggctcagaggaaatcaattctgtatcaagattctgaacccctacatgccttccgtcgtggagacacttgagcagatgcagcgcaagcacggcggcatgctggttcggaatcccctcagcagaaactctacccatgaaatgtattgggtgtcctgcgggacaggaaatatcgtcagcgcggtgaacatgacctctcgcatgctgctgaatcggtttacgatggcccacagaaaaccgacctacgagcgcgatgtggacctcggcgctgggacaagacacgtcgccgttgaacctgaggtgaccaacctggatatcattggacagcggatcgaaaacattaagcatgagcacaaatccacatggcattatgacgaggataatccctacaagacctgggcttatcacggcagctacgaagtgaaaccctctgggtccgccagctccatggtcaacggagtggttaaacttctgacaaagccttgggacgtgatccccatggtcacccaaattgctatgacggatacaacccctttcggccagcagcgcgtgtttaaagagaaggttgacaccagaacaccgaaagccaagcggggcacggcgcaaatcatggaagtgaccgccaaatggctctgggggttcctgagcagaaataagaagccccggatctgtacacgcgaggaatttaccagaaaagtccggtctaacgctgccattggagctgtgttcgttgacgagaatcagtggaacagcgccaaggaggccgtggaagatgagcgcttttgggaccttgtccatagagaacgggagctgcacaaacagggcaagtgcgcgacatgcgtgtacaatatgatggggaaacgcgaaaagaagctcggagagttcggcaaagctaaggggtccagagccatctggtatatgtggctgggcgcccggtttctggagttcgaagctctcggattcatgaacgaggatcactggttttctcgcgaaaatagcctgtccggcgtcgagggggagggacttcataaactgggctacattctcagagacatctctaagattcctgggggaaacatgtatgccgatgacaccgctggctgggatacacggatcaccgaagacgatctgcagaatgaggcccgcatcacggacattatggaacccgagcacgcgcttctggccaaaagcatcttcaagctcacctaccaaaacaaagtggttagagtgcagcggcctgctaagaatgggacagtcatggatgtgatttcccgcagagaccagcggggctctggacaggtgggcacctatgggctgaacacatttaccaatatggaagcccaactgatcagacagatggagagcgagggaattttctcccccagcgaactcgagacgccgaacctggctgaacgcgttcttgattggctggagaagtacggcgtggaacggctcaaaagaatggccatctctggggacgactgtgtcgtgaagcctatcgatgaccgctttgcgacagccctgaccgctcttaacgatatgggaaaagttcggaaggacattccccagtgggagccttccaaaggctggaatgattggcagcaagtgcccttctgcagccatcactttcaccagctgatcatgaaggacgggagagagattgtcgtgccttgtcgcaaccaggatgaactcgtcggccgggccagagtgtctcagggagctggctggtccctgcgcgagacagcctgcctgggaaagagctatgctcaaatgtggcagctcatgtacttccatcggagagacctgcgccttgccgcgaatgccatctgttccgctgttcccgtggattggattccgacctctcggacgacctggagcatccacgcccatcaccagtggatgacaaccgaagacatgctgtccgtctggaacagagtgtggattgaggaaaatccttggatggaggataaaacacatatcagctcttggggagacgttccctacctcggcaagcgggaggaccaatggtgcgggtccctgatcggacttaccgccagagctacatgggccaccaacattcaggtggcgatctatcaggtccgccggctgattggcaatgaaaactacctcgattatatgacgagcatgaaaagatttaagaatgagtctgaccccgaaggggctctgtggtga

SEQ ID NO: 19515 - RNA, 9879 nt, synthetic construct
  misc_feature 1..9879: note = derived and/or modified CDS sequence (opt5) from DENV-1__JN205310__SS-prME
  source 1..9879: mol_type = other RNA
agcgtgaccgtcctgttcatgctgctgcccaccgcccttgcttttcacctgacgaccctcggcggggaacctcatatgatcgtttccaagcaggaaagaggaaagtctctgcttttcaagacaagcgccggcgtgaatatgtgcaccctgattgcgatggacctcggggaactgtgtgaagatacaatgacctacaagtgcccgcggatcacagagaccgaacccgacgatgtggactgttggtgcaatgctacggagacctgggtcacatatggaacctgttcccaaacaggcgagcaccgcagagataagcggtctgtggccctggcccctcatgttgggctcggactggaaacccgcacggagacatggatgagctccgaaggcgcttggaagcagattcagaaggtggagacctgggcccttagacaccccggctttacagtcatcgctctgttcctcgcccatgcgattgggacctctatcacccagaagggaatcatttttatcctgcttatgctggtgacacctagcatggccatgcggtgcgttggcattgggaaccgcgacttcgtggagggaccctccggcgctacgtgggtcgatgtggtgctcgaacacgggagctgtgtcaccacaatggccaaaaataagcctaccctggacatcgagctgctcaaaacagaagttaccaacccggctattctgagaaaactttgcatcgaggccaaaatttctaatacgacaaccgattcccggtgtcccacccaaggagaagcgacactggtggaggagcaggacaccaactttgtgtgccgcagaacattcgtcgatcggggctggggcaatgggtgtggactctttggcaaggggagcctgatcacgtgcgccaagttcaaatgcgtgaccaaacttgaaggaaaaatcgttcagtacgagaacctgaagtattctgtgattgtcacagtgcacaccggcgaccagcatcaagttgggaatgaaacaaccgagcacggaacgaccgctatcattacacctcaggcccccacctccgaaatccagctcacagattacggcgctctgacccctgactgtagcccccgcacgggcctggactttaacgagatggtgctcctgacaatgaaagagaagtcttggcttgtccataaacagtggttcctggatctcccgctgccttggacctccggggccagcacatcccaagaaacctggaatagacaggaccttctggtgacctttaagacagcccacgctaagaaacaggaggtcgtggttctcggatctcaagaaggcgcgatgcacacggccctgaccggggctacagagattcagaccagcggaacaaccacgatcttcgccggccatctgaagtgccggctcaaaatggataagctgacacttaaaggggtgtcctatgtcatgtgtaccggcagcttcaagctggaaaaggaggtggccgagacccagcacggaacagttctcgtgcaggtcaaatacgaaggcaccgacgctccctgcaagatcccttcttccagccaagatgagaaaggggtgattcagaacggacgcctgatcacagccaatcccattgtgacggacaaggaaaaacccgttaacatcgaggcggagcctccgtttggcgaatcttatattgtcgtgggggctggagagaaggccctgaaacttagctggttcaaaaagggctcctctatcgggaaaatgtttgaagccaccgctagaggcgcccggagaatggctatcctcggagatacagcctgggacttcggcagcattgggggagtgtttacctccgtcggcaagctggtgcatcagatcttcgggacagcgtacggagttctgtttagcggcgtgtcttggaccatgaaaattgggatcggcattctcctgacgtggcttggactcaattcccgcagcacctctctctccatgacatgtatcgccgtcggcatggtgaccctgtacctgggggttatggtgcaggctgatagcggatgcgtcattaactggaagggccgggagcttaagtgtgggtccggaatcttcgtgacaaacgaagttcacacctggacagagcaatataaatttcaggccgactctcccaagagactcagcgctgccatcggcaaagcgtgggaggaaggggtgtgcggcattcgctccgccacccggctggagaatatcatgtggaagcagatttctaacgaactgaatcatatcctcctggagaacgatatgaaattcacggtcgtggtgggagacgtcagcggcattcttgctcaggggaagaaaatgatcagacctcaacccatggaacacaagtactcctggaaaagctggggaaaagccaagatcattggcgctgacgttcagaatacaacctttatcattgatgggcctaacacccccgagtgtccggacaatcagcgcgcctggaacatctgggaggtggaagattatggattcggcatttttacaaccaatatctggctgaaactccgggactctttcacgcaagtgtgcgatcacagactgatgtccgccgctatcaaggacagcaaagcggtccatgccgatatgggctactggattgagtctgaaaagaaggagacatggaaactggctcgcgcctccttcatcgaagtgaagacctgtatttggcctaaaagccacacactttggtctaacggggttctcgagagcgagatgatcattcccaagatctatggaggccctgtgtcccaacataattaccggcccgggtattttacccagacagccggaccttggcacctgggcaaactggaactcgacttcgatctgtgcgaggggaccacggtcgtggttgacgaaaactgcggaaatagaggccccagccttcgcaccacaaccgtgacaggcaagaccacgcacgagcggtgttgcagatcttgtacactgccgcctctccggtttaagcgcgaggatgggtgctggtacggaatggaaatcagacccgtcaaagagaaggaagagaacctggtgaaatccatggttagcgctggctccggggaagtggactctttcagcctgggacttctctgtatttccatcatgattgaggaggtcatgcggtctagatggagccgcaagatgctgatgaccggcacactggccgtgtttctcctgcttaccatggggcagtccacctggaatgatctgatccggctctgcacaatggtgggagcgaacgcttctgacatgatgggcatgggcacgacctacctggccctgatggccacattcagaatgcgccccatgtttgctgtcgggcttctgttcagacggctcaccagccgcgaaattctgctcctgacagttggactttccctggtggccagcgtggagctccctaactctctggaagaactgggcgacgggcttgcgatgggaatcatgatgctgaaactcctgaccgattttcaaccgcatcagctctgggctacgctgctttccctgacattcgtcaagaccaccctcagcctgcactatgcctggaagacaatggccatgattctgtctatcgtgtcccttctgcccctctgtctgagcaccacatctcagaaaacgacctggctccctgttctgcttggctccctggggtgcaagcccctgacaatgtttctcatcaccgaaaataaaatttggggaagacggagctggcctctgaacgagggcatcatggctattggcatcgtgtccattcttctgagctctcccctcaagaatgacgtccctctggccgggcccctcatcgctggaggcatgctgatcgcctgttacgtgattagcgggtcctctgcggatcttagcctggagaaagccgctgaagtttcctgggaggacgaagccgagcattctggagctagccacaacatcctggtggaagtccaggatgacggcacaatgaagattaaagatgaggagcgcgacgataccctcacgatcctgcttaaggccaccctgctcgtgatttccggggtctatccgatgtctatccctgccacactgttcgtgtggtacttttggcaaaagaaaaagcagagaagcggagttctctgggacaccccctcccctcccgaagtggagcgggctgtcctggataatggcatctatcgcattcttcagagaggcctgctggggcggagccaggtgggagttggcgtgttccaagaaggggtcttccatacaatgtggcacgtgacccgcggagcggtgctcatgtaccagggcaaaagactggagccgtcttgggcctccgttaagaaagaccttatcagctatgggggaggctggcggtttcagggctcttggaacacaggggaggaagtccaggtgattgctgtggagcctggaaagaatcccaagaacgtccaaacgacccctggcacattcaaaacccccgaaggggaggtgggagccatcgccctggattttaagcccggcacctccgggagcacaattgttaatagagaaggaaaaatcgtgggcctctacggcaacggggtcgtgacgacctccggaacatacgtttctgctattgcccaggcgaaggctagccaggagggccctctgccggagatcgaagacgaggtgttccgcaaacggaatctcaccatcatggacctgcaccccgggtccggaaagacaagacgctatcttcctgccattgtccgggaagccatcaagagaaaactgcgcaccctggtgctcgctcccacgcgggttgtggccagcgagatggcggaagctctgaagggcatgcctattagataccaaacaaccgccgtcaaatctgagcataccgggaaggagatcgtggatcttatgtgccacgccacatttaccatgcgcctgctctcccccgtgcgggtccctaactataatatgattatcatggacgaagctcatttcacagatccggccagcatcgctgccagaggctacatttctacccgggttggaatgggcgaggcggccgctatctttatgacggccacaccccctgggagcgtggaggctttcccccagtccaacgccgtgattcaggacgaagaacgcgatatccctgagagatcttggaatagcggatatgagtggattaccgactttcccggcaaaacagtctggttcgtgccgtccatcaagtctgggaacgatatcgccaactgtctgcggaagaatggaaaacgcgttgtgcagctgagcagaaagacctttgacacggaataccagaagaccaagaacaatgattgggactatgtcgtgacaaccgatatttccgagatgggcgctaacttccgggcggacagagttatcgaccctcgccggtgcctcaaacccgtgattcttaaggatgggcccgaaagagtcatcctggccggccctatgcccgtgacagtcgctagcgccgcccagcgccggggaagaattggccgcaatcctaacaaggagggggaccagtacgtgtacatgggacagccgctgaataacgatgaggaccacgctcattggaccgaagccaaaatgctcctggataatatcaacacacccgagggcattatccctgcgcttttcgaacccgagcgggaaaagtctgctgccatcgacggggagtatagactgcgcggagaggccagaaaaacctttgttgaactcatgcggcgcggcgatctgcctgtgtggctgtcctacaaggtggctagcgaggggttccaatattccgacagacggtggtgctttgatggcgaacgcaataaccaggtcctcgaggaaaatatggacgttgagatttggacgaaagagggagaaagaaagaaacttcggcccagatggctggatgcccgcacatactctgacccgctggcgctccgggagttcaaggaatttgccgctggcagacgcagcgtgtccggggatctgatccttgagattggaaagctgcctcagcacctcaccctgaaagcccagaacgctctggacaatctcgtgatgcttcacaactctgaacaaggcgggaaggcctatcggcatgctatggaggagctgcccgacaccatcgaaacactgatgctcctggcccttattgcggtcctgaccggaggcgtgacactcttctttctgagcggcagagggctgggaaaaacgtccatcggcctcctttgtgttatggccagctctgtgctgctgtggatggcttccgtcgagcctcactggatcgccgctagcattatcctcgagttctttctgatggtgcttctgattcccgagcctgatcggcagcgcacaccgcaggacaaccagctcgcctacgtcgtgatcgggctgctgttcatgattctcacagttgccgctaatgagatgggacttctggaaaccacaaagaaagatctgggcatcgggcatgcggccgctgagaaccaccaccatgccgccatgctcgacgtggatctgcacccggcttctgcctggaccctttatgcggtcgccacgaccatcattacacctatgatgagacataccatcgaaaatacaaccgctaacatttccctgacggccatcgctaatcacgccgcgattctcatgggactggacaagggctggcccatcagcaagatggatattggcgtgcccctgctcgcccttgggtgctactctcaagttaaccctctgacactgaccgctgccgtgctcatgctggtcgctcattacgccatcatcggaccgggccttcaggctaaagccacacgggaggcgcagaagcgcaccgccgctgggattatgaaaaatcccaccgtggacggaatcgtggccattgatctggaccctgttgtctatgatgctaagatcgaaaaacaactcggccagattatgctgctgatcctctgtacaagccagatccttctgatgagaacgacctgggccctgtgcgagtccattacactcgccaccgggcccctgacaaccctttgggagggatctcctggcaagttttggaacacgacaatcgcggtgagcatggctaatattttccggggctcctacctggccggggctggactcgcctttagcctgatgaagtccctgggcgggggacgcagaggcaccggggcccagggagaaaccctcggcgagaaatggaagcggcaacttaaccagctgtctaaaagcgagttcaatatctataagcgctccggcattatcgaggtggacagatctgaagctaaagaggggctgaagcggggagagacaaccaagcacgccgtcagcagaggcacagcgaaactccgctggttcgttgaacggaacctggtgaagcccgaggggaaagtgatcgatcttggatgtggcagagggggatggtcctactattgcgccggcctgaagaaagtcacggaagtgaagggctacaccaaagggggacctggccacgaggaaccgattcccatggctacatatgggtggaatctcgttaagctgcattctggaaaggacgtgtttttcacccctcccgagaaatgtgacacactgctctgcgatatcggcgagagctcccctaaccccaccattgaagaggggcgcacgcttcgggtcctgaagatggtggaaccgtggctgagaggaaatcagttttgtatcaaaattctcaacccttacatgcccagcgttgtggagaccctggagcagatgcaacgcaagcacggcggcatgcttgtccggaatcccctgtctagaaactccacacatgaaatgtactgggtgagctgcgggaccggaaacatcgtgtctgccgtcaatatgacatcccgcatgctcctgaaccggttcaccatggctcacagaaaacctacatatgagcgcgacgttgatctgggcgccgggacccggcacgtggcggtggaacccgaggtcgccaatctcgacattatcggacagagaatcgaaaacattaagaatgagcataagagcacgtggcactacgatgaggacaacccttataaaacatgggcttaccatggctcttatgaagtgaagccgtccgggagcgcctccagcatggttaatggagtggtccgcctgcttaccaaaccctgggatgtgatccctatggttacccagattgctatgacagacacgaccccctttggccagcaaagagtgttcaaggagaaagtcgatacacggacccctaaggccaagcgcggcacagctcagatcatggaagtgaccgccagatggctgtgggggtttctctctcggaacaaaaagcccagaatttgtacacgggaggagttcacccgcaaagttagaagcaatgcggccatcggagctgtgtttgtcgacgagaaccagtggaactccgccaaggaggctgtggaagatgagcggttctgggacctggtccaccgcgaaagagagcttcataaacaaggcaagtgcgccacgtgcgtgtacaacatgatggggcggcgcgaaaagaaactgggagagtttggcaaggccaaagggtctagagcgatctggtatatgtggctcggcgctcggttcctggagtttgaagccctgggattcatgaatgaggaccactggttcagccgcgaaaactccctctctggcgttgagggggagggacaccataagctgggctacattcttagagatatcagcaaaattcccgggggaaatatgtacgccgacgataccgctggctgggacacacggatcaccgaagatgacctgcagaacgaggccaagattacagatatcatggaacctgagcacgctctcctggccacctccatctttaaacttacgtatcagaacaaggtggtccgcgtgcagagacccgcgaagaatgggacagtgatggacgttatttctcggcgcgatcaaagaggcagcggacaggtgggcacctacgggctgaacacattcaccaatatggaagcccagctcatccggcagatggagtccgagggaatttttagcccttctgaactggagacgcccaacctggctgaaagagtcttcgactggctcgagaaacatggcatcgaacgcctgaagcggatggccatttccggggatgactgtgtggttaaacctatcgatgacagatttgctaccgcccttacagcgctgaatgacatgggaaaggtgcgcaaagatatcccccaatgggagccgcctaagggctggaacgactggcagcaggtccccttctgcagccaccactttcatcagctcattatgaaggatgggcgggagatcgtggtcccctgtagaaatcaagacgaactggtgggccgcgcccgggtttctcagggagctggctggtcccttagagagaccgcctgcctggggaaaagctatgctcagatgtggcagctcatgtacttccaccgccgggatctgagactggccgctaacgccatttgttccgcggtgcctgtcgactgggtgccgacatctcgcaccacatggagcatccatgcccaccatcaatggatgaccacggaagatatgctctccgtttggaatcgggtgtggattgaggaaaacccctggatggaggacaagacacacgtcagctcttgggaggatgtgccttatctgggaaaaagagaagaccagtggtgcggctcccttatcgggctgaccgctcgggccacctgggccacaaatattcaggtggctatcaaccaagttagacgcctcatcggaaatgagaactacctggattatatgaccagcatgaagcggtttaaaaatgaatctgaccccgagggcgccctttggtga

SEQ ID NO: 19516 - RNA, 9879 nt, synthetic construct
  misc_feature 1..9879: note = derived and/or modified CDS sequence (opt5) from DENV-1__HQ332182__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaaatctctgctttttaagacaagcgccggcgttaatatgtgcaccctgattgcgatggacctcggggaactgtgtgaagatacaatgacctacaaatgcccccgcatcacagaagctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagcgggttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccagggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggacgtcctatgtgatgtgtacaggcagcttcaaactggagaaggaagtcgccgagacccagcacggaaccgtgcttgttcaggtgaagtacgagggcacagatgcgccgtgcaaaattcctttctctacccaagacgaaaagggggtcacacagaacggacggctcatcacggctaatcccatcgtgaccgataaagagaagcctgtgaacattgaaacagagccgccctttggcgagtcctatatcgttgtcggggccggagaaaaagccctgaagctgagctggttcaagaaaggctctagcattgggaagatgtttgaggctaccgccagaggcgctcgccggatggccatcctcggagacacagcgtgggatttcggctccattgggggagtgtttacctctgtgggcaaactggtccatcaggtgttcgggacggcctacggagttctttttagcggcgtgtcctggaccatgaagatcgggatcggcattctgctcacatggctgggactgaatagcagatctacctcccttagcatgacatgtatcgctgtcggcatggtgaccctctacctgggggttatggtgcaggccgactctggatgcgtcattaactggaaaggccgcgaactgaagtgtgggtccggaatcttcgtgacaaacgaggttcacacctggacggaacaatataagtttcaggctgatagccctaaacggctctccgccgcgattggcaaggcctgggaggagggggtgtgcggcatcagatctgctacacgcctggaaaatattatgtggaaacagatcagcaacgagcttaatcatatcctgctcgaaaacgacatgaagttcaccgtcgtggtgggagacgccaatggcattctggctcaggggaaaaagatgatccggccgcaacccatggagcacaaatactcctggaagtcttggggaaaggccaaaattatcggcgccgatattcagaacaccacatttatcatcgacgggcctgatacccccgaatgtcctgacgatcagagagcttggaatatttgggaggtcgaggactatggattcggcatctttacgacaaacatttggctgaaacttcgcgatagctacacccagatgtgcgaccaccggctcatgtccgcggccatcaaagatagcaaggctgttcatgccgacatgggctattggattgaatctgagaaaaatgaaacatggaagctggccagagcttccttcatcgaggtgaagacctgtacatggcccaaaagccacaccctgtggtctaacggggtgctcgaatccgagatgatcattccgaagatctacggaggccctattagccaacataattatcgccccgggtacttcacgcagaccgccggaccttggcacctgggcaaacttgagctggattttgacctctgcgaagggacaaccgtcgtggttgatgagcactgcggaaaccggggcccctctctgagaacaaccacggtgacaggcaagatcattcatgaatggtgttgccggagctgtaccctgcctccccttcgcttcagaggggaggacggatgctggtacggcatggagatccggccggtcaaagaaaaggaggaaaatctcgtgagatccatggttagcgcggggtctggagaggtggactcctttagcctgggcatcctgtgtgtctccattatgatcgaagaggtgatgcgctctcggtggagcagaaagatgctcatgacagggaccctggctgttttccttctgctcattatgggacagctgacctggaacgatctgatccgcctttgcattatggtgggcgccaatgcctccgacagaatgggcatggggacaacgtatctggctctcatggccacctttaaaatgcggcctatgttcgcggtcggactgctctttcgcagactgacatctcgggaggtgcttctgctcaccatcggcctgagcctggtggcttccgtcgaacttcccaactctctggaggaactcggggatggactggccatgggcattatgatgctcaagctgcttacagagttccaaccccaccagctgtggaccacgctcctgagcctgacatttatcaaaaccaccctttccctggactacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaacaagatctggggccgcaaatcctggcctattaatgagggcatcatggctattgggatcgtgagcatccttctgtcttccctcctgaagaacgatgtccccctcgccggacctctgattgcgggcgggatgcttatcgcctgttatgtgattagcggatccagcgctgacctgtctctggagaaagccgctgaagttagctgggagcaggaagccgagcattccggcacctctcacaatatcctcgtggaagtccaagatgacgggacgatgagaattaaggatgaggagaaagacgataccctgacaatccttctgaaggccaccctcctggctgtgagcggagtttaccccatgtccatccctgcgacactctttgtgtggtatttctggcagaaaaagaagcagcggtctggcgtcctgtgggacacccccagcccgcctgaagtggagcgcgccgtccttgatgacggcatttacagaatcctgcagcgggggctgctcggacgctcccaagtgggcgttggggtgttccaggacggagtctttcatacaatgtggcacgtgacgagaggcgctgttctgatgtatcaggggaaacggcttgaaccctcttgggccagcgtgaagaaagatctgatttcctacggaggcggctggagattccaggggagctggaacaccggagaggaggtccaagtgatcgccgtggaacctggcaagaatcccaaaaacgttcagacaaccccggggacctttaagacacctgagggagaagtcggcgctattgccctcgacttcaagcccgggacgtctggatcccctatcgtgaatcgcgagggcaaaattgtgggcctgtacgggaacggagtcgtgaccacaagcggcacctatgtttctgcgatcgctcaggccaaggcctcccaagaagggcccctccccgagatcgaggatgaagtgtttaaaaagcggaatctgacaattatggaccttcaccctggaagcggcaaaaccagacgctacctgccggctatcgtccgggaggccattaagagaaagctgcgcacgctcatcctggcgcccacacgggtggttgcttccgaaatggccgaggcccttaaagggatgcctattagatatcagaccaccgctgtgaagtctgaacatacaggccgcgagatcgtcgatctgatgtgccacgccaccttcacaatgcggctcctgagccccgtgagagttcctaactacaatatgatcattatggacgaggctcattttaccgatcccgcctccatcgcggcccggggatatattagcacgcgcgtgggcatgggggaagctgccgctatcttcatgacagccacccctccgggatctgtcgaggcctttccccagtccaacgctgtgattcaggacgaagagagagatatccctgaacggagctggaactctggctacgactggatcacagatttccccgggaaaaccgtgtggtttgtccctagcattaagtccggaaacgacatcgcgaattgtctgcgcaaaaacggcaagagagttattcaactctctcggaagacgttcgacaccgagtatcagaaaacaaagaacaatgattgggactacgtggtgaccacagatatcagcgagatgggggccaacttcagagctgaccgcgtcattgatccccggagatgccttaaaccggtgatcctgaaggacggccctgaacgcgttattctggccggacccatgcccgtgaccgtcgcctccgctgcccagcggagaggccgcatcgggcggaatcagaacaaagagggagatcaatacgtgtatatgggccagcctctcaataacgacgaagatcacgcgcattggacagaggctaagatgctgcttgacaatatcaacacccccgaggggattatccctgccctgtttgaaccggagagagaaaagtctgccgctattgatggagagtaccgcctcagaggcgaagcccggaaaacgttcgttgagctgatgcgcagaggggacctgcccgtgtggctcagctataaggtcgcgtccgagggctttcagtacagcgatcggcgctggtgcttcgacggagaaagaaataaccaggtgcttgaggaaaatatggacgtcgagatctggacaaaagaaggcgagcggaagaaactgagacctcgctggctggatgcccggacctattctgaccccctcgctctgagagagtttaaggagttcgccgctgggcgccggtccgtgagcggagatcttattctggagatcggcaaactccctcaacacctgaccctgagagcccagaacgctctcgacaatcttgttatgctgcacaactccgaacaagggggaaaggcctaccggcatgcgatggaggaactgcccgatacaatcgagaccctcatgctgcttgccctgattgctgtgctcacaggcggcgtgacgctgtttttcctgtctgggaagggactcggcaaaaccagcatcgggcttctgtgtgtcacagcctcctctgttctgctctggatggctagcgtggagccgcactggattgccgcctccatcattctggaatttttccttatggtgctgctcatccctgagcccgaccgccagagaacccctcaagataatcagctggcttatgtcgtgatcggactgctctttatgattcttacagttgcggccaacgaaatgggcctgctggagaccacgaagcgggacctcgggatcggacatgtggctgccgagaaccaccagcacgccaccatgctggatgtcgaccttcgccccgctagcgcctggacactgtacgcggtggccaccacagtcattacccctatgatgagacatacgatcgaaaatacaaccgctaacatttctctcacagccatcgctaatcaagccgcgattctgatgggcctggataaaggctggcccatctccaagatggacatcggggtgccgctccttgccctgggatgctacagccaggttaaccctctgaccctcaccgctgccgtgctgatgcttgtcgctcactatgccattatcggccccgggctgcaggctaaagccacacgggaggcgcagaagcgcacggccgctggaattatgaagaatcccaccgtggatggcatcgttgccattgacctcgaccctgtggtctacgatgctaaattcgaaaagcaactggggcagatcatgctgctcatcctttgtgcctctcaggtgctgctgatgagaacaacctgggccctctgcgagtccattacactggcgaccggaccgcttacgacactgtgggaaggcagccccggcaaattttggaacaccaccatcgctgtgtctatggccaatattttccgggggagctatctcgctggagccggcctggccttctccctgatgaagtctctcgggggaggccgcagagggacaggagctcagggcgagacccttggcgagaaatggaagcggcaactgaaccagctgagcaagtccgaatttaatacatacaaaagaagcgggatcatggaggttgaccgctccgaagccaaggagggactcaaacggggcgaaacgaccaagcatgcggtctctagagggacagccaaactgcgctggttcgtggagcggaaccttgtgaagcctgagggaaaggtcattgatctgggctgtgggagaggaggctggagctattactgcgctggcctcaaaaaggttaccgaagtgaaagggtatacaaagggaggccccgggcacgaggaacctatccccatggccacctacggatggaatctggtgaaactgcattccggcaaggacgtctttttcatgcctccggagaaatgtgatacgctcctttgcgacatcggggaatctagccccaaccctaccattgaggagggacgcacactgcgggtgctgaagatggttgaaccctggctcagaggcaatcagttttgtatcaagattctgaacccttacatgccctccgtggtcgagacccttgaacagatgcaacgcaaacacggcgggatgctggtgcggaatccgctctctagaaacagcacacacgagatgtattgggtttcctgcggaaccggcaatatcgtgagcgctgtcaacatgacatctcgcatgctgctgaaccggttcaccatggcccatagaaagcctacgtacgagcgcgatgtggacctcggggcgggaacaagacacgtggccgtcgaacccgaggttgctaatctggatattatcggccagcggattgaaaacatcaaaaatgagcataagtccacctggcactatgacgaagataacccctacaaaacctgggcctatcacgggagctacgaggtgaagccttctggatccgctagctctatggtgaatggcgtcgtgcgccttctgacaaagccctgggacgttatccctatggtgacgcagattgccatgaccgacacaaccccgtttggccaacagagagtcttcaaagagaaggtggatacacggacccccagagctaaacgggggacaacccagatcatggaagttacggccaagtggctctggggatttctgtcccgcaacaaaaagcctagaatttgtacccgggaggagttcacacgcaaggtgagaagcaatgcggccgtcggcgctgtgtttgttgacgagaaccagtggaactccgccaaagaagctgtggaggatgagcggttctgggaccttgtccatcgcgaaagagagctgcacaagcaagggaaatgcgctacctgcgtgtataacatgatgggaaagcgggagaagaagctcggcgagtttgggaaggccaaaggcagccgcgcgatctggtacatgtggctgggagctagattcctggagttcgaggccctcggctttatgaatgaggatcattggttctctcgggaaaacagcctgtccggggtcgagggagaaggccttcacaagctggggtacattctccgcgacatctctaaaatccccggaggcaatatgtatgccgatgacacagctgggtgggataccagaattacggaggacgatctgcagaacgaggccaagatcacagacattatggaacctgagcatgcccttctggccaccagcatctttaaactcacataccagaataaggtggttcgggtgcagcgccccgcgaaaaacggcaccgtcatggatgtgatttccagacgggaccaaagaggatctggccaggtggggacgtatggactgaacaccttcacaaatatggaagttcagctgatccgccagatggagagcgaaggcatctttctcccgtccgagctggagacccctaaccttgccgaacgggtgctggactggctcgagaagcacggggctgaaagactgaagcgcatggccatttctggagatgactgtgtcgtgaaacccatcgatgaccggttcgctacagcccttaccgcgctgaatgatatgggcaaggttagaaaagacattcctcaatgggagcccagcaaggggtggaacgattggcaacaggtgcctttttgctcccaccatttccaccagctcatcatgaaagacggccgcgaaattgtcgtgccctgtcggaatcaagatgagctggtcggcagagctcgcgtgagccagggagctgggtggtctctgcgggagacagcctgcctcggaaagtcctacgctcagatgtggcaactgatgtattttcatagacgcgaccttcggctggccgctaacgccatctgtagcgcggttccggtggattgggtccctacctctagaacgacatggtccatccacgcccaccatcagtggatgaccaccgaagacatgctcagcgtgtggaatcgggtttggattgaggaaaacccctggatggaggacaagacacacgtgtcctcttgggaagaggtcccctacctgggcaaaagagaggatcagtggtgcgggagccttatcggactgaccgctcgcgccacatgggccacgaatattcaggtggctatcaaccaagtgcggagactcattggcaatgaaaactatctggactacatgacctccatgaagcgcttcaaaaatgagagcgatcctgaaggggccctgtggtga

SEQ ID NO: 19517 - RNA, 9879 nt, synthetic construct
  misc_feature 1..9879: note = derived and/or modified CDS sequence (opt5) from DENV-1__HQ332181__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgtccaggggaagaaaatgatcagaccgcaacccatggaacacaagtactcctggaaatcttggggaaaggctaagattatcggcgccgacattcagaacaccaccttcatcatcgatgggcctgacacacccgagtgtcctgatggacagcgcgcctggaatatttgggaggttgaagactatggctttggcgtgttcaccacgaacatctggctgaaactgcgggatagctacacacagatgtgcgaccacagacttatgtccgctgcgattaaggatagcaaagccgtgcatgctgacatggggtattggatcgagtctgaaaagaatgagacctggaaactcgcccgcgcctccttcattgaagtcaagacatgtacctggcccaagagccacacactgtggtctaacggagtgctggagtccgagatgatcatcccgaaaatttacggcgggcctatcagccaacataattatcggcccggatactttacccagacggctggcccttggcacctcgggaagctggaacttgatttcgacctgtgcgagggaaccacagttgtggtcgatgaacactgcggcaacagaggcccctctctccggaccacaaccgtgacggggaaaattatccatgagtggtgttgccgcagctgtacactgcctcccctgagatttcggggagaggacggctgctggtacgggatggaaattagaccggttaaggagaaagaagagaatcttgtgcgctccatggtcagcgccggaaccggcgaagtggattctttctccctcgggatcctgtgtgttagcatcatgattgaggaggtgatgcggtccagatggtctcgcaagatgctgatgacaggaaccctcgcggtctttctgcttctgatcatgggccagctcacctggaacgacctgattagactgtgcatcatggtgggcgctaatgccagcgaccggatggggatgggaacaacgtatcttgccctgatggctaccttcaagatgcgccctatgtttgccgtgggcctcctgttcagacggctcacatcccgcgaagtcctgcttctgaccattgggctctctctggttgcgagcgtggagctgcccaactcccttgaagagctgggagatggcctcgctatggggatcatgatgctgaaactcctgacagaatttcaaccccaccagctttggaccacgctgctctctctgacattcgtgaagaccgccctgagccttgactacgcctggaaaaccacagctatggtcctgtccattgtgagcctctttcctctgtgtctctctaccacatcccagaagacgacctggctgccggttcttctgggaagcttcggctgcaaacccctgacaatgtttctcatcaccgagaacaagatctggggcagaaagtcttggcctctgaatgaggggattatggccatcggaattgtgtccatccttctgagctctctcctgaaaaacgatgtccccctcgctggccctctgattgccgggggaatgcttatcgcgtgttatgtgatctccggcagctccgccgacctgagcctggaaaaggctgccgaggtttcttgggaacaggaggctgaacatagcggggcctcccacaatattctcgtggaggtccaagatgacggaacaatgaaaatcaaggatgaggaacgggacgataccctgacgattcttctgaaagccaccctcctggctgtgtctggcgtctaccccatgagcatccctgcgacactcttcgtgtggtatttctggcagaagaaaaagcagcgctccggcgttctgtgggacaccccctctccgcctgaggtggaaagagccgtccttgataacgggatttaccggatcctgcagcgcggactgctcggcagaagccaagtgggggttggagtgtttcaggacggcgtcttccatacaatgtggcacgtgacccggggggctgtgctgatgtatcagggaaagagacttgagccctcctgggcctctgttaaaaaggatctgatcagctacggcggcgggtggcgctttcagggatcctggaatacaggcgaggaagtccaagtgattgccgtggagcctgggaaaaaccccaagaatgtccagacgaccccgggaacattcaaaacccctgaaggcgaggtgggggctatcgccctcgactttaagcccggaaccagcggctctcctattgttaaccgggaaggcaagatcgtggggctgtacggaaatggcgtcgtgacaacgtccgggacctatgttagcgcgattgctcaggccaaagcctctcaagagggacccctccccgagatcgaagacgaggtgttcaagaaaagaaacctgacaattatggatcttcaccctggctccgggaagacccgccggtacctgccggctatcgtcagagaagccatcaaacgcaagctgcggacactcattctggcgcccaccagagtggttgctagcgagatggccgaagcccttaagggcatgcctatccgctatcagacgacagctgtgaaatccgagcataccggacgggagattgtcgacctgatgtgccacgccacctttacaatgagactcctgtctcccgtgcgggtgcctaattacaacatgatcattatggatgaagctcatttcaccgaccccgccagcatcgcggcccgcggctatatctccacaagagtcgggatgggagaggctgccgctatttttatgaccgccacgcctccgggcagcgttgaagccttcccccagtctaatgctgtgatccaggatgaggaacgggacattcctgagcgctcctggaacagcgggtacgattggatcacagactttcccggaaagaccgtgtggttcgtcccttctattaaaagcggcaatgatatcgcgaactgtctgagaaagaacgggaaacgggtgatccaactctccagaaagacattcgacaccgagtatcagaagacgaaaaataacgattgggactacgttgtgaccacagacatttctgaaatgggcgccaattttcgcgctgatcgggtcatcgaccccagacgctgccttaagccggtgattctgaaagatggacctgagcgggttatcctggccggccccatgcccgtgaccgtcgccagcgctgcccagagacgcgggcggattggaagaaaccagaataaggaaggcgaccaatacgtgtatatggggcagcctctcaacaatgatgaggaccacgcgcattggacagaggctaaaatgctgcttgataacatcaatacccccgaaggaattatccctgccctgttcgagccggaacgcgagaagtccgccgctatcgacggcgaatacagactccggggggaggcccgcaagacatttgtcgagctgatgagacggggcgatctgcccgtgtggctctcttataaagttgcgagcgaaggattccagtactccgaccgcagatggtgctttgatggcgagcggaacaatcaggtgcttgaagagaacatggacgtggaaatttggaccaaggagggggagagaaaaaagctgcgccctcggtggctggatgccagaacgtatagcgaccccctcgctctgcgcgaattcaaagagtttgccgctggacggagatctgtctccggcgaccttatcctggaaattgggaagctccctcaacacctgacactgcgggcccagaatgctctcgataaccttgttatgctgcacaatagcgagcagggaggcaaagcctaccgccatgcgatggaagagctgcccgacaccatcgagaccctcatgctgcttgccctgattgctgtgctcacaggcggggtgaccctgttctttctgtccggaaagggcctcgggaagacatctatcggacttctgtgtgtcacggccagctccgctctgctctggatggcctctgtggaaccgcactggatcgccgctagcattatcctggagttctttcttatggttctgctcattcctgaacccgatagacagcggacccctcaagacaaccagctggcgtatgtggtcatcggcctgctcttcatgattcttacagtggccgctaacgagatggggctgctggagaccacaaaaaaggatctcggaatcggctacgtcgccgccgaaaatcatcagcacgctaccatgctggacgtggatcttcaccccgcctccgcgtggacgctgtacgccgttgctaccacagtgatcacccctatgatgcgccatacaattgagaacaccacggccaatatcagcctcacagctattgccaaccaagcggccatcctgatgggcctggacaaagggtggcccatttctaagatggatatcggagtcccgctccttgctctgggctgctattcccaggtgaatcctctgaccctcacagccgctgttctgatgcttgtggcccactacgctattatcgggcccggactgcaggccaaagcgaccagagaagcccagaagcggaccgctgccggcatcatgaagaaccccacagtcgacgggattgtggctatcgatctcgaccctgtggtttatgatgccaaatttgagaagcaactgggacagattatgctgctcatcctttgtacgagccagattctgctgatgcgcaccacatgggccctctgcgaatctatcaccctggcgacaggcccgcttaccacgctgtgggagggctcccccgggaaattctggaatacaaccatcgctgtcagcatggccaacattttcagaggatcttacctcgctggcgccgggctggcctttagcctgatgaagtccctcggaggcgggcggcgcggaaccggcgctcagggcgagacacttggggaaaaatggaagagacaactgaatcagctgtctaagagcgagttcaacacctataaacggtccggaatcatggaagtggacagaagcgaggccaaggaaggcctcaaacgcggggagacaacgaagcatgcggtgtcccggggaaccgccaaactgagatggtttgtcgagcgcaatcttgttaagcctgaaggcaaggtgattgacctggggtgtggacggggcggctggtcttactattgcgctgggctcaaaaaggtgacagaggtcaaaggatacaccaagggcgggcccggacacgaagagcctatccccatggccacatacggctggaacctggtgaaactgcatagcgggaaggatgttttctttatgcctccggaaaaatgtgacaccctcctttgcgatattggagagtcctctcccaatcctacgatcgaggaaggcagaaccctgcgcgtgctgaagatggtcgagccctggctccggggcaaccagttctgtatcaagattctgaatccttatatgcccagcgtggttgaaacacttgagcagatgcaaagaaaacacgggggaatgctggtgcgcaacccgctctcccggaattctacccacgagatgtactgggtcagctgcggcacagggaacatcgtgtccgctgtgaacatgaccagcagaatgctgctgaatcgctttacaatggcccatcggaagcctacctatgaaagagacgtcgatctcggagcgggcacgcgccacgttgccgtggagcccgaagtggctaacctggacattatcgggcagagaattgagaatatcaaaaacgaacataagtctacatggcactacgatgaggacaatccctataaaacctgggcctaccacggatcctatgaggtcaagcctagcggctctgcttccagcatggtgaacggcgttgtgcggcttctgaccaagccctgggatgtcattcctatggtgacacagatcgccatgacggacaccacaccgttcgggcaacagcgcgtttttaaagaaaaggtggataccagaacaccccgggctaaaagaggaaccacacagatcatggaggtcaccgccaagtggctctggggcttcctgtctcggaataaaaagcctcgcatttgtacgagagaagagtttacccggaaggtgcgctccaacgcggccatcggggctgttttcgtggacgaaaatcagtggaacagcgccaaagaggctgtcgaggacgaaagattttgggatcttgtgcatcgggagcgcgaactgcacaagcaaggaaaatgcgccacatgcgtctacaatatgatgggcaagagagagaaaaagctcggggaattcggcaaggccaaaggatcccgggcgatttggtacatgtggctgggcgctcgcttcctggagtttgaggccctcgggttcatgaacgaagaccattggtttagcagagagaattctctgagcggagtggaaggcgaggggcttcacaagctgggatatatcctccgggatatttccaaaatccccggcgggaacatgtacgccgacgataccgctggctgggacacacgcatcaccgaggatgacctgcagaatgaagccaagattacggatatcatggagcctgaacatgctcttctggccacatctattttcaaactcacctatcagaacaaggttgtgagagtccagcggcccgcgaaaaacggaacagtgatggacgtgatcagccgcagagatcaacggggctccgggcaggttggaacctacggcctgaatacgtttaccaacatggaggtgcagctgattagacagatggaatctgaggggatcttcctcccgagcgagctggaaacacctaatcttgccgagcgcgctctggactggctcgaaaagcacggagccgagcggctgaagagaatggctatctccggcgatgactgtgtcgtgaaacccattgacgatcgctttgccaccgcgcttacagccctgaacgacatggggaaggttcggaaagatatccctcaatgggaaccctctaagggctggaatgactggcagcaggtgcctttctgcagccaccattttcaccagctcattatgaaagatggaagagagatcgtcgtgccctgtcgcaaccaagacgagctggtcggccgggctagagtgtcccagggggccggatggagcctgcgcgaaaccgcttgcctcggcaagtcttatgcccagatgtggcaactgatgtacttccatcggagagatcttcgcctggctgccaatgcgatttgttccgccgttccggtggactgggtccctacaagccggaccacgtggtctatccacgctcaccatcagtggatgacaaccgaggatatgctctccgtgtggaacagagtttggatcgaagagaatccctggatggaagacaagacccacgtgagctcctgggaggaggtcccctatctggggaaacgggaagatcagtggtgcggatctcttattggcctgacagccagagccacctgggctacaaacatccaggtggccattaatcaagtgcgccggctcatcgggaacgagaattacctggactacatgacgagcatgaagagatttaaaaacgaatccgacagcgagggcgcgctgtggtga

SEQ ID NO: 19518 - RNA, 9879 nt, synthetic construct
  misc_feature 1..9879: note = derived and/or modified CDS sequence (opt5) from DENV-1__HQ332180__SS-prME
  source 1..9879: mol_type = other RNA
agcgtgaccatgctgctcatgctgcttcccacagccctggctttccacctcacgaccagaggcggggagcctcatatgatcatttccaagcaggaacggggaaaatctctgctttttaagacaagcgccggcgtcaacatgtgcaccctgatcgcgatggacctcggggagctgtgtgaagatacaatgacctacaaatgcccgcgcattacagaggctgaacccgacgatgttgactgttggtgcaatgccaccgatacgtgggtgacctatggaacatgttcccaaaccggcgagcacagacgggacaagcgctctgtggccctggctcctcatgtcgggctcggactggagacaagaaccgaaacgtggatgagctccgagggcgcctggaaacagatccagcgggtggaaacatgggctcttcgccaccccggcttcaccgttattgccctgtttctcgcgcatgccatcgggacatctatcacccagaagggaattatcttcattctgcttatgctggtgacccctagcatggctatgagatgcgtcggcatcgggaaccgggattttgtggagggactctccggcgccacatgggttgacgtggtcctggagcacgggagctgtgtgacgaccatggctaagaataaacccacactggatattgaactcctgaagaccgaggtgacaaaccctgccgtccttcgcaaactgtgcatcgaagcgaagatttctaataccacgacagactccagatgtccgacccaaggagaggccaccctcgttgaagagcaggatgctaacttcgtgtgccggcgcacatttgtggacagaggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcagcatcaagtggggaatgagacaaccgaacacggaacaattgctaccatcacgccccaggcccctacctccgagattcagctgacagactacggcgccctcaccctggactgtagcccccggacaggccttgatttcaacgaaatggttctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggtcgtgctcggatctcaagagggcgctatgcacaccgccctgacaggggccacggaaatccagaccagcggaacaaccacaatttttgctggccatcttaaatgcagactgaagatggacaaactcaccctgaaggggatgtcctatgttatgtgtacgggcagcttcaaactggagaaggaagtggccgagacacagcacggaaccgtccttgtgcaggttaagtacgagggcaccgatgcgccgtgcaaaatccctttctctacacaagacgaaaagggggtgacccagaacggacggctcatcacagctaatcccattgtcacggataaagagaagcctgtgaacatcgaaaccgagcccccctttggcgagtcctatattgtggttggggccggagaaaaagccctgaagctgagctggttcaagaaaggctctagcatcgggaagatgtttgaggctacagccagaggcgctcgccggatggccattctcggagacaccgcgtgggatttcggctccatcgggggagtctttacatctgtgggcaaactggtgcatcaggtcttcgggaccgcctacggagtgctttttagcggcgtttcctggacgatgaagatcgggattggcatcctgctcacctggctgggactgaatagcagatctacatcccttagcatgacctgtattgctgtgggcatggtcacactctacctgggggccatggtgcaggctgactctggatgcgttatcaactggaaaggccgcgaactgaagtgtgggtccggaattttcgtgaccaacgaggtccacacatggaccgaacaatataagtttcaggccgatagccctaaacggctctccgcggccatcggcaaggcttgggaggagggggtgtgcggcattagatctgccacgcgcctggaaaatatcatgtggaaacagatcagcaacgagcttaatcatattctgctcgaaaacgacatgaagttcacagttgtggtcggagacgctaatggcatcctggcccaggggaaaaagatgattcggccgcaacccatggagcacaaatactcctggaagtcttggggaaaggccaaaatcattggcgctgatatccagaacaccacctttatcattgacgggcctgatacacccgaatgtcctgacggacagagagcgtggaatatctgggaggtggaggattatggcttcggcatttttaccacgaacatctggctgaagcttcgcgacagctacacacagatgtgcgatcaccggctcatgtccgccgctattaaagacagcaaggccgtgcatgccgatatggggtattggatcgaatctgagaaaaatgaaacctggaagctggctagagcctccttcatcgaggtcaagacatgtacctggcccaaaagccacacactgtggtctaacggagttctcgaatccgagatgattatcccgaagatttacggcgggcctatcagccaacataattatcgccccggatacttcacccagacggcgggcccttggcacctggggaaacttgagctggactttgatctctgcgaaggaaccacagtggtggtcgacgagcactgcggcaaccggggcccctctctgagaaccacaaccgtgacggggaagattatccatgaatggtgttgccggagctgtacactgcctccccttcgcttcagaggagaggatggctgctggtacgggatggagatccggccggttaaagaaaaggaggaaaatctcgtgagatccatggtcagcgctggatctggcgaggtggactcctttagcctggggattctgtgtgtttccatcatgattgaagaggtgatgcgctctcggtggagcagaaagatgctcatgaccggaacactggccgtcttccttctgctcatcatgggccagctgacctggaacgacctgattcgcctttgcatcatggtgggcgccaatgcttccgatagaatggggatgggaaccacacacctggccctcatggcgacgtttaaaatgcggcctatgttcgctgttggcctgctctttcgcagactgacctctcgggaggtgcttctgctcacaattgggctgagcctgatggcctccatggaacttcccaactctctggaggaactcggagacggcctggccatggggatcatgatgctcaagctgcttaccgagttccaaccccatcagctgtggacaaccctcctgagcctgacgtttgtcaaaacaaccctttccctggattatgcttggaagaccacagccatgatcctcagcattgtgtctctgttccctctctgtctgtccaccacaagccagaaaacgacctggcttccggtgctgctgggatcttttggctgcaagcccctcacaatgttcctgatcaccgaaaacaagatttggggccgcaaatcctggcctcttaatgaggggatcatggctattggaatcgtcagcatcctgctctcttccctgctcaagaacgacgttcccctggccggccctcttattgcggggggaatgctgatcgcctgttacgtgattagcggctccagcgctgatctgtctctcgagaaagccgctgaagtgagctgggagcaggaagccgagcactccggggcctctcataatatcctggtcgaagtgcaagacgatggaacaatgaagattaaagacgaggagagagatgacacccttacgatcctgctcaaggctaccctgctcgcggttagcggcgtgtatcccatgtccatccctgccacactgtttgtctggtacttctggcagaaaaagaagcagcggtctggcgtgctttgggatacccccagcccgcctgaagttgagcgcgctgtgctggacgatgggatttatagaatcctgcagcggggactcctgggccgctcccaagtcggggtgggagtcttccaggacggcgtgtttcacacaatgtggcacgttaccagaggggccgtgcttatgtaccagggaaaacggctggaaccctcttgggccagcgtcaagaaagacctcatttcctatggcggcgggtggagattccagggaagctggaacacaggcgaggaggtgcaagttatcgctgtggaacctgggaagaatcccaaaaacgtccagacgaccccgggaacatttaagacccctgagggcgaagtgggggccattgcgctggatttcaagcccggaacctctggctcccctatcgtgaatcgcgagggcaaaattgttgggctctacggaaacggcgtcgtgacaacgagcgggacctacgtgtctgctatcgcccaggccaaggcttcccaagaaggacccctgcccgagatcgaggacgaagtctttaaaaagcggaatcttacaattatggatctgcatcctggcagcgggaaaaccagacgctatctgccggccatcgtgcgggaggcgattaagagaaagctccgcacactgatccttgctcccacccgggttgtggcctccgaaatggccgaggctctgaaaggcatgcctattagataccagacgacagccgtcaagtctgaacacaccggacgcgagatcgtggacctcatgtgccatgctaccttcacaatgcggctgctgagccccgttagagtgcctaactataatatgatcattatggatgaggcccactttaccgaccccgcgtccatcgccgctcggggctacattagcacacgcgtcgggatgggagaagccgctgccatcttcatgaccgccacgcctccgggctctgtggaggcttttccccagtccaacgcggttattcaggatgaagagagagacatccctgaacggagctggaattctgggtatgattggatcacagacttccccggaaaaaccgtgtggtttgtccctagcattaagtccggcaacgatatcgccaattgtctccgcaaaaacgggaagagagtgattcaactttctcggaagacattcgacaccgagtaccagaaaacgaagaacaatgactgggattatgtggtcaccacagacatcagcgagatgggcgctaacttcagagccgatcgcgttattgacccccggagatgcctgaaaccggtgatcctgaaggatggacctgaacgcgtgattctcgccggccccatgcccgtcaccgtggcttccgccgcgcagcggagagggcgcatcggacggaatcagaacaaagagggcgaccaatacgtttacatggggcagcctctgaataacgatgaagaccatgctcactggacagaggccaagatgcttctggataatatcaacacccccgagggaattatccctgccctctttgaaccggagagagaaaagtctgctgccattgacggcgagtatcgcctgagaggggaagcgcggaaaacattcgtggagctgatgcgcagaggcgatctccccgtctggcttagctacaaggtggcctccgagggatttcagtatagcgaccggcgctggtgcttcgatggcgaaagaaataaccaggttctggaggaaaatatggacgtggagatctggaccaaagaaggggagcggaagaaactgagacctcgctggctcgacgctcggacgtactctgatcccctggcccttagagagtttaaggaattcgctgccggacgccggtccgtcagcggcgacctgattctcgagatcgggaaactgcctcaacacctgacactcagagctcagaacgcccttgataatctggtgatgctgcataactccgaacagggaggcaaggcgtatcggcacgccatggaggaactccccgacaccatcgagaccctgatgcttctggctctcattgccgtcctgacaggcggggtgaccctgtttttcctctctggaaagggccttgggaaaacaagcatcggactgctgtgtgttacggcttcctctgccctcctgtggatggccagcgtggagccgcattggattgctgcgtccatcattcttgaatttttcctgatggtgctcctgatccctgagcccgatcgccagagaacccctcaagacaatcagctggcctacgtcgttatcggcctcctttttatgattctgacagtggctgccaacgaaatggggctgctcgagaccacaaagaaagatctgggaatcggctatgtggccgctgagaaccaccagcacgccaccatgcttgacgtcgatctgcggcccgcgagcgcctggacgctctacgctgtggccaccacagttattacccctatgatgcgccatacaatcgaaaataccacggctaacatttctctgacagccatcgcgaatcaagccgctattctgatgggcctcgacaaggggtggcccatctccaaaatggatatcggagtgccgcttctggccctgggctgctacagccaggtcaaccctctcaccctgacagctgccgtgcttatgctggtcgctcactatgccattatcgggcccggactccaggcgaaggccaccagagaggctcagaagcggaccgccgctggcattatgaaaaatcccacagtggacgggatcgttgccattgatctggaccctgtggtctacgacgccaagttcgaaaaacaactgggacagatcatgctccttatcctgtgtacgtctcagattctgctcatgcgcaccacatgggcgctgtgcgagtccatcacccttgctacaggcccgctgaccacgctctgggaaggcagccccgggaagttttggaacacaaccattgccgtgtctatggctaatatcttcagaggaagctatctggccggcgccgggctggctttctccctcatgaaatctcttggaggcgggcggcgcggaaccggcgcccagggcgagacactgggggagaagtggaagagacaactgaaccagctcagcaaatccgaatttaatacctacaagcggagcggaattatggaggttgatagatccgaagcgaaagagggcctgaagcgcggggaaacaacgaaacatgccgtgtctcggggaaccgctaagcttagatggttcgtcgagcgcaacctggtgaagcctgagggcaaagtgatcgacctcgggtgtggacggggcggctggagctattactgcgccgggctgaagaaagttacagaagtcaagggatataccaaaggcgggcccggacacgaggaacctatccccatggctacatacggctggaatctggtgaagctccattccgggaaagatgtgtttttcatgcctccggagaagtgtgacacccttctgtgcgatattggagaatctagccccaaccctacgatcgaggagggcagaaccctgcgcgtcctcaagatggttgaaccctggctgaaaggcaatcagttttgtattaagatccttaacccttacatgccctccgtggtggagacactggaacagatgcaacggaaacacgggggaatgctcgtcagaaatccgctgtctcgcaacagcacccacgagatgtattgggtgtcctgcggcacagggaatattgttagcgccgtgaacatgacctctcggatgctgctcaacagattcacaatggcgcatcgcaagcctacctacgagcgggacgtcgatctgggagccggcacgagacacgtggctgttgaacccgaggtggccaatcttgacatcattgggcagcgcatcgaaaacatcaaaaatgagcataagtccacatggcactatgatgaagacaacccctacaagacctgggcttatcacggaagctacgaggtcaaaccttctggctccgccagctctatggtgaatggcgtggtcagactgctcaccaagccctgggatgttattcctatggtgacacagatcgctatgacggacaccacaccgtttgggcaacagcgggtgttcaaagagaaggtcgacacccgcacacccagagccaaacggggaaccacacagattatggaagtgaccgcgaagtggctgtggggctttctttccagaaacaagaaacctcggatctgtacgcgcgaggaattcaccagaaaggttcggagcaatgccgctattggggccgtgtttgtcgatgagaaccagtggaattccgctaaagaagccgtggaggacgagcgcttctgggatctggttcatagagaacgggagctccacaagcaaggaaaatgcgccacatgcgtgtataacatgatgggcaagcgcgaaaagaaactgggggagtttggcaaggcgaaaggaagcagagctatctggtacatgtggctgggcgcccggttcctcgaattcgaggccctggggtttatgaatgaggaccattggttctctcgcgaaaacagcctttccggagtcgagggcgaagggctgcacaagctcggatacatcctgagagatatttctaaaatccccggcgggaatatgtatgctgacgataccgccggctgggacacacggattaccgaggatgaccttcagaacgaggctaagatcacggatattatggaacctgagcatgccctgctcgcgacaagcatctttaaactgacctaccagaataaggtggttcgcgtgcagagacccgccaagaacggaacagtcatggacgtgatctcccggcgcgatcaaagaggctctgggcaggtcggaacctatggcctgaacacgttcaccaatatggaagtgcagctcattcggcagatggagagcgaagggatctttctgccgtccgagcttgagacacctaacctggctgaaagagttctcgactggctggagaaacacggagccgaacgccttaagcggatggctatttctggcgacgattgtgtggtcaaacccatcgacgatagattcgccaccgcgctgacagccctcaatgacatggggaaggtgcgcaaagatattcctcaatgggagcccagcaagggctggaacgactggcagcaggtgcctttttgctcccaccatttccaccagctgatcatgaaggatggacgggaaatcgttgtgccctgtagaaatcaagacgagctggtcggccgcgctcgggtgagccagggggccggatggtctctcagagagaccgcttgcctgggcaaatcctacgcccagatgtggcaacttatgtattttcatcgccgggatctgagactcgctgccaacgcgatttgtagcgccgttccggtggactgggtccctacatctcgcaccacgtggtccatccacgctcaccatcagtggatgacaaccgaagatatgctgagcgtgtggaatcgggtctggattgaggaaaacccctggatggaggacaagacccacgtgtcctcttgggaagaggttccctaccttgggaaaagagaggaccagtggtgcggaagcctgatcggcctcacagcccgggccacctgggctacaaatattcaggtggccatcaaccaagtcagacgcctgattgggaatgaaaactatctggattacatgacgtccatgaagcggttcaaaaatgagagcgaccctgaaggcgcgctctggtga

SEQ ID NO: 19519 - RNA, 9879 nt, synthetic construct
  misc_feature 1..9879: note = derived and/or modified CDS sequence (opt5) from DENV-1__HQ332179__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgcttccattatgatcgaagaggtcatgcgctctcggtggagcagaaagatgctcatgaccggaacactggccgtgttccttctgctcattatgggccagctgacctggaacgacctgatccgcctttgcattatggttggcgccaatgcttccgatagaatggggatgggaaccacatatctggccctcatggcgacgtttaaaatgcggcctatgttcgctgtgggcctgctctttcgcagactgacctctcgggaggtccttctgctcacaatcgggctgagcctggtggcctccgtggaacttcccaactctctggaggaactcggagacggcctggccatggggattatgatgctcaagctgcttaccgagttccaaccccaccagctgtggacaaccctcctgagcctgacgtttgtcaaaacaaccctttccctggattacgcttggaagaccacagccatggttctcagcatcgtgtctctgttccctctctgtctgtccaccacaagccagaaaacgacctggcttccggtgctgctgggatcttttggctgcaagcccctcacaatgttcctgatcaccgaaaacaagatttggggccgcaaatcctggcctcttaatgaggggatcatggctattggaatcgtcagcattctgctctcttccctgctcaagaacgacgtgcccctggccggccctcttatcgcggggggaatgctgatcgcctgttatgttattagcggctccagcgctgatctgctcctggagaaagccgctgaagtgtcttgggagcaggaagccgagcatagcggggcctcccacaatatccttgtcgaagtgcaagacgatggaacaatgaagattaaagacgaggagagagatgacaccctgacgatcctcctgaaggctaccctcctggcggtttctggcgtgtaccccatgagcattcctgccacactttttgtctggtatttctggcagaaaaagaagcagcggtccggcgtgctgtgggataccccctctccgcctgaagtcgagcgcgctgtgctggacgatgggatctacagaatcctccagcggggactgcttggccgcagccaagttggggtgggagtcttccaggacggcgtgtttcatacaatgtggcacgttaccagaggggccgtgctgatgtatcagggaaaacggctcgaaccctcctgggcctctgtcaagaaagacctgattagctacggcggcgggtggagattccagggatcctggaacacaggcgaggaggtgcaagtgatcgctgttgaacctgggaagaatcccaaaaacgtccagacgaccccgggaacatttaagacccctgagggcgaagtgggggccattgcgctcgatttcaagcccggaaccagcggctctcctatcgtgaatcgcgagggcaaaattgtcgggctgtacggaaacggcgtggttacaacgtccgggacctatgtgagcgctatcgcccaggccaaggcttctcaagaaggaccccttcccgagattgaggacgaagtctttaaaaagcggaatctgacaatcatggatctgcaccctggctccgggaaaaccagacgctacctcccggccatcgtgcgggaggcgattaagagaaagctgcgcacacttatcctggctcccacccgggttgtggccagcgaaatggccgaggctctcaaaggcatgcctattagatatcagacgacagccgtcaagtccgaacataccggacgcgagatcgtggacctgatgtgccacgctaccttcacaatgcggctgctctctcccgttagagtgcctaactacaatatgattatcatggatgaggcccattttaccgaccccgcgagcatcgccgctcggggctatatttccacacgcgtcgggatgggagaagccgctgccatcttcatgaccgccacgcctccgggcagcgtggaggcttttccccagtctaacgcggtgattcaggatgaagagagagacatccctgaacggtcctggaatagcgggtacgattggattacagacttccccggaaaaaccgtctggtttgttccttctatcaagagcggcaacgatatcgccaattgtcttcgcaaaaacgggaagagagtgattcaactgtcccggaagacattcgacaccgagtatcagaaaacgaagaacaatgactgggattacgtggtcaccacagacatctctgagatgggcgctaacttcagagccgatcgcgtgattgacccccggagatgcctgaaaccggttatcctcaaggatggacctgaacgcgtgattctggccggccccatgcccgtcaccgtggctagcgccgcgcagcggagagggcgcatcggacggaatcagaacaaagagggcgaccaatacgtttatatggggcagcctcttaataacgatgaagaccacgctcattggacagaggccaagatgctgctcgataatattaacacccccgagggaatcatccctgccctgtttgaaccggagagagaaaagtccgctgccattgacggcgagtaccgcctgagaggggaagcgcggaaaacattcgtggagctcatgcgcagaggcgatcttcccgtctggctgtcttataaggtggccagcgagggatttcagtactccgaccggcgctggtgcttcgatggcgaaagaaataaccaggtcctggaggaaaatatggacgtggagatctggaccaaagaaggggagcggaagaaactcagacctcgctggctggacgctcggacgtatagcgatccccttgccctgagagagtttaaggaattcgctgccggacgccggtctgtttccggcgacctcattctggagatcgggaaactgcctcaacacctcacacttagagctcagaacgccctggataatctggtgatgctccacaacagcgaacagggaggcaaggcgtaccggcatgccatggaggaactgcccgacaccattgagacccttatgctgctcgctctgatcgccgtgctgacaggcggggtcaccctctttttcctttccggaaagggcctggggaaaacatctatcggactgctctgtgttacggctagctccgccctgctttggatggcctgcgtggagccgcactggattgctgcgtctatcattctggaatttttcctcatggtgctgctgatccctgagcccgatcgccagagaacccctcaagacaatcagctcgcctatgtcgtgattggccttctgtttatgatcctgacagttgctgccaacgaaatggggctcctggagaccacaaagaaagatcttggaatcggctacgtggccgctgagaaccatcagcacgccaccatgctggacgtcgatctccggcccgcgagcgcctggacgctgtacgctgtggccaccacagtcattacccctatgatgcgccacacaatcgaaaataccacggctaacatttccctgacagccatcgcgaatcaagccgctattctcatgggccttgacaaggggtggcccatcagcaaaatggatattggagtgccgctgctggccctcggctgttattctcaggttaaccctctgacccttacagctgccgtgctgatgctcgtcgctcattacgccatcatcgggcccggactgcaggcgaaggccaccagagaggctcagaagcggaccgccgctggcattatgaaaaatcccacagtggacgggatcgttgccattgatctggaccctgtggtctatgacgccaagttcgaaaaacaactcggacagatcatgcttctgattctgtgcacgtcccagatcctcctgatgcgcaccacatgggcgctttgtgagagcatcaccctggctacaggcccgctcaccacgctgtgggaaggctctcccgggaagttttggaacacaaccattgccgtgtccatggctaatatcttcagaggaagctacctggccggcgccgggctcgctttctctcttatgaaaagcctgggaggcgggcggcgcggaaccggcgcccagggcgagacactgggggagaagtggaagagacaactcaaccagctgtccaaatctgaatttaatacctataagcggagcggaattatggaggtggatagatccgaagcgaaagagggccttaagcgcggggaaacaacgaaacacgccgttagccggggaaccgctaagctgagatggttcgtcgagcgcaacctcgtgaagcctgagggcaaagtgatcgacctggggtgcggacggggcggctggtcctactattgtgccgggctgaagaaagtcacagaagttaagggatacaccaaaggcgggcccggacatgaggaacctattcccatggctacatacggctggaatctcgtgaagcttcactctgggaaagatgtgtttttcatgcctccggagaagtgcgacaccctgctgtgtgatatcggagaaagctcccccaaccctacgatcgaggagggcagaaccctccgcgtcctgaagatggtggaaccctggcttaaaggcaatcagttttgcattaagatcctgaacccttatatgccctctgttgtggagacactcgaacagatgcaacggaaacatgggggaatgctggtcagaaatccgctgagccgcaactccacccacgagatgtactgggtgtcttgtggcacagggaatattgttagcgccgtgaacatgacctcccggatgctcctgaacagattcacaatggcgcaccgcaagcctacctatgagcgggacgtcgatcttggagccggcacgagacatgtggctgtggaacccgaggtcgccaatctggacatcattgggcagcgcatcgaaaacattaaaaatgagcacaagagcacatggcattacgatgaagacaacccctataagacctgggcttaccacggatcttatgaggttaaaccttccggcagcgcctcttccatggtgaatggcgtggtcagactcctgaccaagccctgggatgtgatccctatggttacacagatcgctatgacggacaccacaccgtttgggcaacagcgggtgttcaaagagaaggtcgacacccgcacacccagagccaaacggggaaccacacagattatggaagtgaccgcgaagtggctttggggctttctgagcagaaacaagaaacctcggatctgcacgcgcgaggaattcaccagaaaggttcggtctaatgccgctattggggccgtgtttgtcgatgagaaccagtggaattccgctaaagaagccgtggaggacgagcgcttctgggatctcgttcacagagaacgggagctgcataagcaaggaaaatgcgccacatgtgtgtacaacatgatgggcaagcgcgaaaagaaactgggggagtttggcaaggcgaaaggaagcagagctatctggtacatgtggctcggcgcccggttcctggaattcgaggcccttgggtttatgaatgaggaccactggttctcccgcgaaaacagcctgtctggagtcgagggcgaagggctccataagctgggatatattcttagagatatcagcaaaatccccggcgggaatatgtacgctgacgataccgccggctgggacacacggattaccgaggatgacctgcagaacgaggctaagatcacggatattatggaacctgagcacgccctcctggcgacatccatctttaaactgacctatcagaataaggtggtccgcgtgcagagacccgccaagaacggaacagttatggacgtgatttctcggcgcgatcaaagaggcagcgggcaggtcggaacctacggcctcaacacgttcaccaatatggaagtgcagctgatccggcagatggagtccgaagggatctttcttccgtctgagctggagacacctaacctcgctgaaagagtgctggactggcttgagaaacatggagccgaacgcctgaagcggatggctattagcggcgacgattgcgttgtgaaacccatcgacgatagattcgccaccgcgctcacagccctgaatgacatggggaaggtccgcaaagatattcctcaatgggagccctccaagggctggaacgactggcagcaggtgcctttttgttctcaccacttccatcagctgatcatgaaggatggacgggaaattgttgtgccctgcagaaatcaagacgagctcgtcggccgcgctcgggtgagccagggggccggatggtccctgagagagaccgcttgtcttggcaaaagctatgcccagatgtggcaactgatgtactttcaccgccgggatctcagactggctgccaacgcgatctgctctgccgtcccggtggactgggttcctacatcccgcaccacgtggagcatccatgctcaccaccagtggatgacaaccgaagatatgctttctgtgtggaatcgggtctggattgaggaaaacccctggatggaggacaagacccatgtgtccagctgggaagaggttccctatctggggaaaagagaggaccagtggtgtggatccctcatcggcctgacagcccgggccacctgggctacaaatattcaggtggccatcaaccaagtcagacgcctgattgggaatgaaaactacctcgattacatgacgtctatgaagcggttcaaaaatgagagcgaccctgaaggcgcgctgtggtga

SEQ ID NO: 19520 - RNA, 9879 nt, synthetic construct
  misc_feature 1..9879: note = derived and/or modified CDS sequence (opt5) from DENV-1__KR919820__SS-prME
  source 1..9879: mol_type = other RNA
accgtggtcgccctgcttatgctgcttcccatggttttcagctttcacctgaccacgagaggcggggaacctcatatgatcgtgaacaagcaggaacggggaaaatccctcctgttcaagacctctggcgggattaatatgtgcacccttatcgctatggacctgggagatctctgtgaggacaccatgacatacaaatgcccgagaattaccgaagccgagcccgatgacgtggattgttggtgcaacgccacagacacctgggtcacgtatggcatctgtagccctaccggggaacacagacgggagaagcgctccgtggctctggcgccccatgttggactgggcctcgagacaagagccgaaacctggatgtctagcgagggcgcttggaaacaaattcagcgggtggaaacatgggccctgcgccaccctgggtttaccgtcatcgctcttttcctggcccatatcattggaacgtccatcacacagaagggcgtgatttttatcctcctgatgcttgttaccccctctatggcgatgagatgcgtgggggtcggaaatcgggatttcgtggagggcctgagcggggccacatgggtggacgtcgttctcgagcacggatcctgtgtgaccaccatggctaagaacaaacctacactggatattgaactgctcaagacggaggtgagcaatccggccgtcctgcgcaaactttgcatcgaagctagaatttctaacaccacaaccgactcccggtgtcccacacagggcgaggccagcctgtctgaagaacaggataccaattttgtgtgccgcagaacgctcgttgaccggggctgggggaacggatgtggcctgttcgggaagggatcccttatcacatgcgcgaaatttgagtgcctgaccaagatggaaggcaagatcgtgcagtacgagaatctcaaatatagcgtcattgtgaccgttcacacaggggatcagcatcaggtgggaaacgaaaccacaggccacggcacgaccgccacaatcacccctcaagctcccacatctgagattcagctgaccgactacggggccctgacgctcgactgttcccctcgcaccggactggatttcaatgaaatggtccttctgacaatgaaggagaaaagctggctcgtgcataagcagtggtttctggaccttcccctgccgtgggcttccggcgcctctagccctcaggagacctggaacagacaagatctcctggtcacattcaaaaccgcccacgctaagaaacaggaagtggttgtgctggggtcccaggagggagcgatgcacacggccctcacaggcgctaccgaaatccaaacaagcgggaccaccacaatttttgccggccatctgaagtgccggcttaagatggacaaactgacgctcaagggaatgtcttatgtcatgtgtaccggctccttcaaactgaagaaagaggtggccgaaacacagcacgggaccgttctggtgcaggtcgagtacgagggaacagatgctccctgcaagatccctttcaccacgcaggacgaaaagggcgtgatccaaaatgggagacttattacagccaaccccatcgtgaccgataaagagaagcccgttaatattgaagcggagcctccgtttggagagagctatatggtcatcggcgtgggggacaaagctctcaagctgtcttggttcaaaaagggcagctccctgggaaagatgtttgaagccaccgcccgcggcgctcggagaatggccattctcggggatacagcttgggacttcggatctgtgggcggggtctttaccagcatgggaaaactggtgcatcagatcttcggcacagcctacggggttctcttttccggcgtgagctggacgatgaagatcggaattggcctgctcctgacctggctggggcttaactctcgctccacaagcctctctatgacctgtatcgcggtcggaattatcacactgtacctgggcgtgatggttcaggccgataccgggtgcgtggtcaactggaaaggacgggagctcaagtgtggctccgggattttcgtgacgaatgaagttcacacctggacagagcagtataaatttcaagctgacagccccaagagactgtccgccgctatcggcaaggcctgggaagacggagtgtgcggcattcgctctgcgacccggcttgagaacatcatgtggaaacagatcgccaatgagctgaactacattctcctggaaaatgatatgaagttcacagtcgtggtgggggacgtcaaaggaatcctgacccagggcaagaaagggattagacctcagcccatggagcataagtatagctggaaatcctggggaaaggctaagatcattggcgccgatgttcaaaacacaacctttatcatcgacggccctgatacgcccgaatgtccggactctcagcgcgcttggaatatttgggaggtggaagattacgggttcggaatctttacaaccaacatttggcttaaactccgggacagctatacccaggtgtgcgatcacagactgatgtccgccgccatcaaggacagccgcgctgtccacgcggatatgggctactggattgagtctgagaaaaatgaaacatggaagctgtcccgggccagcttcatcgaggtgaaaacctgtacgtggcctaagtctcatacactctggtccaacggggttctggaaagcgagatgatcattcccaagatctatggaggccctatttctcagcacaattacagacccgggtacttcacccaaacagctggaccttggcatcttggcaaactggaactcgactttgatctgtgcgagggcaccacagtggtcgtggacgagcagtgcgggaaccggggacccagcctgcgcaccacgaccgttacaggcaagatcattcacgaatggtgttgcagatcctgtacccttccgcctctccggttcaaaggggaggacggatgctggtatggcatggaaatcagacccgtgaaggagaaagaggaaaatctggtcaagagcatggtgtctgccgggtccggaaaggttgataactttagcctgggcctcctgtgtatctccattatggtggaggaagtcatgcgctctcggtggagcggcaaaatgcttatgacagggaccatggccgtgttcctgctcctggtgatgggacagctgacgtggaatgaccttatcagagtctgcattatggttggcgctcacgccctggattccatggggatgggaacaacctacctcgcgctgatggctacatttaagatccgccccatgctcgccgtgggcctgcttttcagaaaactgacctctcgggagattctcctgctgaccatcgggcttagcctgattacacctgtggaactcccgaactccatcgaggagctgggagacggcctcgccatgggcatcatgatgctgaaacttctgacggattttcaaccctatcagctctgggctaccctgctgtctcttacattcgtcaaaaccacactgagcctccattacgcctggaagaccgcggctatggtgctgtccattgttagcctcctgcctctttgtctgtctacgacatcccagaagaccacctggctgcccatcctcctggggagccttggatgcaaacctctgacaatgtttctcatttctgaaaacaagatctggggccgcagatcctggcccattaatgaggggatcatggccgtgggaatcgtcagcattctgatgtcttccctcctgaaaaacgacgtgcctcttgccggccccctgatcgctgggggaatgctggttgcctgttatgtgattagcggctccagcgctgatctcaccctggaaaagacagccgaggtctcttgggaagaggaggcggaacacagcggcacggcccataatatccttgtggaggtccaggacgatgggaccatgaaaattaaggacgaagaacgggaagatacactgaccatcctcctgaaagctgccctcctggctctttccggagtgtacccgatgtctatccctgccacactgttcgtttggtatttttggcaaaagaagaaacagcgcagcggcgtgctgtgggacattccctcccctcccgaggtcgagaaggccgtgctcgatgacgggatctaccggattctgcagcggggagttttcggccgctctcaggtgggggtcggagtgtttcaagaaggcgtgttccacaccatgtggcatgttacgagaggcgctgtccttacctaccaggggaaacggctggagccgagctgggcgtccgtgaagaaagacctcatctcttatggaggcgggtggcgcctgcagggaagctggaacgtgggcgaagaggtccaggtgattgccgttgagcctgggaagaatcccaagaacgtgcaaacagtccctggaaccttcaaaacacacgaaggcgaggtgggcgctatcgccctcgattttaagcccgggacctccggaagccccattgttaatagagacggcaaagtggtcgggctgtacggaaacggcgtggttacaacgtctgggacctatgtgtccgccatcgctcagagcaaggtctctcaggaaggccctcttccggagatcgaagatgaggtgttcaaaaagaagaatctgacaattatggacctgcaccccggatccggcaaaacccggagatacctccctgccatcgtgcgcgagagcattaagcggagactgcgcacccttatcctggcgcccacacgggtcgttgcttccgaaatggccgaggccctcaaagggctgcctattagatatcaaacgaccgctgtgcgcaacgaacatacaggacgggagatcgtggatctgatgtgccacgccacctttacaatgagactcctttctcccgtccgcgtgcctaattacaacatgatcattatggacgaagcgcatttcaccgatccggctagcatcgccgcccggggctatatttccacgagagttgggatgggagaggctgccgctatctttatgacagccacaccccctggcagcgcggaggccttcccccagtctaattccgtgatttacgacgaagagaaggatatccctgaacggagctggaactctgggtacgactggatcaccgattttcagggcaaaacagtctggttcgtgcccagcattaagaccggaaatgacatcgctaactgtctgcgcaagaacggcaaaagagttattcagctgtcccggaagacatttgacaccgagtatcagaagacgaaaaattctgattgggacttcgtggtcacaaccgatatcagcgaaatgggggccaactttcgcgctgacagagtgattgatccgcggagatgcctcaaacctgtcatcctgcgcgacggacccgagcgggtgattcttgccggccccatgcctgttacagtggcctccgctgcgcagagacgcgggcggatcggaagaaatcagtctaaggagggcgatcagtacatctatatggggcaacccctgaacaatgacgaagatcacgcccattggaccgaggctaagatgctcctggacaacattaatacgcctgaaggcatcattccggccctgttcgagcccgagcgcgaaaagagcgccgctatcgatggagagtaccggctcagaggcgaggcccgcaagaccttcgtggagcttatgagaagaggggacctgcctgtctggctgtcctataaagttgcgagcgaaggcattcaatacgctgatcgcaagtggtgctttgacggagagagaaacaatcagatcctcgaggaaaacatggacgtggagatctggacaaaagaaggggagcggaagaaactgcgccccagatggcttgatgcccggacctattctgaccctctggccctcagagagttcaaggagtttgctgccggacgccggtccgtgagcggcgatctgattctggagatcggcaagctcccccaccaccttacacagagagcgcaaaatgccctggacaacctggtcatgctccataattccgaacaagggggacgcgcttaccggcacgccatggaggaactgccggataccattgagacacttatgctgctcgctatgatcgccaccctgacgggcggggtggctctgttctttctctctggaaaaggccttgggaagacaagcattggactgctgtgtgttatggcctcctctaccctcctgtggatggcgagcgtggaacctcattggatcgccgcttccatcgtccttgagttctttctgatggtgctcctgattcccgagcctgacagacagcggacaccccaggataaccaactggcctacgtcgtgatcggcctccttgttctgattctgacagtggctgccaatgaaatgggcctcctggagaccaccaagaaggaccttgggatcggaagcgccgctgcggaaattcagcaccacacgaccatcctggatgtcgacctccatcctgcctctgcttggacactgtatgccgtggccaccacagttattacccccatgctgcgccacacgatcgagaacaccacagctaacatgtccctcaccgccatcgcgaatcaggccgctattcttatgggcctggataaagggtggccgatcagcaagatggacattggagtgcctctgctcgccctgggctgctactctcaagtcaaccccatgacacttaccgctgccgtgctgatgctcgtggcgcattatgccatcattgggcccggactgcaggctaaggccacgagagatgctcagaaacggacagccgctggcatcatgaagaatcctaccgttgacggcatcgtcgccattgacctggatccggtggtgtacgacacaaaattcgagaagcagctcgggcaaatcatgcttctgattctgtgtacctcccagatcctcctgatgcgcaccacatgggcgttttgcgaaagcattacgcttgccaccggacccctgacaaccctctgggagggctctcctgggaaattctggaacacaaccatcgctgtcagcatggccaatatctttagaggatcctatctggctggcgccgggctggccttctctctcatgaaaagccttggaggcaaccggcgcggcacgggggcgcagggagaaacactgggcgagaagtggaaaagacagctgaatcaactctccaagctggaatttaacacctacaaacggagcgggattatggaggttgatcgcaccgaggctaaggaaggacttaaaagaggcgagacaacccggcacgccgtgtccagagggacagctaagctgcgctggttcgtggaacggaatctcgtcaagcccgagggaaaagtgatcgacctgggctgtggcagagggggatggtcttattactgcgccggcctgaagaaagttacggaagtgaaggggtacaccaaaggaggccctgggcatgaggagcccattcctatggccacatatggatggaacctcgtcaaacttcacagcggcaaagatgtgttctttatcccgcccgaaaagtgtgacaccctgctgtgcgatattggcgagtcctctcctaatcccacaatcgaagaggggcgcaccctccgggttctgaagatggtggaaccttggcttagaggaaaccagttctgtattaaagtcctgaatccctacatgccgagcgtggtggagacgctcgagcgcatgcagcggaagcacggcgggatgctggtcagaaaccctctgtcccgcaattctacccatgaaatgtattgggttagctgcggaacaggcaacatcgtgtccgctgtgaatatgaccagccggatgctcctgaacagatttacaatgacccaccgcaaacccacatacgagaaggacgtcgatcttggggccggaacccggcatgtggcggttgaacccgaggtggccaacctggacatcattggccagagaatcgagaatattaaaaacgaacacaagtctacgtggcactatgatgaggacaatccttacaagacatgggcttatcatggctcctacgaagtcaaacccagcgggtctgcctccagcatggtgaacggagttgtgcgcctcctgaccaagccttgggacgtcatcccgatggtgacccaaattgctatgacagatacgacccccttcggccagcagagagtttttaaagagaaggtggacacacggacccctaaagccaagcgcgggacagcgcaagtcatggaaatcaccgccggatggctttggaagttcctgtctcgcaagaagaaaccccggatctgtacaagagaggagtttacccggaaggtgcgctccaatgctgccattggcgctgtcttcgtggatgaaaaccagtggaatagcgccaaagaggctgttgacgatgaaagattttgggacctcgtgaaccgggagcgcgaactgcacaagcaggggaagtgcgccacgtgcgtctacaatatgatgggcaaaagagagaagaaactgggagagttcggcaaggcgaaagggtcccgggccatctggtatatgtggctcggagctcgctttctggagttcgaggcccttggctttatgaacgaagatcattggttcagcagagacaattctctgagcggggtggagggagaaggcctccacaagctggggtacattcttcgggatatcgctcgcattcctggcggaaacatgtatgccgacgataccgccggctgggacacaagaatcaccgaggaggatctgcagaatgaagcgcgggtgacagagctcatggaacccgaccatgctcaactggccacctccatcttccgcctgacgtaccagaacaaagttgtgagagtccagcggccggggaagaatggaacagtgatggacgttatttctcgcagagatcagcggggcagcgggcaagtgggaacctatggcctcaacacatttaccaacatggaggcccagctgatcagacagatggagtccgaaggggtcttctctcctagcgagcttgaaacgcccaatctggctaaccgcgtgctcgactggctggagaagtacggcgtcgaacggcttaaaagaatggccatttccggagatgactgtgtggttaagcctatcgatgaccgctttgctaccgccctgacagcgctcaatgatatgggcaaagtgcggaaggacattccccagtgggagccttctagagggtggaacgattggcaacaggtccccttctgcagccaccactttcatcagctgatcatgaaagacggacgcgagatcgtggttccgtgtcggaatcaggatgaactggtgggcagagcccgcgtctcccaaggggctggatggagcctccgggagaccgcctgcctgggcaagtcttatgctcagatgtggcagcttatgtacttccacagacgcgacctgcggctcgccgcgaacgccatttgttccgctgtgcctgtggactgggttcccacaagcagaaccacatggtctatccatgcccaccaccaatggatgaccacggaagatatgctgtccgtctggaatcgggtgtggattgaggaaaacccctggatggaggacaagacacatgtgaccagctgggaggatgtcccttaccttgggaaaagagaagaccagtggtgcggctccctgatcggactctctgctcgcgccacctgggctattaatatccaggtggccattaaccaggttcggaagctgatcggcaatgagcactatcaagattacatgacaagcatgagacgctttaaaaacgaatccgagccggaaggggcgctgtggtga

SEQ ID NO: 19521 - RNA, 9879 nt, synthetic construct
  misc_feature 1..9879: note = derived and/or modified CDS sequence (opt5) from DENV-1__DQ285561__SS-prME
  source 1..9879: mol_type = other RNA
agcgtgaccatgctgctcatgctgcttcccaccgctctgacgttccacctcaccacacggggaggggagcctcatatgattgtcggaaagcaggaacggggcaaatccctgctttttaagacctctgctggggttaatatgtgcacactgattgccatggacctcggagagctgtgtgatgacaccatgacatacaaatgcccgcgcatcaccgaaacggagcccgatgacgtggattgttggtgcaatgcgaccgaaacatgggtgacctatggcacatgtagccaaaccggggagcacagacgggacaagcgctccgtcgctctggcccctcatgtgggactcggcctggagacgagaacagaaacctggatgtctagcgagggcgcctggcggcagattcagaaagttgaaacatgggcccttcgccaccccgggttcaccgtgatcgccctgtttctcgctcatgccattggaacctccatcacacagaagggcatcattttcatcctgcttatgctggtcacgccttctatggcgatgagatgcgtggggattggaaaccgggattttgttgagggcctcagcggggccacctgggtggacgtcgtgctggagcacggatcctgtgtgacaaccatggctaaggataaacccacactggacatcgaactcctgaagaccgaggtcacgaatcctgccgttcttcgcaaactgtgcattgaagctaagatcagcaacacaaccaccgattctagatgtccgacacaaggcgaggccaccctcgtggaggaacaggacacaaatttcgtgtgccggcgcacgtttgtcgatagaggctgggggaacggatgtggcctgttcgggaaaggatcccttattacctgcgcgaagtttaagtgcgtgacaaaactggagggcaagatcgttcagtacgaaaatctcaaatatagcgtgatcgtcaccgtgcacacaggggaccagcatcaagttggaaacgagaccacggaacacggcaccattgccacaatcacaccccaggctcctacatctgagattcagctgaccgactacggcgccctgacgctcgattgtagcccccggacagggctggacttcaatgaaatggtgcttctgaccatgaaggagaaaagctggctcgtccataagcagtggtttctggatcttcctctgccctggacatctggagcttccaccagccaagagatctggaaccgccaggacctcctggtgaccttcaaaacagcccacgccaagaagcaggaagtcgtggttctgggctcccaagagggggctatgcacacggcgctcaccggagccacagaaattcagacctctggcacaaccacgatctttgctgggcatctgaaatgcagacttaagatggataaactgacactcaagggcatcagctatgtgatgtgtaccggatccttcaaactggagaaggaagtcgccgagacccagcacggcacagtgctggttcaggtgaagtacgaggggaccgacgccccgtgcaaaattcctttcagctctcaagatgaaaagggagtcacacagaatggccggcttgtgacggctaaccccatcgtgaccgacaaagagaagcctgttaatattgaagccgagccgccctttggggagtcctatatcgtcgtgggagcgggcgaaaaagctctcaagctgagctggttcaagaaagggtctagcattggcaagatgtttgaggccacagccagaggagctcgccggatggccatcctgggcgataccgcttgggacttcgggtccatcggaggcgtgtttacatctgtcgggaaactcgtgcatcagattttcggaaccgcctacggcgttctgtttagcggggtgtcctggacgatgaagatcggcattggaatccttctgacctggctcggcctgaacagcagatctacatccctgagcatgacctgtattgcggtcgggatgatcacactttacctcggagtgatggttcaggccgattctggctgcgtgattaattggaaagggcgcgaactgaagtgtggatccggcatcttcgtcaccaacgaggtgcacacatggaccgaacaatataagtttcaggctgacagccctaaacggctgtccgccgctatcgggaaggcctgggaggagggcgtttgcggaattagatctgcgacgcgcctcgaaaacatcatgtggaaacagattagcaatgagctgaaccatatccttctggaaaatgacatgaagttcacagtggtcgtgggcgatgtgtccgggattctcgcccagggcaagaagtctatccggccgcaacccatggagcacaaatacagctggaagtcctggggcaaggctaaaatcattggggccgacgtccagaacaccacctttatcattgatggacctaatacacccgaatgtcctgacgatcagagagcttggaacatctgggaggttgaggactatggcttcggcatttttaccacgaatatctggctgaagctgcgcgatagctacacacaggtgtgcgaccaccggcttatgtctgccgccatcaaagattccaaggctgtgcatgcggacatggggtattggattgaaagcgagaaaaacgaaacctggaagctcgccagagcttctttcatcgaggtcaagacatgtatttggcccaaatcccacaccctgtggagcaatggagtgctggaatctgagatgatcattccgaagatctacggcgggcctatcagccaacataactatcgccccggatacttcacacagaccgccggcccttggcacctcgggaaactggagcttgattttgacctgtgcgaaggaacgaccgttgtggtcgatgagcactgcggcaatcggggcccctccctcagaacaaccacagtgaccgggaagattatccatgaatggtgttgccggagctgtacgctgcctcccctgcgcttcaaaggagaggacggctgctggtacgggatggagattagaccggttaaggaaaaggaggaaaaccttgtgaaatctatggtctccgccggaagcggcgaggtggactccttttctctcgggctgctgtgtatcagcattatgatcgaagaggttatgcggtccagatggtctcgcaagatgctcatgacaggaaccctggctgtgttccttctgctcacaatgggccagctgacctggaatgatctgattcggctttgcatcatggtcggcgccaacgcgagcgacaatatggggatgggaaccacatatctggctctcatggccacgtttagaatgcgccctatgttcgccgtgggcctgctctttagacggctgacctcccgcgaggtgcttctgctcacagtcgggctgtctctggttgctagcgtggaacttcccaactccctggaggaactcggagatggcctggccatggggatcatgattctcaaactgcttaccgacttccaaagccaccagctgtgggcgacactcctgtctctgacctttgtgaagacgacattctcccttcattacgcttggaaaaccatggccatgatcctgagcattgtctctctctttcccctgtgtctctccaccacaagccagaagaccacatggctgcctgtgcttctgggatctctgggctgcaagccgctcacgatgttcctgatcaccgagaacaaaatttggggcagaaagtcctggccccttaatgaagggatcatggccgttggaatcgtgagcattctgctctccagcctgctcaaaaacgatgtccctctggctggcccccttatcgccgggggaatgctgattgcttgttatgtgatctctggcagctccgccgacctgtctctcgagaaggcggccgaggttagctgggaagaggaagctgagcactccggggcctctcataatattctggtggaaatccaggatgacggaacaatgaaaatcaaggatgaggagcgggacgataccattacaatccttctgaaagctaccctcctggccattagcggcgtctaccctatgtccatccccgccacgctctttgtgtggtatttctggcaaaagaagaaacagcgctctggcgtcctgtgggacaccccttcccctcccgaagtggagagagctgttcttgatgacgggatttaccggatcctgcagcgcggactgctcggcagatcccaggtgggggtcggagtgttccaagaaggcgtttttcacacaatgtggcacgtgaccagaggggcggtcctgatgtatcagggaaagcgccttgagcccagctgggcctctgtgaaaaaggacctgatttcctacggcggcgggtggagattccagggaagctggaacacaggcgaggaagtgcaggttatcgctgtcgagcccgggaaaaatcctaagaacgtgcaaaccgcccccggaacatttaagacgtctgaaggcgaggtgggggccatcgctctcgatttcaaaccgggaacctccggcagccctattgtcaatcgggaaggcaagatcgtggggctgtacggaaacggcgttgtgacaacctccgggacctatgtctctgccattgcgcaggctaaagccagccaggagggacccctccctgagatcgaagacgaggtgtttagaaagcgcaatctgacaattatggatcttcatcccggctccgggaaaacgcggagatacctgcccgccatcgttcgcgaagctatcaagcggaagctgagaaccctcgtgctggcccctacacgcgtcgtggcgagcgagatggctgaagcccttaaaggcatgccgattcggtatcaaaccacagccgttaagtctgagcacaccggaagagagatcgtggacctgatgtgccatgctacgttcacaatgcgcctcctgtcccccgtccgggtgcctaactacaatatgattatcatggatgaagcccactttaccgaccccgctagcattgccgcgagaggctatatctctacccgggtggggatgggagaggccgctgccatcttcatgacagctacccctcccggcagcgtcgaagcctttcctcagtccaacgccgttattcaggatgaggaaaaagacatcccggagcgctcttggaatagcgggtacgattggattacaggattccccggcaagaccgtgtggtttgtgccttccatcaaatctgggaacgacattgctaattgtctgagaaagaacggcaagcgggtcatccagctcagccgcaaaacgttcgatacagagtatcaaaagaccaaaaacaatgactgggactacgtggttacaaccgatatttccgaaatgggagcgaacttcagagccgaccgggtgatcgatcccagacgctgccttaagcctgtcatcctgaaagacggccccgagcgggtgattctggctgggccgatgcctgttacggtggccagcgccgctcagagacgcggacggatcggcagaaatcagaacaaggaaggggatcagtacatttatatgggacaacccctcaataacgacgaggatcatgcccactggaccgaggcgaagatgctgcttgacaatatcaacacacccgaaggcattatccctgctctgtttgagcccgaacgcgagaaatctgccgccatcgatggggaataccggctcagaggcgaggctcgcaagaccttcgtcgagctgatgagacggggagacctgcctgtgtggctctcctataaagtcgccagcgaaggctttcagtactccgatcgcagatggtgcttcgacggggagcggaataaccaggtgcttgaagagaatatggatgttgaaatttggacaaaggagggagagcgcaaaaagctgagaccgcggtggctggacgcgagaacctattctgaccccctcgccctgcgcgaatttaaagagttcgctgccggccggagaagcgtgtccggggatcttatcctggaaattggaaagctccctcagcacctgacacaacgcgctcagaacgccctggacaatctcgtgatgcttcataactctgagcagggcggcaaggcttaccggcacgccatggaggaactgcccgataccatcgagacgctgatgctcctggcgcttattgccgtcctgacagggggagttaccctctttttcctgagcggcagagggctgggaaaaacctccatcggcctcctttgtgtgatgtcctctagcgctctgctgtggatggccagcgtggaacctcattggatcgctgcctctattatcctcgagtttttcctgatggtccttctgattcccgaaccggaccggcagcgcacacctcaagataatcagctcgcctatgtggttatcgggctgctgtttatgattctcaccgtggctgcgaacgagatgggacttctggagacaacgaagaaagacctgggcatcggccacgccgctgccgaaaaccaccatcacgccgctatgctcgatgtcgacctgcatcccgcctccgcgtggaccctttacgccgtggctacaaccattatcacacctatgatgagacacaccatcgagaatacgaccgccaacattagcctgacagctatcgccaatcaggcggccattctcatggggctggataagggatggcccatctctaaaatggacattggcgtccctctgctcgctcttgggtgctacagccaagtgaaccccctgaccctgacagccgctgttctcatgctggtggcccattatgctatcatcggaccgggccttcaggccaaggcgacccgggaagcccagaagcgcacggctgccgggattatgaaaaatcctacagtcgatggaatcgtggctattgacctggatcccgttgtgtacgacgccaagttcgagaaacagctcggccaaatcatgctgctgattctctgtacctcccagatccttctgatgagaacaacctgggccctgtgcgaatctatcaccctcgcgacaggccccctgacgaccctttgggaggggagccctggaaagttttggaacacaaccattgctgtctccatggccaatatcttccggggcagctatctggctggggccggactcgccttctccctgatgaaatctctgggcgggggacgcagaggcacaggcgctcagggggagaccctcggagaaaagtggaagcggcagcttaaccaactgagcaaatccgagtttaatatttacaagcgctctggcatcgtggaagtggacagaagcgaggccaaagaagggctgaagcggggagagacgattaaacacgcggtttccagaggcacagccaagctccgctggttcgtcgagcggaacctggtgaagccggaagggaaagtgatcgatcttggatgtggcagaggcgggtggtcttattactgcgctggactgaagaaagtcaccgaggttaagggctataccaaagggggacccggccacgaggaacctattcccatggccacatacgggtggaatctcgtgaagctgtacagcggaaaagacgtgtttttcatccctcccgaaaagtgtgataccctgctctgcgacatcggcgagtccagccctaacccgacaattgaggaaggccgcacgcttcgggtcctgaagatggtggagccctggctgagagggaatcagttttgtatcaaaattctcaacccttatatgccctctgttgtggaaaccctggagcagatgcagcgcaagcatggaggcatgcttgtccggaatcctctgtccagaaacagcacacacgagatgtactgggtgtcttgcgggaccggaaatatcgtttccgctgtgaacatgacaagccgcatgctcctgaaccggttcaccatggcccatagaaaacccacgtatgaacgcgatgtcgacctgggcgcggggacccggcacgtggccgtggagccggaagtcgctaatctcgatattatcggacaaagaatcgagaacattaagaatgaacacaaatctacatggcattacgacgaggataacccttataagacctgggcctaccacggctcctatgaggttaagcccagcggctccgctagctctatggtgaatggggtggtccgcctgcttacaaaaccctgggacgtgatccctatggttacccagattgccatgacagataccacgccctttggacagcaaagagtgttcaaggaaaaagtcgacacacggacccctaaggctaaacgcggcaccgcccagatcatggaggtgacagcgaagtggctgtgggggtttctcagcagaaacaagaaaccgcggatttgtacgagagaagagttcacccggaaggttcgctccaatgccgctatcggagccgtgtttgtcgacgaaaaccagtggaactctgctaaagaggccgtggaggatgaaagattctgggacctggttcggcgcgagagagaacttcataagcagggcaaatgcgccacatgcgtgtacaacatgatggggaagcgggagaagaaactgggcgaatttggaaaggcgaaaggcagccgcgctatctggtacatgtggctcggggccagattcctggagttcgaggccctgggatttatgaatgaagatcactggttctcccgggagaactctctcagcggcgtcgaaggggagggactgcataaacttggctatattctgcgcgacatctccaaaattcccgggggcaatatgtacgctgatgacaccgccggatgggatacaagaatcaccgaggacgatctccaaaacgaagctaagattacagacatcatggagcctgaacacgccctgcttgcgacctctatctttaaactgacgtatcagaataaggtggtccgggtgcagcgccccgccaagaacggcaccgttatggatgtgattagcagacgggaccagcgcgggtccggacaagtcggcacatacgggctcaacaccttcacaaatatgggagctcagctgatcagacagatggagagcgaaggcatcttttctccttccgagctggagacccccaacctcgccgggcgggtgctggattggcttgaaaaacacggcatcgagagactgcgccggatggctattagcggagacgactgtgtggttaagccgatcgatgacagattcgccacggcgctcacagccctgaatgatatgggcaaagtgcgcaaggacattcctcagtgggaaccctctaaagggtggaacgattggcaacaggtccctttttgctcccatcacttccatcagcttatcatgaaggacggacgggagatcgtggttccctgtagaaatcaggatgaactggtgggccgcgctcgggtcagccaaggggccggatggtccctcagagagaccgcttgcctgggcaagtcttatgcccagatgtggcagctgatgtactttcaccgccgggacctcagactggctgccaacgcgatttgtagcgccgtgcctgtcgattgggtgcccacatcccgcaccacgtggagcatccacgctcatcaccaatggatgaccacagaggacatgctttctgtttggaatcgggtgtggattgaagagaacccgtggatggaagataaaacccatgtctccagctgggaggacgtgccttatctggggaagagagaagaccagtggtgcggctctctcatcggactgacagcccgggccacctgggctacaaatattcaggttgccatcaaccaggtgagacgccttatcggcaatgagaactacctggattacatgaccagcatgaaacggttcaagaatgagtccgaccccgaaggggcgctctggtga

SEQ ID NO: 19522 - RNA, 9879 nt, synthetic construct
  misc_feature 1..9879: note = derived and/or modified CDS sequence (opt5) from DENV-1__DQ285562__SS-prME
  source 1..9879: mol_type = other RNA
tccgtgaccatgctgctcatgctgcttcccaccgccctggctttccacctcacgaccagaggcggggaacctcatatgatcgtgtccaagcaggaacggggaaagtctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggcggcagattcagaaagttgaaacatgggctcttagacaccccggcttcaccgtgatcgccctgtttctcgcgcatacaattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccaaggagaggcgacactcgtggaagaacaagatgccaacttcgtgtgccggcgcacctttgtcgacagaggctggggcaatgggtgtggactgttcggcaaagggagccttctgacatgcgctaagtttaagtgcgtgacgaaactcgagggaaagattgttcagtacgaaaacctgaaatattctgtgatcgtcaccgtgcacacaggcgatcagcatcaagttgggaatgagaccacagaacacggaaccatcgccacgattacaccccaagctcctacctccgagatccagctgaccgactacggcgccctcacactggactgtagcccccggaccggccttgatttcaacgaaatggtgctgctcacgatgaaggagaaatcttggctggtccataagcagtggtttcttgacctgcctctcccctggacatccggggccagcacctcccaagagacatggaatcgccaggatctgctggtgaccttcaaaaccgctcacgcgaagaagcaggaagtcgtggttctcggatctcaagagggcgccatgcacacagctctgacgggggccaccgaaattcagacaagcggaaccacaaccatctttgccggccatcttaaatgcagactgaagatggacaaactcacgctgaagggggtgtcctatgtcatgtgtacaggcagcttcaaactggagaaggaagtggctgagacccagcacggaaccgttcttgtgcaggtcaagtacgagggcacagatgccccgtgcaaaattcctttctctacccaagacgaaaagggggtgacacagaacggacggctcatcacggcgaatcccatcgtgaccgataaagagaagcctgttaacattgaaacagagccgccctttggcgagtcctatatcgtcattggggctggagaaaaagccctgaagctgagctggttcaagaaaggctctagcatcgggaagatgtttgaggccaccgctagaggcgcccgccggatggctattctcggagacacagcctgggatttcggctccatcgggggagtgtttacctctgtgggcaaactggtccatcaggtgttcgggacggcgtacggagttctttttagcggcgtgtcctggaccatgaagatcgggattggcatcctgctcacatggctgggactgaatagcagatctacctcccttagcatgacatgtattgtcgtgggcatggttaccctctacctgggggtgatggtccaggccgactctggatgcgtgatcaactggaaaggccgcgaactgaagtgtgggtccggaattttcgttacaaacgaggtgcacacctggacggaacaatataagtttcaggctgatagccctaaacggctctccgccgctatcggcaaggcctgggaggagggggtctgcggcattagatctgcgacacgcctggaaaatatcatgtggaaacagatcagcaacgagcttaatcatattctgctcgaaaacgacatgaagttcaccgtggtggtcggagacgccaatggcatcctgacccaggggaaaaagatgattcggccgcaacccatggagcacaaatactcctggaagtcttggggaaaggctaaaatcattggcgccgatatccagaacacaacctttatcattgacgggcctgatacgcccgaatgtcctgacgatcagagagcttggaatatctgggaggttgaggactatggattcggcatttttacaaccaacatctggctgaaacttcgcgatagctacacacagatgtgcgaccaccggctcatgtccgccgccattaaagatagcaaggctgtgcatgcggacatgggctattggatcgaatctgagaaaaatgaaacctggaagctggccagagcttccttcatcgaggtgaagacatgtatttggccccgcagccacaccctgtggtctaacggggtcctcgaatccgagatgatcattccgaaaatctacggaggccctattagccaacataattatcggcccgggtacttcacgcagaccgccggaccttggcacctgggcaaacttgagctggattttgacctctgcgaagggacaaccgtggttgtggatgagcactgcggaaacagaggcccctctctgcggacaaccacggtcacaggcaaaatcatccatgaatggtgttgccgcagctgtaccctgcctccccttagattcaagggggaggacggatgctggtacggcatggagattcggccggtgaaagaaaaggaggaaaatctcgttagatccatggtgagcgccgggtctggagaggtcgactcctttagcctgggcctgctctgtgtgtccatcatggttgaagaggtgatgcgctctcggtggagcagaaagatgctgatgacagggacccttgctgtcttctttctgctcattatgggacagctgacctggaacgatctgatccgcctttgcattatggtgggcgccaatgtgtccgacagaatgggcatggggacaacgtatctggcgctcatggctaccttcaaaatgcggcctatgtttgccgtcggactcctgttccgcagactgacatctcgggaggttcttctgctcaccatcggcctgagcctggtggcctccgtggaacttcccaactctctggaggaactcggggatggactggctatgggcattatgatgctcaagctgcttacagactttcaaagccaccagctgtggaccacgctcctgtccctgacattcatcaaaaccacccttagcctggattacgcctggaagacaatcgcgatggtcctctctattgtgtccctgtttcccctctgtctgagcaccacatctcagaaaacgacctggcttcctgttctgctggggtccttcggatgcaagccgctcacaatgtttctgatcaccgagaacaagatttggggccgcaaaagctggccccttaatgaaggcatcatggctgtggggattgtctctatcctgctctccagcctgctcaagaacgacgtgcctctggccggaccccttatcgccggcgggatgctgattacatgttatgttatctccggaagctctgctgatctgagcctcgagaaagccgctgaggtgtcctgggaagaggaagccgagcattctggcgcgagccacaatattctggtcgaagtgcaggacgatgggaccatgaagatcaaagacgaggagagagatgacacgcttaccattctgctcaaggccacactgctcgctgtctccggagtgtaccctatgtctatccccgccaccctgttcgtttggtatttctggcagaagaagaagcagcggagcggcgtgctttgggatacacctagccctcccgaagtcgagcgcgctgtgctggacgacggcatctaccgcattctgcagcgggggctcctgggacgctctcaggttggcgtgggggtctttcaagatggagtgttccataccatgtggcacgtgacaagaggcgccgttcttatgtatcaggggaaacggctggaacccagctgggcctccgtcaagaaagacctcatcagctacggaggcggctggagatttcaggggtcttggaacacgggagaggaggtccaggtgattgctgtcgaacccggcaagaatcctaaaaacgtgcaaaccacacccgggaccttcaagaccccggagggagaagttggcgcgatcgccctggattttaagcctgggacatccggaagccccattgtgaatcgcgagggcaaaatcgtcggcctctacgggaacggagtggttacgacctctggcacatatgtgtccgctattgcccaggccaaggctagccaggaagggcctctgcccgagatcgaggacgaagtcttcaaaaagcggaatcttaccatcatggatctgcaccccggatccggcaaaacaagacgctacctgcctgccattgtgcgggaggcgatcaagagaaagctccgcaccctgattcttgctccgacgcgggttgtggcctctgaaatggccgaggctctgaaagggatgcccatcagatatcaaacaaccgccgtcaagagcgaacataccggccgcgagattgtggacctcatgtgccacgcgacatttaccatgcggctgctgtcccctgtgagagtccccaactacaatatgatcatcatggatgaggctcatttcacagaccctgccagcattgccgctcggggatatatctctacccgcgttggcatgggggaagccgctgccatttttatgacggcgacaccccctggatccgtggaggccttcccgcagagcaacgctgtgatccaggatgaagagagagacattcccgaacggtcttggaatagcggctacgattggatcaccgactttcctgggaaaacagtctggttcgtgccctccatcaagtctggaaacgacattgccaattgtctccgcaaaaacggcaagagagttatccagcttagccggaagaccttcgatacggagtatcagaagaccaagaacaatgactgggattacgtggtcacaaccgacatttccgagatgggggctaactttagagccgatcgcgtgatcgaccctcggagatgcctgaaacccgttattctgaaggatggcccggaacgcgtgatcctcgccggacctatgcccgtcacagtggcttctgcggcccagcggagaggccgcattgggcggaatcagaacaaagagggagaccagtacatctatatgggccaacccctgaataacgatgaagaccacgctcattggaccgaggccaagatgcttctggataatatcaacacacctgaggggattatccccgccctcttcgaacctgagagagaaaagagcgctgccattgacggagagtaccgcctgagaggcgaagcgcggaaaacctttgtcgagctgatgcgcagaggggatctcccggtgtggctttcctataaggttgctagcgagggcttccagtactctgaccggcgctggtgctttgacggagaaagaaataaccaggtgctggaggaaaatatggatgtggagatctggacgaaagaaggcgagcggaagaaactgagaccccgctggctcgacgcccggacatattccgatcctctggcccttagagagttcaaggaatttgctgccgggcgccggagcgtctccggagacctgattctcgagatcggcaaactgccccagcacctgaccctcagagcgcaaaacgcccttgataatctggttatgctgcacaactctgaacaagggggaaaggcttaccggcatgccatggaggaactccctgacaccatcgagacactgatgcttctggctctcattgccgtgctgaccggcggcgtgacactgttctttctcagcgggaagggacttggcaaaacgtccatcgggctgctgtgtgtcatggcttctagcgtgctcctgtggatggcctccgttgagccccactggattgcggccagcatcattcttgagttctttctgatggtgctcctgatcccggagcctgatcgccagagaacaccccaggacaatcaactggcttatgtcgtgatcggactccttttcatgattctgacagtcgccgctaacgaaatgggcctgctcgagaccacaaagaaagatctggggatcggacatgccgtggccgagaaccaccaccatgctaccatgcttgacattgatctgcaccctgcgtctgcctggacgctctacgctgttgccaccacaatcattacccccatgatgcggcatacaatcgaaaataccacggccaacatttccctgacagctatcgccaatcaggcggccatcctgatgggcctcgacaagggctggcctattagcaaaatggatatcggggtgccccttctggctctgggatgctactctcaggtcaacccgctcaccctgacagccgctgtgcttatgctggttgcccactatgcgattatcggccctgggctccaagccaaggctacccgcgaggcccagaagagaaccgctgccggaattatgaaaaatcccacagtggacggcatcgtcgctatcgacctggatcccgtggtgtacgacgccaagtttgaaaaacagctggggcagattatgctccttatcctgtgtacgtcccaaattctgctcatgcggaccacatgggcgctgtgcgagagcatcacccttgccacaggacctctgaccacgctctgggaaggctctccgggcaagttctggaacacaaccattgctgttagcatggccaatatcttccgcgggtcctatctggctggagccggcctggccttttctctcatgaaaagccttgggggaggcagacgggggaccggagcgcagggcgagacactgggcgagaagtggaagcgccagctgaaccagctctccaaaagcgagttcaatacctacaagagatccgggatcatggaggtcgatcggtctgaagctaaagagggactgaagagaggcgaaacaacgaaacatgccgtgagccgcgggaccgctaaacttcggtggtttgtggagagaaacctggtcaagcccgagggaaaagttattgacctcggctgtgggcgcggaggctggtcctattactgcgccggcctgaagaaagtgacagaagtgaaggggtataccaaaggaggccctgggcacgaggaacccatccctatggccacatacggatggaatctggtcaagctccactctggcaaagatgtgttctttacgccccctgagaagtgtgacacccttctgtgcgatattggggaaagctccccgaaccccaccatcgaggagggacggacactgagagttctcaagatggtggaaccttggctgcgcggcaatcaattctgtattaaaatccttaacccctacatgccttctgtcgtggagaccctggaacagatgcagcggaagcatggcgggatgctcgttagaaatcccctgagccgcaactccacacacgagatgtattgggtgagctgcggaaccggcaatattgtctctgctgtgaacatgacatcccggatgctgctcaacagatttaccatggcccatcgcaaaccgacgtacgagcgggacgtggatctgggggcgggaacaagacacgtcgccgttgaacctgagatcgctaatcttgacatcattggccagcgcatcgaaaacattaagaatgagcacaaaagcacctggcattatgatgaagacaacccctacaagacctgggcctatcacgggtcttacgaggtgaagccctccggaagcgcttcttccatggtgaatggcgtcgtgagactgctcacaaaaccttgggacgttatccccatggtgacgcaaattgccatgaccgatacaacccctttcggccagcagcgggtctttaaggagaaagtggacacacgcaccccgagacccaagcgggggacagcgcaaatcatggaagttaccgccaaatggctgtggggattccttagcagaaacaagaagcctcggatctgtacgcgcgaggaatttaccagaaaagtgcggtccaatgctgccattggcgctgtcttcgtggatgagaaccagtggaatagcgccaaggaagctgttgaggacgagcgcttttgggatctggtgcatagagaacgggagctccacaaacaggggaagtgcgccacatgcgtctataacatgatgggaaaacgcgaaaagaagctgggcgagttcgggaaagcgaagggctctagagccatctggtacatgtggctgggagctcggttcctcgaatttgaggccctgggcttcatgaatgaggaccattggtttagccgcgaaaactccctttctggggtggagggagaaggcctgcacaaactcgggtacattctgagagatatcagcaagattcccggaggcaatgtctatgctgacgataccgccgggtgggacacacggatcaccgaggatgaccttcagaacgaggccaaaatcacggatattatggaacctgagcacgcgctgctcgctacatccatcttcaagctgacctaccaaaataaagtggttcgcgtgcagagacccgccaagtctggcacagtcatggacattatcagccggcgcgaccagagaggatccggccaggtggggacctatggactgaacacgtttaccaacatggaagtgcaactcattcggcagatggagtctgaaggcatcttcagcccgtccgagctggagaatagcaaccttgccgaaagagttctggattggctcgagaagcatggggtggaacgcctgaaacggatggctatctctggagacgattgtgtcgtgaagcctacagacgatagatttgccaccgctcttacagccctgaatgacatgggcaaagttcgcaaggatattccccagtgggagccttccaaagggtggaacgactggcagcaagtgcccttctgcagccaccattttcaccagctcatcatgaaggatggccgggaaattgtcgtgccttgtagaaatcaggacgagctggtcggacgcgcgcgggtgtctcagggcgccgggtggtccctgagagagaccgcttgcctcggaaagagctacgcccaaatgtggcagctgatgtatttccaccgccgggatcttagactggctgccaacgcgatctgttccgccgttcccgtggactgggtcccgacatctcgcaccacgtggagcattcatgctcaccatcagtggatgacaaccgaagacatgctctccgtgtggaatcgggtttggatcgaggaaaacccttggatggaggataaaacccacgtgagctcttgggaagacgtcccctacctgggcaagagagaggatcaatggtgcgggtcccttattggactgacagcccgggctacctgggccacaaatatccaggtggctatcaaacaggtgagacgcctcattggcaacgagaattatctggactacatgacgagcatgaagcggtttaaaaacgaatctgatcccgagggggccctgtggtga

SEQ ID NO: 19523 - RNA, 9879 nt, synthetic construct
  misc_feature 1..9879: note = derived and/or modified CDS sequence (opt5) from DENV-1__DQ285558__SS-prME
  source 1..9879: mol_type = other RNA
agcgtgaccatgctgctcatgctgcttcccacagccctgacgttccacctcaccacacggggaggggagcctcatatgatcgtcggaaagcaggaacggggaaaatccctgctttttaagacctctgctggggttaacatgtgcacactgattgccatggacctcggagagctgtgtgatgacaccatgacatacaaatgcccgcgcatcaccgaaacggagcccgatgacgtggattgttggtgcaatgcgaccgaaacatgggtgacctatggcacatgtagccaaaccggggagcaccggcgggacaagcgctccgtcgctctggcccctcatgtgggactcggcctggagacgagaacagaaacctggatgtctagcgagggcgcctggcggcagattcagaaagttgaaacatgggcccttcgccaccccgggttcaccgtgatcgccctgtttctcgctcatgccattggaacctccatcacacagaagggcatcattttcatcctgcttatgctggtcacgccttctatggcgatgagatgcgtggggattggaaaccgggattttgttgagggcctcagcggggccacctgggtggacgtcgtgctggagcacggatcctgtgtgacaaccatggctaaggataaacccacactggacatcgaactcctgaagaccgaggtcacgaatcctgccgttcttcgcaaactgtgcattgaagctaagatcagcaacacaaccaccgattctagatgtccgacacaaggcgaggccaccctcgtggaggaacaggacacaaatttcgtgtgccggcgcacgtttgtcgatagaggctgggggaacggatgtggcctgttcgggaaaggatcccttattacctgcgcgaagtttaagtgcgtgacaaaactggagggcaagatcgttcagtacgaaaatctcaaatatagcgtgatcgtcaccgtgcacacaggggaccagcatcaagttggaaacgagaccacggaacacggcaccattgccacaatcacaccccaggctcctacatctgagattcagctgaccgactacggcgccctgacgctcgattgtagcccccggacagggctggacttcaatgaaatggtgcttctgaccatgaaggagaaaagctggctcgtccataagcagtggtttctggatcttcctctgccctggacatctggagcttccaccagccaagagacctggaaccgccaggacctcctggtgacattcaaaacggcccacgccaagaagcaggaagtcgtggttctgggctcccaagagggggctatgcacaccgcgctcacaggagccaccgaaatccagacatctggcaccacgacaatttttgctgggcatctgaaatgcagacttaagatggataaactgaccctcaagggcatcagctatgtgatgtgtaccggatccttcaaactggagaaggaagtcgccgagacacagcacggcaccgtgctggttcaggtgaagtacgaggggacagacgccccgtgcaaaatccctttcagctctcaagatgaaaagggagtcacgcagaatggccggcttgtgaccgctaaccccattgtgacagacaaagagaagcctgttaatatcgaagccgagccgccctttggggagtcctatattgtcgtgggagcgggcgaaaaagctctcaagctgagctggttcaagaaagggtctagcatcggcaagatgtttgaggccaccgccagaggagctcgccggatggccattctgggcgatacagcttgggacttcgggtccatcggaggcgtgtttacctctgtcgggaaactcgtgcatcagatcttcggaacggcctacggcgttctgtttagcggggtgtcctggaccatgaagattggcatcggcattcttctgacatggctcggcctgaacagcagatctacctccctgagcatgacatgtatcgcggtcgggcttattaccctctacctgggagtgatggttcaggccgattctggctgcgtgatcaattggaaagggcgcgaactgaagtgtggatccggcattttcgtcacaaacgaggtgcacacctggacggaacaatataagtttcaggctgacagccctaaacggctctccgccgctatcgggaaggcctgggaggagggcgtttgcggaatcagatctgcgacacgcctggaaaacattatgtggaaacagatcagcaatgagcttaaccatattctgctcgaaaatgacatgaagttcaccgtggtcgtgggcgatgtgtccgggatcctggcccagggcaagaagtctattcggccgcaacccatggagcacaaatacagctggaagtcctggggcaaggctaaaatcatcggggccgacgtccagaacaccacatttattatcgatggacctaatacccccgaatgtcctgacgatcagagagcttggaacatttgggaggttgaggactatggcttcggcatctttacgacaaatatttggctgaaacttcgcgatagctacacccaggtgtgcgaccaccggctcatgtctgccgccatcaaagattccaaggctgtgcatgcggacatggggtattggatcgaaagcgagaaaaacgaaacatggaagctggccagagcttctttcattgaggtcaagacctgtatctggcccaaatcccacacactgtggagcaatggagtgctcgaatctgagatgattatcccgaagatttacggcgggcctatcagccaacataactatcgccccggatacttcacccagacggccggcccttggcacctggggaaacttgagctggattttgacctctgcgaaggaaccacagttgtggtcgatgagcactgcggcaatcggggcccctccctgagaaccacaaccgtgacggggaagatcattcatgaatggtgttgccggagctgtacactgcctccccttcgcttcaaaggagaggacggctgctggtacgggatggagatcagaccggttaaggaaaaggaggaaaacctcgtgaaatctatggtctccgccggaagcggcgaggtggactccttttctctggggctgctctgtattagcatcatgattgaagaggttatgcggtccagatggtctcgcaagatgctgatgaccggaacacttgctgtgttcctgctcctgaccatgggccagctgacctggaatgatcttatccggctgtgcattatggtcggcgccaacgcgagcgacaatatggggatgggaacaacgtatctcgctctgatggccacctttagaatgcgccctatgttcgccgtgggcctcctgtttagacggcttacatcccgcgaggtgctgctcctgaccgtcgggctgtctcttgttgctagcgtggaactgcccaactccctcgaggaactgggagatggcctcgccatggggatcatgatcctgaaacttctgacagacttccaaagccaccagctctgggcgaccctgctgtctcttacgtttgtgaagacaaccttctccctgcattacgcttggaaaaccatggccatgattctcagcatcgtctctctgtttcccctctgtctgtccacaaccagccagaagacaacgtggcttcctgtgctgctgggatctctcggctgcaagccgctgaccatgttccttattacagagaacaaaatctggggcagaaagtcctggcccctgaatgaagggattatggccgttggaatcgtgagcatcctcctgtccagcctcctgaaaaacgatgtccctcttgctggccccctgattgccgggggaatgctgatcgcttgttatgtgatttctggcagctccgccgacctctctctggagaaggcggccgaggttagctgggaagaggaagctgagcactccggggcctctcataatatccttgtggaaattcaggatgacggaaccatgaaaatcaaggatgaggagcgggacgatacaatcaccattctgctcaaagctacgctgctcgccatcagcggcgtctaccctatgtccattcccgccaccctgtttgtgtggtatttctggcaaaagaagaaacagcgctctggcgtcctttgggacacaccttcccctcccgaagtggagagagctgttctggatgacgggatctaccggattctgcagcgcggactcctgggcagatcccaggtgggggtcggagtgttccaagaaggcgtttttcacaccatgtggcacgtgacaagaggggcggtccttatgtatcagggaaagcgcctggagcccagctgggcctctgtgaaaaaggacctcatctcctacggcggcgggtggagattccagggaagctggaacaccggcgaggaagtgcaggttattgctgtcgagcccgggaaaaatcctaagaacgtgcaaacagcccccggaacgtttaagacctctgaaggcgaggtgggggccatcgctctggatttcaaaccgggaacatccggcagccctatcgtcaatcgggaaggcaagattgtggggctctacggaaacggcgttgtgaccacctccgggacatatgtctctgccatcgcgcaggctaaagccagccaggagggacccctgcctgagattgaagacgaggtgtttagaaagcgcaatcttacgatcatggatctgcatcccggctccgggaaaacccggagatacctgcccgccattgttcgcgaagctatcaagcggaagctcagaacactggtgcttgcccctacccgcgtcgtggcgagcgagatggctgaagccctgaaaggcatgccgatccggtatcaaacaaccgccgttaagtctgagcacacgggaagagagattgtggacctcatgtgccatgctacattcaccatgcgcctgctgtcccccgtccgggtgcctaactacaatatgatcattatggatgaagcccactttaccgaccccgctagcatcgccgcgagaggctatatttctacacgggtggggatgggagaggccgctgccatcttcatgaccgctacacctcccggcagcgtcgaagcctttcctcagtccaacgccgttatccaggatgaggaaaaagacattccggagcgctcttggaatagcgggtacgattggatcaccgacttccccggaaagacggtgtggtttgtgccttccattaaatctggcaacgatatcgctaattgtctcagaaagaacgggaagcgggtcattcagcttagccgcaaaacattcgacaccgagtatcaaaagaccaaaaataatgactgggattacgtggttaccacggacatctccgaaatgggcgcgaacttcagagccgatcgggtgattgaccccagacgctgcctgaagcctgtcatcctgaaagatggacccgagcgggtgatcctcgctggcccgatgcctgttaccgtggccagcgccgctcagagacgcgggcggattggaagaaatcagaacaaggaaggcgaccagtacatctatatggggcaacccctgaataacgatgaggaccatgcccactggacagaggcgaagatgcttctggataatattaacacccccgaaggaatcattcctgctctctttgagcccgaacgcgagaaatctgccgccatcgacggcgaataccggctgagaggggaggctcgcaagacattcgtcgagctgatgagacggggcgatctccctgtgtggctttcctataaagtcgccagcgaaggatttcagtactccgaccgcagatggtgcttcgatggcgagcggaataaccaggtgctggaagagaatatggacgttgaaatctggaccaaggagggggagcgcaaaaagctgagaccgcggtggctcgacgcgagaacatattctgatcccctggcccttcgcgaatttaaagagttcgctgccggacggagaagcgtgtccggcgacctgattctcgaaatcgggaagctgcctcagcacctgacccaacgcgctcagaacgccctcgataatcttgtgatgctgcataactctgagcagggaggcaaggcttaccggcacgccatggaggaactgcccgacacgattgagacactcatgctgcttgcgctgatcgccgtcctcaccggcggggttaccctgtttttcctgagcggaagaggcctcgggaaaacatccattggacttctgtgtgtgatgtcctctagcgctctgctctggatggccagcgtggaacctcattggatcgctgcctctatcattctggagtttttccttatggtcctgctcatccccgaaccggatcggcagcgcacccctcaagacaatcagctggcctatgtggttattggcctgctctttatgatccttacagtggctgcgaacgagatggggctgctggagacgaccaagaaagatctcggaattggccacgccgctgccgaaaaccaccatcacgccgctatgctggacgtcgatcttcatcccgcctccgcgtggacactgtacgccgtggctaccacaatcattacccctatgatgagacacacgatcgagaataccacagccaacatcagcctcaccgctattgccaatcaggcggccatcctgatgggcctggacaaggggtggcccatttctaaaatggatatcggagtccctctccttgctctgggctgctacagccaagtgaaccccctgacactcaccgccgctgttctgatgcttgtggcccattatgctattatcgggccgggactgcaggccaaggcgacgcgggaagcccagaagcgcacagctgccggcatcatgaaaaatcctaccgtcgacgggattgtggctatcgatctcgaccccgttgtgtacgacgccaagttcgagaaacagctgggacaaattatgctgctcatcctttgtacatcccagattctgctgatgagaaccacctgggccctctgcgaatctatcacactggcgacgggcccccttaccacactgtgggagggcagccctgggaagttttggaacaccacaatcgctgtctccatggccaatattttccggggaagctatctcgctggcgccgggctggccttctccctgatgaaatctctcggaggcgggcgcagaggaaccggcgctcagggcgagacgcttggggaaaagtggaagcggcagctgaaccaactgagcaaatccgagtttaatatctacaagcgctctggaattgtggaagtggatagaagcgaggccaaagaaggcctcaagagaggggaaacaatcaaacacgcggtttccagaggaaccgccaagctgcgctggttcgtcgagcggaaccttgtgaagccggaaggcaaagtgattgacctggggtgtggaagaggcggctggtcttattactgcgctgggctcaagaaagtcaccgaggttaagggatatacaaaaggcgggcccggacacgaggagcctatccccatggccacctacggctggaatctggtgaagctgtacagcgggaaagatgtgtttttcattcctcccgaaaagtgtgacacactcctttgcgatatcggagagtccagccctaacccgacgatcgaggaaggccgcaccctgcgggtcctgaagatggtggagccctggctcagaggcaatcagttttgtattaaaatcctgaacccttatatgccctctgttgtggaaacacttgagcagatgcagcgcaagcatgggggaatgctggtccggaatcctctctccagaaacagcacccacgagatgtactgggtgtcttgcggcacagggaatattgtttccgctgtgaacatgaccagccgcatgctgctgaaccggttcacgatggcccatagaaaacccacctatgaacgcgacgtcgatctcggagcgggcacacggcacgtggccgtggagccggaagtcgctaatctggacatcattgggcaaagaatcgagaacatcaagaatgaacacaaatctacctggcattacgatgaggacaacccttataagacatgggcctaccacggatcctatgaggttaagcccagcggctccgctagctctatggtgaatggcgtggtccgccttctgaccaaaccctgggatgtgattcctatggttacacagatcgccatgaccgacacgacaccctttgggcagcaaagagtgttcaaggaaaaagtcgacacccggacccctaaggctaaacgcggaacagcccagattatggaggtgacggcgaagtggctctggggctttctgagcagaaacaagaaaccgcggatctgtaccagagaagagttcacacggaaggttcgctccaatgccgctattggggccgtgtttgtcgatgaaaaccagtggaactctgctaaagaggccgtggaggacgaaagattctgggatcttgttcggcgcgagagagaactgcataagcagggaaaatgcgctacctgcgtgtacaacatgatgggcaagcgggagaagaaactcggggaatttggcaaggcgaaaggaagccgcgctatctggtacatgtggctgggcgccagattcctggagttcgaggccctcgggtttatgaatgaagaccactggttctcccgggagaactctctgagcggagtcgaaggcgaggggcttcataagctgggatatatcctccgcgatatttccaaaatccccggcgggaatatgtacgctgacgatacagccggctgggacaccagaattacagaggatgacctgcaaaacgaagctaagatcaccgatattatggagcctgaacacgcccttctggcgacgtctatctttaaactcacctatcagaataaggtggtccgggtgcagcgccccgccaagaacggaacagttatggacgtgatcagcagacgggatcagcgcggctccgggcaagtcggaacctacggcctgaacacattcaccaatatgggggctcagctgattagacagatggagagcgaaggaatcttttctccttccgagctcgagacgcccaacctggccggccgggtgcttgactggctggaaaaacacgggattgagagactccgccggatggctatcagcggcgacgattgtgtggttaagccgattgacgatagattcgccacagcgctgaccgcccttaatgacatgggaaaagtgcgcaaggatatccctcagtgggaaccctctaaaggctggaacgactggcaacaggtccctttttgctcccatcacttccatcagctgattatgaaggatgggcgggagatcgtggttccctgtagaaatcaggacgaactcgtgggacgcgctcgggtcagccaaggcgccgggtggtccctgagagagacagcttgcctgggaaagtcttatgcccagatgtggcagctcatgtactttcaccgccgggatctgagacttgctgccaacgcgatctgtagcgccgtgcctgtcgactgggtgcccacctcccgcacgacctggagcattcacgctcatcaccaatggatgacaaccgaggatatgctgtctgtttggaatcgggtgtggatcgaagagaacccgtggatggaagacaaaacacatgtctccagctgggaggacgtgccttatctcggcaagagagaagatcagtggtgcgggtctctgattggccttaccgcccgggccacatgggctaccaatatccaggttgccattaaccaggtgagacgcctgatcggaaatgagaactacctcgactacatgacgagcatgaaacggttcaagaatgagtccgatcccgaaggcgcgctgtggtga

SEQ ID NO: 19524 - RNA, 9879 nt, synthetic construct
  misc_feature 1..9879: note = derived and/or modified CDS sequence (opt5) from DENV-1__DQ285559__SS-prME
  source 1..9879: mol_type = other RNA
agcgtgaccatgctgctcatgctgcttcccacagctctgacgttccacctcaccacaagaggaggggagcctcatatgatcgtgtccaagcaggaacggggaaaatctctgctttttaagaccagcgttggagtgaatatgtgcacactgattgctatggacctcggggagctgtgtgaagataccatgacatacaaatgcccccgcatcaccgaggccgaacccgacgatgtggactgttggtgcaatgcgacggatacctgggtcacatatggaacctgttcccaaacaggagagcacagacgggacaagcgctctgtggctctggcccctcatgttgggctcggactggagaccagaacggaaacatggatgagctccgagggcgcctggaaacagattcagaaggtggaaacctgggcccttcggcaccccggcttcacagtcatcgccctgtttctcgctcatgccattgggacctctatcacccagaagggaatcattttcatcctgcttatgctggtgacacctagcatggcgatgcgctgcgttggcattgggaatagagattttgtggagggactctccggcgccacgtgggtcgacgtggtgctggagcacgggagctgtgtcaccacaatggctaaaaataagcccaccctggatatcgaactcctgaaaacagaggttaccaaccctgccgtgcttcggaagctgtgcattgaagctaaaatctctaatacgacaaccgactcccgctgtccgacccaaggagaggccacactcgtggaagaacaagatgcgaacttcgtctgcagacggacctttgtggaccgcggctggggcaatgggtgtggactgttcggcaaggggagccttctgacatgcgccaagtttaaatgcgttacgaagctcgagggaaaaattgtgcagtacgaaaacctgaagtattctgtcatcgtgaccgttcacacaggcgatcagcatcaagtggggaatgagaccacagaacacggaaccatcgctacgattacaccccaagcccctacctccgagatccagctgattgactacggcgctctcaccctggactgtagccccagaacaggccttgatttcaacgaaatggtcctgctcaccatgaaagggaagtcttggctggtgcataaacagtggtttcttgacctgcctctcccctggacgtccggagccagcacatcccaagagacctggaatcggcaggatctgctggtcacattcaagaccgcccacgctaagaaacaggaggtggttgtgctcggctctcaagaaggggcgatgcacaccgccctgacaggagctacggagatccagaccagcggcacaaccacaatttttgccgggcatcttaagtgccgcctgaaaatggacaagctcaccctgaaaggcatgtcctatgtcatgtgtacgggcagcttcaagctggaaaaggaggtggccgaaacacagcacggcaccgttcttgtgcaggtcaaatacgaggggaccgatgctccgtgcaagatccctttctctacacaagacgagaaaggagtgacccagaacggcagactcatcacagccaatcccattgtgacggataaggaaaaacctgttaacatcgagaccgaaccgccctttggggagtcctatattgtcgtgggagcgggcgagaaggctctgaagctgagctggttcaaaaaggggtctagcatcggcaaaatgtttgaagccacagcccggggagctagacgcatggccattctcggcgacaccgcttgggatttcgggtccatcggaggcgtgtttacatctgtcgggaagctgacccatcaggtgttcggaacggcctacggcgttctttttagcggggtgtcctggaccatgaaaatcggcattggaatcctgctcacatggctgggcctgaatagccggtctacctcccttagcatgacatgtattgcggtcgggatggtgaccctctacctgggagttatggtgcaggccgactctggctgcgtcatcaactggaaggggagagagctgaagtgtggatccggcattttcgtgacaaacgaagttcacacctggacggagcaatataaatttcaggctgatagccctaagaaactctccgccgctatcgggaaggcctgggaagagggcgtgtgcggcattagatctgcgacacggctggagaatatcatgtggaaacagatcagcaacgaacttaattacattctgctcgagaacgacatgaagttcaccgtcgtggtgggcgacgccaatgggatcctggctcagggcaagaaaatgattagaccgcaacccatggaacataagtattcctggaaatcttggggcaaggccaaaatcattggggctgatatccagaacaccacatttatcattgacggacctgatacccccgagtgtcctgacgatcagcgcgcctggaatatctgggaagtcgaggactacggcttcggcatttttacgacaaacatctggctgaaacttcgggatagctatacccagatgtgcgaccacagactcatgtccgccgctattaaagatagcaaggcggttcacgccgacatggggtactggatcgagtctgaaaagaatgagacatggaaactggctcgcgcctccttcatcgaagtgaagacctgtatttggcccaaaagccatacactgtggtctaacggagtgctcgagtccgaaatgatcattccgaagatctatggcgggcctattagccaacacaattaccggcccggatacttcacccagacggccggcccttggcatctggggaaacttgagctggattttgacctctgcgagggaaccacagtcgtggttgatgaacactgcggcaacagaggcccctctctgcgcaccacaaccgtgacggggaagatcatccacgagtggtgttgccggagctgtacactgcctccccttagattccggggagaagacggctgctggtatgggatggagattcgcccggtcaaggagaaagaagagaatctcgtgagatccatggttagcgctggatctggcgaagtggactcctttagcctggggatcctgtgtgtctccattctcatcgaggaagtgatgcggtctaagtggagcagaaaaatgctgatgaccggaacacttgccgttttcctgctcctgattatgggccagctgacctggaacgatcttacccgcctgtgcatcatggtgggcgcgaatgcttccgaccggatggggatgggaacaacgtacctcgccctgatggccacctttaagatgagacctatgttcgctgtcggcctcctgtttcgcagacttacatctcgggaggtgctgctcctgaccattgggctgagccttgtggcctccgtcgagctgcccaactctctcgaggaactgggagatggcctcgcgatggggatcatgatcctgaaacttctgacagacttccaaccccatcagctctggaccacgctgctgagccttacatttattaagaccaccctgtccctcgattatgcttggaagacaatggccatgaccctgagcatcgtttctctcttccctctgtgtctttccacaacgagccagaaaaccacatggctgccggtgctgctcggatcttttggctgcaagcccctgaccatgttccttattacagaaaacaaaatctggggccgcaagtcctggcctattaatgaggggatcatggccgtgggaatcgtcagcattctgctctcttccctgctcaaaaacgacgtgcccctggctggccctcttatcgccgggggaatgctgattgcttgttacgttatcagcggctccagcgccgatctgtctctcgaaaaggcggccgaggtgagctgggaggaagaggctgaacactccgggacctctcataatattctggtcgaggtgcaggacgatggaacgatgaaaatcaaggacgaagagagagatgacacccttacaatcctgctcaaggccaccctgctcgctgttagcggcgtgtatcccatgtccattcctgccacactgtttgtctggtacttctggcagaaaaagaaacagcggtctggcgtgctttgggatacccccagcccgcctgaggtcgaacgcgccgtgctggacgacgggatctatcgcattctgcagcggggactcctgggccgctcccaggttggggtgggagtcttccaagatggcgtgtttcacacaatgtggcatgttacgagaggggctgtgcttatgtaccagggaaagcggctggagccctcttgggcgagcgtcaaaaaggacctcatctcctacggcggcgggtggcgcttccagggaagctggaacaccggcgaagaggtccaggtgattgccgttgagcctgggaagaatcccaaaaacgtccaaacaaccccgggaacctttaagacacctgaaggcgaggtgggggctatcgccctggatttcaaacccggaacgtctggctcccctattgtgaatagagaaggcaagatcgtcgggctctatggaaacggcgtggttaccacaagcgggacctacgtgtctgccatcgctcaggccaaagcgtcccaggagggacccctgcccgaaattgaggacgaggtctttaagaagcggaatcttacaatcatggatctgcaccctggcagcgggaaaaccagacgctatctgccggctattgtgcgggaagccatcaagagaaaactccgcacgctgattcttgcccccacacgggttgtggcttccgagatggccgaagcgctgaagggcatgcctatcagataccaaaccaccgctgtcaaatctgagcacacaggacgcgaaatcgtggacctcatgtgccatgccaccttcacaatgcggctgctgagccccgttagagtgcctaactataatatgattatcatggatgaggcccactttaccgaccccgcttccattgccgctcgcggctacatcagcacgcgggtcgggatgggagaggccgcggccattttcatgacagctacccctccgggctctgtggaagcctttccccagtccaacgctgtgatccaggatgaggaaaaggacatccctgagagaagctggaactctgggtatgattggattacagacttccccggaaagaccgtctggtttgttcctagcatcaaatccggcaacgacattgccaattgtctccggaagaacgggaaacgcgtgatccagctttctagaaagacgttcgataccgaataccagaaaaccaagaacaatgactgggattacgtggtcaccacagacattagcgagatgggcgccaacttccgggctgatcgcgtgatcgaccccagacggtgcctgaagccggttattctgaaagatggacctgagagagtgatcctcgcgggccccatgcccgtcaccgtggcctccgctgcccagcgccgggggagaatcggacgcaatcagaacaaggaaggcgaccagtatgtttacatggggcaacctctgaataacgatgaggaccatgcccactggacagaagctaaaatgcttctggataatattaacacccccgagggaatcattcctgccctctttgagccggaacgggagaagtctgcggctatcgacggcgaatatagactgcgcggggaggcccggaaaacgttcgtggaactgatgagacgcggcgatctccccgtctggcttagctacaaggtggcctccgagggatttcagtatagcgacagacggtggtgcttcgacggcgagcgcaataaccaggtcctggaagagaatatggatgtggaaatttggacaaaagagggggaaagaaagaagctgcggcctcgctggctcgacgctagaacctactctgatcccctggcccttcgggagtttaaagagttcgcggccggaagacgctccgttagcggcgacctgatcctcgaaatcgggaagctgcctcagcatctgaccctccgggctcaaaacgcccttgataatctggtgatgctgcacaactccgagcagggaggcaaggcttatagacacgccatggaggaactccccgacacaattgaaaccctgatgcttctggctctcatcgccgtgctgacaggcggggtcacgctgtttttcctctctggaaagggccttgggaaaaccagcattggactgctgtgtgttatggcgtcctctgccctcctgtggatggctagcgtggagccgcattggatcgccgcttccattatccttgagtttttcctgatggtgctcctgatccctgaacccgatcgccagcggacacctcaggacaatcaactggcctacgtcgtgattggcctcctttttatgatcctgaccgttgccgctaacgagatggggctgctcgaaacaaccaagaaggatctgggaattggccacgtggcggccgagaaccatcaccacgctacgatgcttgacgtcgatctgagacccgccagcgcctggaccctctacgctgtggccacaaccgtcatcacacctatgatgcggcataccattgagaatacgacagcgaacatctctctgaccgccattgctaatcaggccgctatcctgatgggcctcgacaaagggtggcccatctccaagatggatattggagtgccgcttctggccctgggctgctatagccaggttaaccctctcacactgaccgcggccgtgcttatgctggtcgctcactacgccatcattgggcccggactccaagctaaagccacccgcgaagctcagaagagaacagccgcgggcatcatgaaaaatcccacggtggacgggattgttgccatcgacctggatcctgtggtctatgacgctaagttcgagaagcagctgggacagatcatgctccttattctgtgtacctctcaaatcctgctcatgcggacaacctgggccctgtgcgaatccattacacttgctaccggcccgctgacgacactctgggagggcagccccgggaaattttggaacaccaccatcgccgtgtctatggccaatattttccgcggaagctacctggcgggcgctgggctggccttctccctcatgaagtctcttggaggcgggagacggggaacaggcgctcagggcgaaaccctgggggagaaatggaagcgccagctgaaccagctcagcaaatccgagtttaatacatataagagaagcggaatcatggaagtggatcggtccgaggccaaggaaggcctgaaacgcggggagacgaccaagcatgccgtttctagaggaacagctaaacttcggtggttcgtcgaaagaaacctggtgaagcctgagggcaaagtgatcgacctcgggtgtggacgcggcggctggagctactattgcgccgggctgaagaaagtcaccgaggttaagggatacacaaagggcgggcccggacacgaggagcctattcccatggcgacctacggctggaatctggtgaaactccattccgggaaggatgtgtttttcatccctccggaaaaatgtgacacgcttctgtgcgatattggagagtctagccccaaccctaccatcgaagagggccggacactgagagtcctcaagatggtggagccctggctgaaaggcaatcaattttgtattaagatccttaacccttatatgccctccgttgtggaaaccctggagcagatgcagcgcaagcacgggggaatgctcgtccggaatccgctgtctagaaacagcacacacgaaatgtactgggtgtcctgcggcaccgggaatattgttagcgccgtgaacatgacatctcgcatgctgctcaaccggttcaccatggctcatagaaaacctacgtatgagcgcgacgtcgatctgggagccggcacacggcacgtggctgtggagcccgaagtcgccaatcttgacatcatcgggcagagaattgagaacatcaagaatgaacataaatccacctggcactacgatgaggacaacccctataagacctgggcgtaccacggaagctatgaagttaaaccttctggctccgccagctctatggtgaatggcgtggtccgcctgctcacaaagccctgggacgtgattcctatggttacgcaaatcgctatgaccgatacaaccccgtttgggcagcagcgggtgttcaaggagaaagtcgacacaagaacaccccgcgccaagagaggaacagctcaaattatggaggtgaccgccaaatggctgtggggctttctttcccggaacaagaaacctcgcatctgtacgagagaagagttcacccggaaggttagaagcaatgctgccatcggggcggtgtttgtcgatgaaaaccagtggaactccgccaaggaggctgtggaagacgagcggttctgggatctggttcatcgcgagagagaactccacaaacagggaaagtgcgccacatgcgtgtacaacatgatgggcaaacgggagaagaaactgggggaatttggcaaggctaaaggaagccgcgccatttggtacatgtggctgggcgccagattcctcgagttcgaagcgctggggtttatgaatgaggaccattggttctctcgggagaacagcctttccggagtcgaaggcgaggggctgcacaagctcggatatatcctgcgcgatatttctaagatccccggcgggaatatgtacgctgacgataccgccggctgggacacaagaattaccgaagatgaccttcagaacgaggccaaaatcacggatatcatggagcctgaacatgctctgctcgccacagctatttttaagctgacctatcaaaataaagtggtccgggtgcagcgccccgccaagagcggaacagttatggacgtgatctccagacgggaccagcgcggctctgggcaggtcggaacctacggcctgaacacgttcaccaacatggaggcgcaactcattagacagatggaaagcgaggggatctttctgccgtccgaacttgagacacctaatctggccaaacgggtgctcgattggctggagaagtatggagctgaacgccttaagagaatggccatttctggcgacgattgtgtggttaaacccatcgacgatcggttcgctaaggccctgaccgcgctcaacgacatggggaaagtgagaaaggatatccctcagtgggagcccagcaaaggctggaatgactggcagcaagtccctttttgctcccaccacttccatcagctgattatgaaggatggacgcgaaatcgtggttccctgtcggaaccaggacgagctggtgggcagagcccgcgtcagccagggggctggatggtctctccgggaaacagcctgcctgggcaagtcctacgctcaaatgtggcagcttatgtattttcacagacgcgatctgcggctcgccgctaatgccatttgtagcgcggtgccggtcgactgggtgcctacctctagaacaacctggtccatccatgcccaccaccagtggatgacgacagaggacatgctgagcgtttggaaccgcgtgtggattgaggaaaatccctggatggaggataaaacccatgtctcctcttgggaagaggtgccctaccttgggaagcgggaagaccaatggtgcggaagcctgatcggcctcaccgctagagccacatgggccaccaacattcaggttgctatcaatcaggtgcgccggctgatcgggaacgagaattacctggattatatggcctccatgaaaagattcaagaacgagagcgaccctgaaggcgcgctctggtga

SEQ ID NO: 19525 - RNA, 9879 nt, synthetic construct
  misc_feature 1..9879: note = derived and/or modified CDS sequence (opt5) from DENV-1__AF311956__SS-prME
  source 1..9879: mol_type = other RNA
agcgtgaccatgctgctcatgctgcttcccaccgccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagccgccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacattaagttcaccgtcgtggtgggaaatgccaacggcatcctggctcaggggaaaaagatgattcggccgcaacccatggagcacaaatactcctggaagtcttggggaaaggccaaaatcattggcgccgacatccagaataccacatttatcattgatgggcctgacacccccgaatgtcctgatgagcagagagcttggaacatctgggaggtcgaagactatggattcggcatttttacgacaaatatctggctgaaacttcgcgatagctacacccagatgtgcgaccaccggctcatgtccgcggccattaaagatagcaaggctgttcatgccgacatgggctattggatcgagtctgagaagaacgagacatggaagctggccagagcttccttcatcgaagtgaagacctgtatttggcccaaaagccacacactgtggtctaatggggtgctcgagtccgagatgatcattccgaagatgtacggaggccctatcagccaacataactatcgccccgggtacttcacccagacggccggaccttggcacctgggcaaacttgaactggattttgacctctgcgaggggaccacagtcgtggttgatgaacactgcggatctcggggccccagcctgagaaccacaaccgtgacgggcaagattatccatgagtggtgttgccggtcctgtacactgcctccccttcgcttcagaggggaggacggatgctggtacggcatggaaatccggccggtcaaagagaaggaagagaatctcgtgagaagcatggtttctgcggggtccggagaagtggatagcttttccctgggcattctgtgtgtctctatcatgattgaggaggtgatgcgcagccggtggtccagaaagatgctcatgaccgggacactggctgttttccttctgctcatcatgggacagctgacctggaacgacctgattcgcctttgcatcatggtgggcgccaatgcctctgacaaaatgggcatggggaccacatatctggctctcatggccacgtttaagatgagacctatgttcgcggtcggactgctctttcggcgcctgaccagcagagaagtgcttctgctcacaattggcctgtccctggtggcttctgtcgagcttcccaacagcctggaagaactgggggatggactggccatgggcatcatgatgctcaaactgcttaccgagttccaaccccaccagctgtggacaaccctcctgtccctgacgtttatcaagacaacccttagcctggactacgcctggaaaaccacagctatggttctctctattgtgtccctgttccctctctgtctgagcaccacatctcagaagacgacctggcttccggtgctgctggggtcctttggatgcaagcccctcacaatgttcctgatcaccgagaacgagatttggggccggaaaagctggcctcttaatgaaggcatcatggccattgggatcgtctctatcctgctctccagcctgctcaagaacgatgtgcccctggctggacctcttattgccggcgggatgctgatcgcgtgttatgttatttccggaagctctgccgacctgagcctcgagaaagctgccgaagtgtcctgggaggaagaggctgagcattctggcacaagccacaatatcctggtcgaagtgcaggatgacgggaccatgaagattaaagatgaggaacgcgacgatacgcttaccatcctgctcaaggccacactgctcgccgtttccggagtgtaccccatgtctatccctgctaccctgtttgtctggtatttctggcagaagaagaagcagagaagcggcgtgctttgggacacaccctccccgcctgaggtcgagcgggcggtgctggatgacggcatttaccgcatcctgcagagagggctcctgggacggtctcaggttggcgtgggggtcttccaagatggagtgtttcataccatgtggcacgttacacgcggcgccgtgcttatgtatcaggggaaaagactggaacccagctgggcttccgtcaagaaagacctcattagctacggaggcggctggcggttccaggggtcttggaacacgggagaggaagtgcaagtgatcgccgttgagcctggcaagaatcccaaaaacgtccaaaccacaccggggacctttaagacccctgaaggagaggtgggcgccattgctctggacttcaagcccgggacatccggaagccctatcgtgaatagagagggcaaaattgtcggcctctacgggaacggagtggttacgacctctggcacatatgtgtccgccatcgcgcaggctaaggccagccaggaagggcccctgcccgagatcgaagatgaggtctttaaaaagcgcaatcttaccattatggacctgcaccctggatccggcaaaacacggagatacctgccggccatcgtgcgcgaagctattaagcggaagctcagaaccctgatccttgcccccacgcgcgttgtggcgtctgagatggctgaggccctgaaagggatgcctattcggtatcaaacaaccgccgtcaagagcgaacataccggcagagagatcgtggatctcatgtgccacgctacattcaccatgcgcctgctgtcccccgttcgggtgcctaactacaatatgatcattatggacgaagcccattttacagatcccgctagcatcgccgcgagaggatatatttctacccgggtcggcatgggggaggccgctgccatcttcatgacggctacacctccgggatccgtggaagcctttccccagagcaacgccgtgattcaggacgaggagcgcgatatccctgaaagatcttggaatagcggctacgactggatcaccgatttccccgggaaaacagtctggtttgttccttccattaagtctggaaacgacatcgctaattgtctccggaaaaacggcaagcgcgtgattcagcttagcagaaagaccttcgatacggagtatcagaaaaccaagaacaatgactgggactacgtggtcacaaccgatatctccgaaatgggggcgaacttccgggccgacagagtgattgatccccgccggtgcctgaaaccggttatcctgaaggacggccctgagagagtgattctcgctggacccatgcccgtcacagtggcctctgccgctcagcgccggggcagaatcgggcgcaatcagaacaaagagggagatcagtacgtttatatgggccaacctctgaataacgacgaagatcacgcccattggaccgaggcgaagatgcttctggacaatatcaacacacccgaagggattatccctgctctctttgagccggaacgggaaaagagcgccgccattgatggagagtacagactgcgcggcgaagctagaaaaaccttcgtggagctgatgcggcgcggggacctccccgtctggctttcctataaggtggccagcgaaggctttcagtactctgatagacggtggtgcttcgacggagagcgcaataaccaggtcctggaagagaatatggatgtggagatctggacgaaagaaggcgagagaaagaaactgcggcctagatggctcgacgcgcgcacatattccgaccccctggcccttcgggaatttaaggagttcgctgccgggagacgcagcgtttccggagatctgattctcgaaatcggcaaactgcctcagcacctgaccctccgggctcaaaacgcccttgacaatctggtgatgctgcacaactctgagcaagggggaaaggcttacagacatgccatggaggaactccccgataccatcgagacactgatgcttctggcgctcattgccgtgctgaccggcggcgtcacactgtttttcctcagcgggaagggacttggcaaaacgtccatcgggctgctgtgtgttaccgcttctagcgccctcctgtggatggcttccgtggaaccgcactggattgccgccagcatcattcttgagtttttcctgatggtgctcctgatccctgagcccgaccggcagcgcacacctcaggataatcaactggcttatgtcgtgatcggactcctttttatgattctgaccgttgcggccaacgaaatgggcctgctcgagacaaccaagaaagacctggggatcggacatgtggctgccgaaaaccaccagcacgccacgattcttgatgtcgacctgcatcccgcttctgcctggaccctctacgcggtggccacaaccgtcatcacacctatgatgagacacaccattgagaatacgacagctaacatctccctgaccgccattgctaatcaggccgcgatcctgatgggcctcgataagggctggcccatcagcaaaatggaccttggggtgccgctgctggccctcggatgctactctcaagttaaccctctgacacttaccgctgccgtgctgatgctcgtcgctcattatgccattatcggccccgggctgcaggctaaggccacccgggaagcgcagaagcgcacagccgctggaattatgaaaaatcccacggtggatggcatcgttgccattgacctggatcctgtggtctacgacgctaagttcgagaaacagctcgggcaaatcatgcttctgatcctgtgtacctcccagattctcctgatgagaacaacctgggccctttgcgagagcatcacactggccaccggaccgctcacgacactgtgggaaggctctcccggcaagttttggaacaccaccattgcggtgagcatggctaatatcttccgggggtcctatctggccggagctggcctcgccttctctcttatgaaaagcctcgggggaggccgcagagggacaggagcccagggcgagaccctgggcgaaaagtggaagcggcagctcaaccaactgtccaaaagcgagtttaatacatacaagcgctccgggattatggaagtggacagatctgaggctaaagagggacttaagcggggcgaaacgaccaaacacgccgttagcagagggacagcgaagctgcgctggttcgtcgagcggaacctcgtgaagcctgaaggaaaagtgatcgatctgggctgtgggagaggaggctggtcctattactgcgccggcctgaagaaagtcaccgaggttaaggggtatacaaaaggaggccccgggcatgaggaacctatccccatggctacctacggatggaatctcgtgaaacttcactctggcaaagacgtgtttttcatgcctccggagaagtgtgatacgctgctgtgcgacattggggaaagctcccccaaccctaccatcgaggaaggacgcacactccgggtcctgaagatggtggagccctggcttagaggcaatcagttttgtattaaaatcctgaacccttacatgccctctgttgtggagaccctcgaacagatgcagcgcaagcacggcgggatgctggtccggaatccgctgagcagaaactccacacatgagatgtattgggtgagctgcggaaccggcaatattgtttctgccgtgaacatgacatcccgcatgctcctgaaccggttcaccatggctcacagaaaacctacgtacgaacgcgatgtcgaccttggggccggaacacggcatgtggcggtggagcccgaagtcgccaatctggatatcattggccaaagaatcgagaacatcaagaatgagcacaaaagcacctggcactatgacgaagataacccctacaagacctgggcttatcatgggtcttacgaggttaagccttccggaagcgcctcttccatggtgaatggcgtggtccgcctcctgacaaaaccctgggacgtgattcctatggttacgcagatcgctatgaccgatacaaccccgtttggccagcaaagagtgttcaaggaaaaagtcgacacacggacaccccgcgccaagagagggacagctcagattatggaggtgaccgccaaatggctttggggatttctgagccggaacaagaagcctagaatctgtacgcgggaagagttcacccgcaaagttagatccaatgcggccattggcgctgtgtttgtcgacgagaaccagtggaatagcgccaaggaagctgtggaggatgaacggttctgggacctcgttcaccgcgagagagaactgcataaacaggggaagtgcgccacatgcgtgtataacatgatgggaaaacgggagaagaagctgggcgagtttgggaaagccaagggctctcgcgcgatctggtacatgtggctcggagctagattcctggagttcgaggcccttggctttatgaatgaagatcactggttcagccgggagaactccctgtctggggtcgagggagaaggcctccataaactggggtacatccttcgcgacattagcaagatccccggaggcaatatgtatgccgatgacaccgctgggtgggatacaagaattaccgaggacgatctgcaaaacgaagccaaaatcacggacattatggagcctgaacacgctctcctggccacatccatctttaagctgacctaccagaataaagtggtccgggtgcagcgccccgcgaagaacggcacagttatggatgtgatctctagacgggaccagcgcggaagcggccaagtcgggacctatggactcaacacgttcaccaatatggaggtgcagctgattagacagatggagtccgaaggcatctttttcccgtctgagcttgaaagccctaacctggccgagcgggtgctcgattggctggaaaagcacggggctgagagacttaaacgcatggccatttccggagacgactgtgttgtgaagcccatcgatgaccggtttgctacagccctgattgcgctcaatgatatgggcaaagtcagaaaggacatccctcagtgggagcccagcaaagggtggaacgattggcaacaggtgcctttctgctctcatcactttcatcagctgatcatgaaggacggccgcgaaattgttgtgccctgtcggaatcaggatgagctggtcggcagagctcgcgtgtcccaaggagctgggtggagcctccgggaaaccgcctgcctgggaaagtcttacgctcagatgtggcagcttatgtatttccacagacgcgacctgcggctcgccgctaacgccatctgttccgcggtcccggtggattgggttcctacaagcagaaccacatggtccattcacgcccatcaccaatggatgaccacggaggacatgctgtctgtgtggaatcgcgtctggatcgaagagaacccctggatggaggataaaacacatgtgagctcctgggaagaggttccctaccttggcaagcgggaagaccagtggtgcgggagcctgattggactcaccgctagagccacctgggccacaaatatccaggtggctattaaccaggtccggagactgatcggcaatgagaactatctggactacatgacctctatgaaacgctttaagaatgagtccgatcctgaaggggccctctggtga

SEQ ID NO: 19526 - RNA, 9879 nt, synthetic construct
  misc_feature 1..9879: note = derived and/or modified CDS sequence (opt5) from DENV-1__AF311958__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcaccctcacactggactgtagccccagaaccggccttgatttcaacgaaatggtgctgctcacgatgaaagagaagtcttggctggtccataaacagtggtttcttgacctgcctctcccctggacatccggggccagcacctcccaagagacatggaatcggcaggatctgctggtgaccttcaagaccgctcacgcgaagaaacaggaagtcgtggttctcggatctcaagagggcgccatgcacacagctctgacgggggccaccgaaattcagacaagcggaaccacaaccatctttgccggccatcttaagtgccgcctgaaaatggacaagctcacgctgaaagggacatcctatgtgatgtgtaccggcagcttcaagctggagaaggaagtcgctgagacccagcacggaacagtgcttgttcaggtgaaatacgagggcaccgatgccccgtgcaagattcctttctctacacaagacgaaaaaggggtcacgcagaacggaagactcatcaccgcgaatcccatcgtgacagataaggagaaacctgtgaacattgaaaccgagcccccctttggcgagtcctatatcgttgtcggggctggagaaaaggccctgaagctgagctggttcaaaaagggctctagcattgggaaaatgtttgaggccacagctcggggcgccagacgcatggctatcctcggagacaccgcctgggatttcggctccattgggggagtgtttacgtctgtgggcaagctggtccatcaggtgttcgggaccgcgtacggagttctttttagcggcgtgtcctggacaatgaaaatcgggatcggcattctgctcacctggctgggactgaatagccggtctacatcccttagcatgacctgtatcgccgtcggcatggtgacactctacctgggggttatggtgcaggctgactctggatgcgtcattaactggaagggcagagaactgaagtgtgggtccggaatcttcgtgaccaacgaggttcacacgtggacagaacaatataaatttcaggccgatagccctaagcgcctctccgctgccattggccgggcgtgggaggagggggtgtgcggcatcagatctgccacccgcctggaaaatattatgtggaaacagatcagcaacgagcttaatcatatcctgctcgaaaacgacattaagttcaccgtcgtggtgggaaatgctaacggcatcctggcccaggggaaaaagatgattcggccgcaacccatggagcacaaatactcctggaagtcttggggaaaggctaaaatcattggcgccgacatccagaatacaacctttatcattgatgggcctgacacgcccgaatgtcctgatgagcagagagcctggaacatctgggaggtcgaagactatggattcggcatttttacaaccaatatctggctgaagcttcgcgatagctacacacagatgtgcgaccaccggctcatgtccgctgcgattaaagatagcaaggccgttcatgctgacatgggctattggatcgagtctgaaaaaaacgagacctggaagctggccagagcctccttcatcgaagtgaagacatgtatttggcccaaaagccacaccctgtggtctaatggggtgctcgagtccgagatgatcattccgaagatgtacggaggccctatcagccaacataactatcgccccgggtacttcacgcagaccgctggaccttggcacctgggcaaacttgaactggattttgacctctgcgaggggacaaccgtcgtggttgatgaacactgcggatctcggggccccagcctgagaacaaccacggtgacaggcaagattatccatgagtggtgttgccggtcctgtaccctgcctccccttcgcttcagaggggaggacggatgctggtacggcatggaaatccggccggtcaaagagaaggaagagaatctcgtgagaagcatggtttctgccgggtccggagaagtggatagcttttccctgggcattctgtgtgtctctatcatgattgaggaggtgatgcgcagccggtggtccagaaagatgctcatgacagggaccctggcggttttccttctgctcatcatgggacagctgacctggaacgacctgattcgcctttgcatcatggtgggcgctaatgcctctgacaaaatgggcatggggacaacgtatctggccctcatggctacctttaagatgagacctatgttcgccgtcggactgctctttcggcgcctgacaagcagagaagtgcttctgctcaccattggcctgtccctggtggcgtctgtcgagcttcccaacagcctggaagagctcggggatggactggctatgggcatcatgatgctcaaactgcttacagaattccaaccccaccagctgtggaccacgctcctgtccctgacatttatcaagaccacccttagcctggactacgcctggaaaacaaccgccatggttctctctattgtgtccctgttccctctctgtctgagcacaacgtctcagaagaccacatggcttccggtgctgctggggtcctttggatgcaagcccctcaccatgttcctgatcacagagtatgagatttggggccggaaaagctggcctcttaacgaaggcatcatggctattgggatcgtctctatcctgctctccagcctgctcaagaatgatgtgcccctggccggacctcttattgctggcgggatgctgatcgcctgttacgttatttccggaagctctgcggacctgagcctcgagaaagccgctgaagtgtcctgggaggaagaggccgagcattctggcaccagccacaacatcctggtcgaagtgcaggatgacgggacgatgaagattaaagatgaggaacgcgacgatacccttacaatcctgctcaaggctaccctgctcgccgtttccggagtgtatcccatgtctatccctgccacactgtttgtctggtacttctggcaaaaaaagaagcagagaagcggcgtgctttgggacaccccctccccgcctgaggtcgagcgggctgtgctggatgacggcatttatcgcatcctgcagagagggctcctgggacggtctcaggttggcgtgggggtcttccaagatggagtgtttcatacaatgtggcacgttacgcgcggcgcggtgcttatgtaccaggggaaaagactggaacccagctgggcctccgtcaagaaagacctcattagctacggaggcggctggcggttccaggggtcttggaataccggagaggaagtgcaggtgatcgctgttgagcctggcaagaaccccaaaaatgtccaaacaaccccggggacctttaagacacctgaaggagaggtgggcgccattgccctggacttcaagcccgggacgtccggaagccctatcgtgaacagagagggcaaaattgtcggcctctatgggaatggagtggttaccacatctggcacctacgtgtccgctatcgcccaggcgaaggctagccaggaagagcccctgcccgaaatcgaggatgaagtctttaaaaagcgcaaccttacaattatggacctgcaccctgggtccggaaaaacccggagatatctgccggccatcgtgcgcgaggccattaagcggaagctcagaacgctgatccttgctcccacacgcgttgtggcctctgagatggcggaagctctgaaaggcatgcctattcggtaccaaaccaccgccgtcaagagcgagcatacagggagagaaatcgtggatctcatgtgccacgccaccttcacaatgcgcctgctgtcccccgttcgggtgcctaattataacatgatcattatggacgaggctcattttaccgatcccgccagcatcgctgccagaggctacatttctacgcgggtcggaatgggcgaagcggccgctatcttcatgacagccacccctccggggtccgtggaggcttttccccagagcaatgccgtgattcaggacgaggaacgcgatatccctgagagatcttggaacagcggatatgactggatcacagatttccccggcaaaaccgtctggtttgttccttccattaagtctgggaatgacatcgccaactgtctccggaaaaatggaaagcgcgtgattcagcttagcagaaagacgttcgataccgaataccaaaaaacaaagaacaacgactgggactacgtggtcaccacagatatctccgagatgggcgctaatttccgggcggacagagtgattgatccccgccggtgcctgaaaccggttatcctgaaggacgggcctgagagagtgattctcgccggccccatgcccgtcaccgtggcttctgccgcccagcgccggggaagaatcggccgcaaccagaataaagaaggggatcagtatgtttacatgggacaacctctgaacaatgacgaggatcacgctcattggacagaagccaagatgcttctggacaacatcaatacccccgagggcattatccctgcgctctttgaaccggagcgggagaagagcgctgccattgatggggaatatagactgcgcggagaggccagaaaaacgttcgtggaactgatgcggcgcggcgacctccccgtctggctttcctacaaggtggctagcgaggggtttcagtattctgatagacggtggtgcttcgacggcgaacgcaacaatcaggtcctggaggagaacatggatgtggaaatctggacaaaagagggagaaagaaagaaactgcggcctagatggctcgacgcccgcacctactccgaccccctggcgcttcgggagtttaaggaattcgccgctggcagacgcagcgtttccggggatctgattctcgagatcggaaaactgcctcagcacctgaccctccgggcccaaaatgctcttgacaacctggtgatgctgcacaattctgagcagggcgggaaggcctatagacatgctatggaagagctccccgatacaatcgaaaccctgatgcttctggccctcattgcggtgctgacaggaggcgtcacgctgtttttcctcagcggcaaggggcttggaaaaacctccatcggcctgctgtgtgttacagcctctagcgctctcctgtggatggcctccgtggagccgcactggattgctgccagcatcattcttgagtttttcctgatggtgctcctgatccctgaacccgaccggcagcgcacccctcaggataaccaactggcctacgtcgtgatcgggctcctttttatgattctgacagttgctgcgaatgagatgggactgctcgaaaccacgaagaaagacctgggcatcgggcatgtggccgctgagaaccaccagcacgccaccatgcttgatgtcgacctgcatcccgcctctgcttggacactctacgccgtggcgaccacagtcattacccctatgatgagacacacgatcgaaaacacaaccgccaatatttccctgacagctatcgccaaccaggctgccattctgatgggactcgataagggctggcccatcagcaaaatggaccttggcgtgccgctgctggcgctcgggtgctattctcaagttaatcctctgacccttaccgccgctgtgctgatgctcgtcgcccattacgctatcattggacccggcctgcaggccaaggctacacgggaggcccagaagcgcacggcggccgggatcatgaaaaaccccaccgtggatggaattgttgctatcgacctggatcctgtggtctatgacgccaagttcgagaaacagctcggccaaattatgcttctgatcctgtgtacatcccagatcctcctgatgagaaccacatgggctctttgcgaaagcattaccctggccacggggccgctcacaaccctgtgggagggatctcccggcaagttttggaataccacaatcgccgtgagcatggcgaacattttccggggctcctacctggctggggccggactcgctttctctcttatgaaaagcctgggcgggggacgcagaggcaccggggcccagggagaaacactgggcgagaagtggaagcggcagctcaatcaactgtccaaaagcgaatttaacacgtataagcgctccggcatcatggaggtggacagatctgaggccaaagaagggcttaagcggggagagaccacaaaacacgctgttagcagaggcgccgcgaagctgcgctggttcgtcgaacggaatctcgtgaagcctgaggggaaagtgattgatctgggatgtggcagagggggatggtcctactattgcgccggcctgaagaaagtcaccgaagttaagggctacacaaaagggggacccggccatgaggagcctatccccatggctacctacgggtggaacctcgtgaagcttcactctggaaaagacgtgtttttcatgcctccggaaaagtgtgatacgctgctgtgcgacatcggcgagagctcccccaatcctaccattgaagaggggcgcacactccgggtcctgaagatggtggagccctggcttagaggaaaccagttttgtatcaaaattctgaatccttatatgccctctgttgtggaaaccctcgagcagatgcagcgcaagcacggcggcatgctggtccggaacccgctgagcagaaattccacacatgaaatgtactgggtgagctgcgggaccggaaacatcgtttctgccgtgaatatgacatcccgcatgctcctgaaccggttcaccatggctcacagaaaacctacgtatgagcgcgatgtcgaccttggcgccgggacacggcatgtggcggtggaacccgaggtcgccaacctggatattatcggacaaagaattgagaatatcaagaacgaacacaaaagcacctggcactacgacgaggataatccctataagacctgggcttaccatggctcttatgaagttaagccttccgggagcgcctcttccatggtgaacggagtggtccgcctcctgacaaaaccctgggacgtgatccctatggttacgcagattgctatgaccgatacaaccccgtttggccagcaaagagtgttcaaggagaaagtcgacacacggaccccccgcgccaagagaggcacagctcagatcatggaagtgaccgccaaatggctttgggggtttctgagccggaataagaagcctagaatttgtacgcgggaggagttcacccgcaaagttagatccaacgcggccatcggagctgtgtttgtcgacgaaaatcagtggaacagcgccaaggaggctgtggaagatgagcggttctgggacctcgttcaccgcgaaagagagctgcataaacagggcaagtgcgccacatgcgtgtacaatatgatggggaaacgggagaagaagctgggagaatttggcaaagccaaggggtctcgcgcgatttggtacatgtggctcggcgctagattcctggagttcgaagcccttggatttatgaacgaggatcactggttcagccgggagaattccctgtctggcgtcgaaggggagggactccataaactgggctatatccttcgcgacatcagcaagattcccgggggaaacatgtacgccgatgacaccgctggctgggatacaagaatcaccgaagacgatctgcaaaatgaggccaaaattacggacatcatggaacctgagcacgctctcctggccacatccatttttaagctgacctatcagaacaaagtggtccgggtgcagcgccccgcgaagaatgggacagttatggatgtgatctctagacgggaccagcgcggcagcggacaagtcggcacctacgggctcaacacgttcaccaacatggaggtgcagctgatcagacagatggaatccgagggaatttttttcccgtctgaacttgagagccctaatctggccgaacgggtgctcgattggctggagaagcacggcgctgagagacttaaacgcatggccatctccggggacgactgtgttgtgaagcccattgatgaccggtttgctacagccctgatcgcgctcaacgatatgggaaaagtcagaaaggacattcctcagtgggaacccagcaaaggctggaatgattggcaacaggtgcctttctgctctcatcactttcatcagctgatcatgaaggacgggcgcgagatcgttgtgccctgtcggaaccaggatgaactggtcggcagagcccgcgtgtcccaaggagctggctggagcctccgggagaccgcctgcctggggaagtcttatgctcagatgtggcagcttatgtacttccacagacgcgacctgcggctcgccgctaatgccatttgttccgcggtcccggtggattgggttcctacaagcagaaccacatggtccatccacgcccatcaccaatggatgaccacggaagacatgctgtctgtgtggaaccgcgtctggattgaggagaatccctggatggaagataaaacacatgtgagctcctgggaggaagttccctatcttggaaagcgggaggaccagtggtgcggcagcctgatcgggctcaccgctagagccacctgggccacaaacattcaggtggctatcaatcaggtccggagactgattggaaacgagaattacctggactacatgacctctatgaaacgctttaagaacgaatccgatcctgagggcgccctctggtga

SEQ ID NO: 19527 - RNA, 9879 nt, synthetic construct
  misc_feature 1..9879: note = derived and/or modified CDS sequence (opt5) from DENV-1__AF311957__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagagcaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggacgtcctatgtgatgtgtacaggcagcttcaagctggagaaggaagtcgccgagacccagcacggaaccgtgcttgttcaggtgaaatacgagggcacagatgcgccgtgcaagattcctttctctacccaagacgaaaaaggggtcacacagaacggaagactcatcacggctaatcccatcgtgaccgataaggagaaacctgtgaacattgaaacagagcccccctttggcgagtcctatatcgttgtcggggccggagaaaaggccctgaagctgagctggttcaaaaagggctctagcattgggaaaatgtttgaggctaccgcccggggcgctagacgcatggccatcctcggagacacagcgtgggatttcggctccattgggggagtgtttacctctgtgggcaagctggtccatcaggtgttcgggacggcctacggagttctttttagcggcgtgtcctggaccatgaaaatcgggatcggcattctgctcacatggctgggactgaatagccggtctacctcccttagcatgacatgtatcgctgtcggcatggtgaccctctacctgggggttatggtgcaggccgactctggatgcgtcattaactggaagggcagagaactgaagtgtgggtccggaatcttcgtgacaaacgaggttcacacctggacggaacaatataaatttcaggctgatagccctaagcgcctctccgccgcgattggccgggcctgggaggagggggtgtgcggcatcagatctgctacacgcctggaaaatattatgtggaaacagatcagcaacgagcttaatcatatcctgctcgaaaacgacattaagttcaccgtcgtggtgggaaatgccaacggcatcctggctcaggggaaaaagatgattcggccgcaacccatggagcacaaatactcctggaagtcttggggaaaggccaaaatcattggcgccgacatccagaataccacatttatcattgatgggcctgacacccccgaatgtcctgatgagcagagagcttggaacatctgggaggtcgaagactatggattcggcatttttacgacaaatatctggctgaagcttcgcgatagctacacccagatgtgcgaccaccggctcatgtccgcggccattaaagatagcaaggctgttcatgccgacatgggctattggatcgagtctgaaaaaaacgagacatggaagctggccagagcttccttcatcgaagtgaagacctgtatttggcccaaaagccacacactgtggtctaatggggtgctcgagtccgagatgatcattccgaagatgtacggaggccctatcagccaacataactatcgccccgggtacttcacccagacggccggaccttggcacctgggcaaacttgaactggattttgacctctgcgaggggaccacagtcgtggttgatgaacactgcggatctcggggccccagcctgagaaccacaaccgtgacgggcaagattatccatgagtggtgttgccggtcctgtacactgcctccccttcgcttcagaggggaggacggatgctggtacggcatggaaatccggccggtcaaagagaaggaagagaatctcgtgagaagcatggtttctgcggggtccggagaagtggatagcttttccctgggcattctgtgtgtctctatcatgattgaggaggtgatgcgcagccggtggtccagaaagatgctcatgaccgggacactggctgttttccttctgctcatcatgggacagctgacctggaacgacctgattcgcctttgcatcatggtgggcgccaatgcctctgacaaaatgggcatggggaccacatatctggctctcatggccacgtttaagatgagacctatgttcgcggtcggactgctctttcggcgcctgaccagcagagaagtgcttctgctcacaattggcctgtccctggtggcttctgtcgagcttcccaacagcctggaagagctcggggatggactggccatgggcatcatgatgctcaaactgcttaccgaattccaaccccaccagctgtggacaaccctcctgtccctgacgtttatcaagacaacccttagcctggactacgcctggaaaaccacagctaccgttctctctattgtgtccctgttccctctctgtctgagcacaacgtctcagaagaccacatggcttccggtgctgctggggtcctttggatgcaagcccctcaccatgttcctgatcacagagaacgagatttggggccggaaaagctggcctcttaatgaaggcatcatggccattgggatcgtctctatcctgctctccagcctgctcaagaacgatgtgcccctggctggacctcttattgccggcgggatgctgatcgcgtgttatgttatttccggaagctctgccgacctgagcctcgagaaagctgccgaagtgtcctgggaggaagaggctgagcattctggcaccagccacaatatcctggtcgaagtgcaggatgacgggacgatgaagattaaagatgaggaacgcgacgatacccttacaatcctgctcaaggccaccctgctcgccgtttccggagtgtaccccatgtctatccctgctacactgtttgtctggtatttctggcaaaaaaagaagcagagaagcggcgtgctttgggacaccccctccccgcctgaggtcgagcgggcggtgctggatgacggcatttaccgcatcctgcagagagggctcctgggacggtctcaggttggcgtgggggtcttccaagatggagtgtttcatacaatgtggcacgttacgcgcggcgccgtgcttatgtatcaggggaaaagactggaacccagctgggcttccgtcaagaaagacctcattagctacggaggcggctggcggttccaggggtcttggaacaccggagaggaagtgcaggtgatcgccgttgagcctggcaagaatcccaaaaacgtccaaacaaccccggggacctttaagacacctgaaggagaggtgggcgccattgctctggacttcaagcccgggacgtccggaagccctatcgtgaatagagagggcaaaattgtcggcctctacgggaacggagtggttaccacatctggcacctatgtgtccgccatcgcgcaggctaaggccagccaggaagggcccctgcccgagatcgaagatgaggtctttaaaaagcgcaatcttacaattatggacctgcaccctggatccggcaaaacccggagatacctgccggccatcgtgcgcgaagctattaagcggaagctcagaacgctgatccttgcccccacacgcgttgtggcgtctgagatggctgaggccctgaaagggatgcctattcggtatcaaaccaccgccgtcaagagcgaacatacaggcagagagatcgtggatctcatgtgccacgctaccttcacaatgcgcctgctgtcccccgttcgggtgcctaactacaatatgatcattatggacgaagcccattttaccgatcccgctagcatcgccgcgagaggatatatttctacgcgggtcggcatgggggaggccgctgccatcttcatgacagctacccctccgggatccgtggaagcctttccccagagcaacgccgtgattcaggacgaggagcgcgatatccctgaaagatcttggaatagcggctacgactggatcacagatttccccgggaaaaccgtctggtttgttccttccattaagtctggaaacgacatcgctaattgtctccggaaaaacggcaagcgcgtgattcagcttagcagaaagacgttcgataccgagtatcaaaaaacaaagaacaatgactgggactacgtggtcaccacagatatctccgaaatgggggcgaacttccgggccgacagagtgattgatccccgccggtgcctgaaaccggttatcctgaaggacggccctgagagagtgattctcgctggacccatgcccgtcaccgtggcctctgccgctcagcgccggggcagaatcgggcgcaatcagaacaaagagggagatcagtacgtttatatgggccaacctctgaataacgacgaagatcacgcccattggacagaggcgaagatgcttctggacaatatcaacacccccgaagggattatccctgctctctttgagccggaacgggagaagagcgccgccattgatggagagtacagactgcgcggcgaagctagaaaaacgttcgtggagctgatgcggcgcggggacctccccgtctggctttcctataaggtggccagcgaaggctttcagtactctgatagacggtggtgcttcgacggagagcgcaataaccaggtcctggaagagaatatggatgtggagatctggacaaaagaaggcgagagaaagaaactgcggcctagatggctcgacgcgcgcacctattccgaccccctggcccttcgggaatttaaggagttcgctgccgggagacgcagcgtttcctctgatctgattctcgaaatcggaaaactgcctcagcacctgaccctccgggctcaaaacgcccttgacaatctggtgatgctgcacaacagcgagcagggcgggaaggcttacagacatgccatggaggaactccccgatacaatcgagaccctgatgcttctggcgctcattgccgtgctgacaggaggcgtcacgctgtttttcctctccggcaaggggcttggaaaaacctctatcggcctgctgtgtgttacagctagctccgccctcctgtggatggctagcgtggaaccgcactggattgccgcctctatcattcttgagtttttcctgatggtgctcctgatccctgagcccgaccggcagcgcacccctcaggataatcaactggcttatgtcgtgatcgggctcctttttatgattctgacagttgcggccaacgaaatgggactgctcgagaccacgaagaaagacctgggcatcgggcatgtggctgccgaaaaccaccagcacgccaccatgcttgatgtcgacctgcatcccgcttccgcctggacactctacgcggtggccaccacagtcattacccctatgatgagacacacgatcgagaatacaaccgctaacattagcctgacagccatcgctaatcaggccgcgattctgatgggactcgataagggctggcccatctctaaaatggaccttggcgtgccgctgctggccctcgggtgctactcccaagttaaccctctgacccttaccgctgccgtgctgatgctcgtcgctcattatgccatcattggacccggcctgcaggctaaggccacacgggaagcgcagaagcgcacggccgctgggatcatgaaaaatcccaccgtggatggaattgttgccatcgacctggatcctgtggtctacgacgctaagttcgagaaacagctcggccaaattatgcttctgatcctgtgtacaagccagatcctcctgatgagaaccacatgggccctttgcgagtctattaccctggccacggggccgctcacaaccctgtgggaaggaagccccggcaagttttggaacaccacaatcgcggtgtccatggctaatattttccggggctcttatctggccggggctggactcgccttcagccttatgaaatccctgggcgggggacgcagaggcaccggggcccagggagagacactgggcgaaaagtggaagcggcagctcaaccaactgagcaaatccgagtttaatacgtacaagcgctctggcatcatggaagtggacagaagcgaggctaaagaggggcttaagcggggagaaaccacaaaacacgccgtttccagaggcaccgcgaagctgcgctggttcgtcgagcggaacctcgtgaagcctgaagggaaagtgattgatctgggatgtggcagagggggatggtcttattactgcgccggcctgaagaaagtcacagaggttaagggctataccaaagggggacccggccatgaagagcctatccccatggctacgtacgggtggaatctcgtgaagcttcacagcggaaaagacgtgtttttcatccctccggagaagtgtgataccctgctgtgcgacattggcgaatcctctcccaaccctacaatcgaggaagggcgcaccctccgggtcctgaagatggtggagccctggcttagaggaaatcagttttgtattaaaatcctgaacccttacatgcccagcgttgtggagacactcgaacagatgcagcgcaagcacggcggcatgctggtccggaatccgctgtccagaaacagcacccatgagatgtattgggtgtcttgcgggacaggaaatattgtttccgccgtgaacatgaccagccgcatgctcctgaaccggttcacgatggctcacagaaaacctacatacgaacgcgatgtcgaccttggcgccgggacccggcatgtggcggtggagcccgaagtcgccaatctggatatcattggacaaagaatcgagaacatcaagaatgagcacaaatctacctggcactatgacgaagataacccctacaagacatgggcttatcatggctcctacgaggttaagcctagcgggtctgcctccagcatggtgaatggagtggtccgcctcctgacgaaaccctgggacgtgattcctatggttacccagatcgctatgacagataccacaccgtttggccagcaaagagtgttcaaggaaaaagtcgacacccggacaccccgcgccaagagaggcaccgctcagattatggaggtgacggccaaatggctttgggggtttctgtcccggaacaagaagcctagaatctgtacccgggaagagttcacacgcaaagttagaagcaatgcggccattggagctgtgtttgtcgacgagaaccagtggaattctgccaaggaagctgtggaggatgaacggttctgggacctcgttcaccgcgagagagaactgcataaacagggcaagtgcgccacctgcgtgtataacatgatggggaaacgggagaagaagctgggagagtttggcaaagccaaggggagccgcgcgatctggtacatgtggctcggcgctagattcctggaattcgaggcccttggatttatgaatgaagatcactggttctcccgggagaactctctgagcggcgtcgagggggaaggactccataaactgggctacatccttcgcgacatttccaagatccccgggggaaatatgtatgccgatgacacagctggctgggataccagaattacggaggacgatctgcaaaacgaagccaaaatcacagacattatggagcctgaacacgctctcctggccacctctatctttaagctgacataccagaataaagtggtccgggtgcagcgccccgcgaagaacgggaccgttatggatgtgatcagcagacgggaccagcgcggctccggacaagtcggcacgtatgggctcaacaccttcacaaatatggaggtgcagctgattagacagatggagtctgaaggaatctttttcccgagcgagcttgaatcccctaacctggccgagcgggtgctcgattggctggaaaagcacggcgctgagagacttaaacgcatggccattagcggggacgactgtgttgtgaagcccatcgatgaccggtttgctaccgccctgattgcgctcaatgatatgggaaaagtcagaaaggacatccctcagtgggagccctctaaaggctggaacgattggcaacaggtgcctttctgctcccatcactttcatcagctgatcatgaaggacgggcgcgaaattgttgtgccctgtcggaatcaggatgagctggtcggcagagcccgcgtgagccaaggagctggctggtctctccgggaaacagcctgcctggggaagtcctacgctcagatgtggcagcttatgtatttccacagacgcgacctgcggctcgccgctaacgccatctgtagcgcggtcccggtggattgggttcctacctccagaacaacctggtctattcacgcccatcaccaatggatgacgacagaggacatgctgagcgtgtggaatcgcgtctggatcgaagagaacccctggatggaggataaaacccatgtgtccagctgggaagaggttccctaccttggaaagcgggaagaccagtggtgcggctctctgattgggctcaccgctagagccacatgggccaccaatatccaggtggctattaaccaggtccggagactgatcggaaatgagaactatctggactacatgacatccatgaaacgctttaagaatgagagcgatcctgaaggcgccctctggtga

SEQ ID NO: 19528 - RNA, 9879 nt, synthetic construct
  misc_feature 1..9879: note = derived and/or modified CDS sequence (opt5) from DENV-1__EU280167__SS-prME
  source 1..9879: mol_type = other RNA
agcgtgaccatgctgctcacactgatgcccacggcccttgctttccacctgaccacaagaggaggggagcctcatatgatcgtctccaagcaggaacggggaaaatctctcctgtttaagacctccgccggcgttaatatgtgcacacttattgcgatggacctgggggagctctgtgaagataccgtgacatacaaatgcccgcgcatcaccgaggctgaacccgacgatgtggactgttggtgcaatgccacggatacctgggtcacatatggaacctgttcccaaacaggcgagcacagacgggacattcgctctgtggccctggctcctcatgttgggctgggactcgagaccagaacggaaacatggatgagctccgagggcgcctggaagcagatccagcgggtggatacctgcgtcctgcgccaccccggcttcacagtgattgctctttttctggcccatgcgatcgggacctctatcagccagaaaggaattatcttcattctcctgatgcttgttaccccttccatgacaatgagatgtgtgggcatcgggagccgggactttgtcgaaggactgtctggcgccacgtgggtggatgtggtcctcgagcacgggtcctgcgttaccagcatggctaaggacaagcccacactggatattgagctgctcaaaaccgaagtgcctaacccggccgtgctgcgcaaactttgtatcgaggctaaaatttctaatacaaccacggactccagatgccccacacaaggagaagccaccctggtcgaggaacaggatgcgaacttcgtgtgtcggcgcacctttgttgacagaggctggggcaatgggtgcggactcttcggcaaggggagcctgcttacatgcgacaaatttaagtgtgtgaccaagctggagggaaaaatcatccagtacgagaacttcaagtattctgtcattgtgacagttcacacgggcgatcagcatcaagtggggaatgaatccaccgagcacggaacaaccgccacaatcacccctcaggctcccacgaccgaaattcagctcacagactacggcgccctgaccctggattgcagccctcggacaggcctcgactttaacgagatggtcctgcttaccatgaaagaaaagtcctggctggtgcataaacagtggttcctcgatctgccccttccgtggacgtctggggctagcacatcccgcgagacctggaatagacaagacctgctcgtcacatttaagaccgcccacgccaaaaagcaggaggtggttgtgctgggaagccaggaaggcgctatgcacaccgcgctgacaggggccacggagatccaaacctctggaacaaccacaattttcgctggccatctcaagtgtcggctgaaaatggataaacttaccctgaaagggatgtcctatgtcatgtgcacgggcagcttcaagctcgaaaaagaggtggccgaaacacagcacggaaccgttctggtgcagatcaagtacgagggcaccgacgccccttgtaagatccccttttctacacaggatgagaaaggggtcacccaaaacggaagactgattacagctaatcctatcgtgacggacaaggaaaaacccgtgaacattgaggccgaaccccctttcggcgagagctatatcgttattggggtcggagagaaggcgcttaaactctcctggtttaagaagggctctagcatcgggaaaatgttcgaagctaccgcccgcggcgcccggagaatggctatcctgggagatacagcctgggactttggctccattgggggagtgttcaccagcgtgggcaagctggtccatcagatctttgggacagcttacggagtgctgttctctggcgtttcctggaccatgaaaattgggatcggcgtgctgcttacgtggctgggactcaatagccgctctacctccctgagcatgacatgcattgccgtcggcctggtgaccctttacctcggggttatggtgcaggcggactccggatgtgtcatcaactggaagggccgggggctgaaatgcggatctggcatttttgtgacaaatgaggttcacacctggacagggcagtataagttccaagccgatagcccgaagggcctgtccgctgccatcggaaaggcttgggaagagggcgtgtgtgggatcagatctgccacccgcctcgaaaacattatgtggaagcagatcagcaacgagctgaatcatattcttctggagaacgacatgaaatttacggtcgtggtgggagatgtcgcgggcatcctcgcccaggggaagaaaatgattcggccccagcctatggaacacaagtactcctggaaaaattggggaaaggctaagatcatcggcgccgacgttcaaaacagcacattcattatcgatggccccaatacccctgagtgctctgacgatcagagagcttggaacatttgggaagtggaggactatgggtttggaatcttcaccacaaatatttggctgaaactgcgcgattcctacacccaggtgtgtgaccaccggcttatgagcgccgccatcaaggattctaaagctgtccatgcggacatgggctattggatcgaatccgagaagaacgagacgtggaaactcgccagagctagcttcattgaagtgaagacatgcatctggcccaagtctcacaccctgtggagcaatggggttctggagtccgaaatgattatcccgaaaatttacggaggccctatcagccagcataactatcgccccgggtactttacacaaaccgccggaccttggcacctcggcaagctggagcttgatttcgacctgtgcgaaggcacaaccgtggtcgtggacgagcactgtgggaatcggggaccctctctcggcacgaccacagttaccgggaaaatcattcatgagtggtgctgtagatcctgcacactgcctcccctgcggtttcgcggagaagatggctgttggtacgggatggagatcagaccggtgaaggaaaaagaggagaaccttgtcaagagcatggtgtccgccggatctggcgaagttgacagcttctccctcggcctgctgtgcatttctatcatgattgaggaagtgatgcggagcagatggtcccgcaagatgctcatgaccgggacgctggctgtctttttccttctgatcatgggacagctcacatggaatgatctgattcggctgtgtatcatggtgggcgccaacgcgtctgacagaatggggatgggaaccacatatcttgctctgatggccacctttaaaatgcgccctatgttcgccgtgggcctcctgtttagacggctcaccagccgcgaggtcctgcttctgacaatcgggctctccctggttgctagcgtggaactgcccaattctcttgaggagctgggagatggcctcgccatgggcattatgatcctgaagctcctgacggacttcagatcccaccagctttgggcgaccctgctcagcatgacatttattaaaaccgctttctctctgcattacgcctggaagacaatggccatggtgctgtccatcgtcagcctttttcccctgtgcctctataccacgtctcagaagacaacctggctgcctgtgctcctggggtcccttggatgtaagccgctgaccatgttcctgattgctgaaaacaagatctggggccggaaaagctggcccctcaacgaggggatcatggccgttggaattgtgtccatcctgcttagctctctgctcaagaatgatgtccctctggctggccccctcattgccgggggaatgctgatcgcgtgctacgtgattagcggctcctctgccgaccttagcctggaaaaagctgccgaggtttcctgggaagaggaggctgaacactctggcgccagccataacatcctggtggaggtccaggatgacgggacaatgaagatcaaagatgaagaaagagacgataccctcacaattctgcttaaggccacgctgctcgctgtgtccggagtctatcctctgtctatccccgcgaccctcttcgtgtggtgtttttggcagaaaaagaagcagagaagcggcgttctgtgggacacaccttctcccccgaaagtggaacgggccgtccttgacgatgggatttaccgcatcatgcaaagaggactgctgggccggagccaggtgggggttggagtgttccaggagaatgtctttcacaccatgtggcacgtgacacgcggcgctgtgctcatgtatcagggcaagagactggagcctagctgggcctccgttaaaaaggaccttattagctacgggggaggctggcggctgcaagggtcttggaacaccggagaagaggtccaggtgatcgccgtggaacccggcaaaaatcctaagaacgtccagacggctcccgggaccttcaagacaccggagggagaggtgggcgccattgcgctcgattttaaacctggcacctccgggagccccatcgttaatagagaaggaaagatcgtgggcctgtacgggaacggagtcgtgacaacctccggcacatatgtttctgctattgcccaggccaaagctagccaagaggggcctctccccgaaatcgaggacgaagtgttccgcaagcggaatctgacgattatggatcttcatcccggctccggaaaaaccagacgctacctgcctgccatcgtccgggaggcgattaagagaaagatgcgcacactgatcctcgctccgacccgggtggttgccagcgagatggccgaagctctgaaaggcatgcccatcagatatcagaccacagccgtgaagtctgagcacacggggaaagaaattgtcgaccttatgtgccatgctacctttacaatgcgcctgctctcccctgtgcgggtgcccaactacaatatgatcattatggatgaggcccacttcaccgaccctagctctatcgcggccagaggatatattagcacacgggtcggcatgggggaagctgccgctatctttatgaccgccacgccccctggatccgttgaggccttcccgcagtctaacgctgtgatccaagatgaggaacgcgacattcccgagagaagctggaactccggctacgaatggatcacagattttcctgggaagaccgtgtggttcgtcccctctattaaagcgggcaacgacatcaccaattgcctgcggaagaacggaaagcgcgtgattcagctgagcagaaaaacattcgacaccgagtatcagaagaccaagaataatgattgggactacgttgtgaccacggatatctccgaaatgggcgccaactttcgggctgacagagtcatggatcctcgccggtgtctcaagcccgtgattcttaaagacgggccggagagagttatcctggccggacctatgcccgtgacagtcgccagcgctgcccagcgccggggcagaatcgggcgcaatcataacaaggagggagatcaatacatttatatgggccagcccctgaccaatgacgaagatcacgcgcactggacagaggctaagatgctcctggacaacatcaatacccctgaagggattatccccgcccttttcgagcctgagcgggaaaaatctgccgctattgatggcgagtacagactgcgcggagaagccagaaagacgtttgtggagctcatgcggcgcggcgacctgccggtctggctgtcccataaagtggcgagcgaagggttccagtattccgatagacggtggtgctttgacggagagcgcaacaatcaggttctcgaggaaaacatggacgtggagatctggaccaaggaaggcgagcgcaagaaacttcggcccagatggctggatgcccgcacatactctgaccctctggctctccgggagttcaaagagtttgccgctgggagacgcagcgtgtccggagatctgatccttgagattggcaagctgccccaacacctcacccagcgggcccagaatgctctggacaacctggtcatgctccataattctgaacagggcgggagagcctatcggcacgcgatggaggaacttcctgatacaatcgagaccctgatgctgctcgccctgattgctgttcttacaggaggcgtgaccctgttctttctcagcgggaagggactgggcaaaacgtccatcgggctgctctgtgtgatggccagctctgtccttctgtggatggcttccgtggaaccccactggattgccgccagcatcatcctggagttctttctcatggttctgcttattccggagcctgaccgccaaagaacaccccaggataaccagctggcttacgtggtcatcggactcctgttcatgattctgaccgtggcggccaatgaaatgggcctccttgagaccacaaagaaagacctgggcatcgggcatgtcgctgtggaaaaccaccatcacgccgccatgctggatgttgacctccatcctgcttctgcctggaccctgtatgcggtggccacaacgattatcacccccatgatgcggcacacaattgagaacaccacagctaatatctcccttaccgccatcgctaaccaggccgcgattctgatgggactcgataagggctggcctatcagcaaaatggacattggggtccccctgctggccctcggatgctactctcaagtgaatccgcttacgctgaccgctgccgttctgatgctcgtggctcactacgccatcattggccctgggctgcaggctaaggccacacgcgaggcgcagaagagaaccgccgctggaatcatgaaaaaccccacaatcgatggcattgtcgccatcgaccttgaccccgtggtgtatgatgctaagtttgaaaaacaactgggccagattatgctcctgatcctgtgtaccagccagattctccttatgcggacgacatgggccctgtgcgagtccatcaccctggccacagggcctctcaccaccctgtgggaaggatctccgggcaagttctggaatacaacgatcgcggttagcatggctaacattttccgcgggtcctaccttgccggagctggcctggcctttagcctcatgaaatccctcgggggaggcagacggggcaccggggcccagggagagacactgggcgaaaagtggaagcgccaactcaatcagctttctaaaagcgagttcaacacctataagagatccgggatcatggaggtcgaccggtctgaagctaaagagggactgaagagaggcgaaacaaccaaacatgccgtgagccgcgggacggcgaagctgcggtggtttgtggagagaaatctcgtcaagcccgaaggaaaagttattgatctgggctgtggccgcgggggatggtcctactattgcgccggccttaagaaagtgacagaggtgaaggggtacaccaaaggaggccctgggcacgaggaacccatccctatggctacctatggatggaacctggtcaagctccattctggcaaagacgtgttctttattccccctgagaagtgtgatacactgctgtgcgacatcggcgaaagctccccgaatcccaccattgaggaagggcggacactcagagttcttaagatggtggagccttggctgcgcggaaaccagttctgtatcaaaatcctgaatccctacatgcctagcgtcgtggagacgctcgaacagatgcaacggaagcacggcgggatgctggttagaaaccccctttctcgcaattccacccacgagatgtactgggtgagctgcggaacaggcaacattgtctctgccgtgaatatgacctcccggatgctgctcaacagatttacaatggctcatcgcaaaccgacctatgaacgggatgtggacctgggggccggaacgagacacgtcgcggttgagcctgaggtggccaacctggatatcattggccagcgcatcgaaaatattaagcatgagcacaaaagcacctggcattacgacgaagataacccctataagacatgggcttaccacggctcttatgaggtgaagccctccgggagcgcctccagcatggtcaatggagtggttaaactcctgaccaagccttgggacgtgatccccatggtcacacagatcgctatgaccgacacaacccctttcggccagcaaagagtgtttaaagaaaaggttgatacgcggacaccgaaagccaagcgcgggaccgctcagattatggtggtcaccgccagatggctttggtctttcctgagccggaacaagaaacccagaatctgcacacgggaggagtttacgcgcaaggtgagatccaatgcggccattggagctgttttcgtggacgaaaaccagtggaactctgccaaagaggctgtcgaagatgaccggttttgggatctcgtgcaccgcgagagagaactgcataagcaaggcaaatgtgccacatgcgtctacaacacaatggggaagcgggagaagaaacttggcgagttcggaaaggccaaaggcagccgcgcgatctggtatatgtggctgggggctagattcctcgaatttgaggccctgggattcatgaatgaagaccactggttttcccgggagaactctctgagcggcgtggaaggggagggactccataagctgggctacattcttcgcgatatctccaaaatccctgggggcaatatgtacgccgacgataccgctggatgggacacaagaattaccgagggcgatctgcagaacgaagccaagatcacagacattatggagcccgaacacgctctcctggccaaatctatcttcaaacttacctatcagaataaggttgtgcgggtccagcgccctgcgaaaaacgggacggtgatggatgtgattagcagacgggaccaacgcggatccggccaggttgggacctacggactgaatacatttaccaacatggaggcccagctcatcagacagatggagagcgaaggcatcttctctcccaacgagctggaaacaccgaatctggctgagcgggtgctcgactggctggaaaagtatggggtcgagagacttaaacgcatggccatttccggcgatgactgtgtggttaagcctatcgatgaccggtttgctaccgccctgacggcgctcaacgatatgggaaaagtgagaaaggacattccccaatgggagcctagcaagggctggaatgattggcagcaggtccccttctgctctcaccattttcaccagctgatcatgaaagacgggcgcgaaattgtggtcccttgtcggaaccaagatgagcttgtgggcagagcccgcgtttcccagggcgctgggtggagcctgcgggaaacagcctgcctcggaaagtcctacgctcagatgtggcagctgatgtatttccatagacgcgacctgcggctcgccgctaatgccatctgttctgcggtgcccgtcgattgggtgccgaccagcagaacaacctggtccattcacgcccatcaccaatggatgacgaccgaggacatgctgagcgtttggaaccgcgtgtggatcgaagagaatccttggatggaggacaaaacacggatctcttcctgggaagatgtcccctaccttggcgagagagaagaccagtggtgcgggagcctgattggcctcaccgctcgggccacatgggccaccaacgtgcaagtggctatcaatcaagttagacgcctgattggaaacgagaattattctgattacatgacaagcatgaagcggtttaaaaacaagtccgaacccgagggcgccctttggtga

SEQ ID NO: 19529 - RNA, 9876 nt, synthetic construct
  misc_feature 1..9876: note = derived and/or modified CDS sequence (opt5) from DENV-2__AJ968413__SS-prME
  source 1..9876: mol_type = other RNA
accgccggaatgatcattatgctgatccccacagtgatggctttccacctgacgaccagaaatggggaacctcatatgattgtcagccggcaggaaaagggaaaatccctgctttttaagacagaagacggagttaatatgtgcaccctgatggccatggatctcggggaactgtgtgaggacacaatcacctacaaatgcccgcttctgcgccaaaacgaacccgaggatattgactgttggtgcaattctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacacactttcagagagctcttattttcatcctgctcacggccgttgcgccttccatgaccatgcggtgcattggaatctctaaccgcgattttgtggaaggcgtcagcgggggatcctgggtggacattgttctggagcacggcagctgtgtgacaaccatggccaagaataagcccacacttgatttcgaactgatcaaaaccgaggctaagcagctcgccacgctgagaaaatattgcatcgaagctaagctgacaaacaccaccacagagtctcggtgtcctacccaaggggagccgtccctcaatgaagaacaggacaaacgctttgtctgcaagcatagcatggtggatagaggatggggcaacggctgtgggctgttcggaaagggcgggattgtgacatgcgccatgtttacgtgcaaaaagaatatggaaggaaaaatcgtccagcccgagaaccttgaatacaccattgttatcacacctcactctggcgaggagcatgcggtggggaatgacaccggaaagcacggcaaagaaattaagatcacaccccagtccagcatcaccgaggccgaactgacgggctatgggaccgtgacaatggagtgttctcctcggaccggactcgatttcaacgaaatggtcctgcttcaaatggagaataaggcttggctggtgcaccgccagtggtttctcgacctgcccctgccgtggctccctggcgccgatacacaggggtccaactggattcagaaggagaccctggttacgttcaagaatccccatgctaaaaagcaagacgtggtcgtgcttggaagccaggaaggcgccatgcacacagccctgaccggggctacagagatccagatgtcctctggcaacctcctgtttaccggacatcttaaatgcagactgcggatggacaagctccaactgaaaggcatgagctactccatgtgtaccgggaagttcaaggttgtgaaagaaattgcggagacacagcacggaacgatcgtcgtgagagtccagtatgagggcgatgggagcccttgcaagattcccttcgaaatcatggacctggagaaacgccatgtgctcggacggctgatcaccgttaaccccattgtgacagaaaaggattctcctgtcaatatcgaggccgaaccgccctttggcgactcctacgtgattatcggggttgagcctggccagcttaaactgaactggttcaagaagggaagctctattggccaaatgtttgagaccacaatgagaggggctaaacgcatggccatcctcggagataccgcctgggacttcggcagcctcgggggagtgtttacgtccattggcaaggctctgcaccaggtcttcggggccatctacggcgcggctttttctggagtgagctggacaatgaaaatccttattggcgtgatcattacctggatcgggatgaactcccggagcacctctctctccgttagcctggtcctggtgggagtggtcacactctatctgggcgtggttgtgcaggccgattctgggtgtgtcgtgtcctggaagaacaaagaacttaagtgcggaagcggcattttcatcaccgacaatgttcacacatggacggagcagtacaagtttcaacccgaatccccttctaaactggccagcgctatccagaaggcccatcaggaggggatttgtggcatcagatccgtgacccgcctcgaaaacctgatgtggaaacagattacacccgagctgaatcacatcctttctgagaacgaagtcaagctcaccattatgacaggagatatcaaaggcatcatgcatgctgggaagcggagcctgagaccgcaacctaccgagctgcgctattcctggaaaacgtggggaaaggccaagattctcagcaccgaatctcacaatcagacattcctgatcgacggccccgagaccgcggaatgccctaacacaaatcgggcctggaactcccttgaggtggaggattacgggtttggagttttcaccacaaatatttggctgaaactcagagaaaagcaggacgtgttttgtgacagcaaactgatgtctgctgccatcaaggataaccgcgctgtccacgccgacatgggctattggattgagtccgcgctgaatgatacctggaaaatcgaaaaggccagcttcatcgaggtgaagtcttgccattggcccaaaagccacacgctttggtccaacggcgtgctcgagagcgaaatgattatccctaagaacttcgctgggcccgtctctcagcataattaccggccgggatatcacacacaaaccgccggcccttggcatctggggaaactggagatggactttgatttctgtgaaggaaccacagttgtggtgaccgaggactgcggcaacagagggccctccctccggacgacaaccgctagcggaaagctgattacagaatggtgctgtcgctcctgcacccttccccctctgagataccggggcgaggatggctgttggtacgggatggagatcagaccgctcaaagaaaaggaggaaaatctggtcaactctctggtgacagccggacacggccagattgacaattttagccttggggttctcggaatggccctgttcctggaggaaatgctccgcacccgggtgggcacgaagcacgctaccctgcttgtcgcggtgtcctttgttacactgatcaccgggaacatgtctttcagagatctcggacgcgtgatggtcatggtgggcgccacaatgaccgacgatattggcatgggggttacgtatctggctctgcttgccgcctttaaagtgagacccacattcgctgccggactgctcctgcggaagctcaccagcaaagagctgatgatgacaaccatcggcgtcgtgcttctgtcccagtctaccatccctgagacaattctcgaactgacggacgcgctggctcttgggatgatggtgctgaagatcgtccgcaaaatggagagataccaactcgccgttaccattacagccatcctgtgcgtgcccaatgctgtgattctccagaacgcctggaaggtcagctgtaccatcctggcggtggtttccgtgagccctcttctgctcacatcttcccagcagaaggctgattggatccccctggccctgaccattaaaggacttaatcctacggccatctttctgacaaccctcagccggacctctaagaaacgctcctggcccctgaacgaagctattatggccgtcggcatggtgagcatcctcgcttcttccctgcttaagaatgacattccgatgacagggcctctggttgccggaggcctgctcaccgtgtgctatgtcctgacaggcagaagcgcggaccttgagctggaaaaagccgctgatgtgcggtgggaggaccaagccgagatctccgggagctctcccatcctcagcattacgatctccgaagatggatctatgagcattaagaacgaggaagaggagcagaccctgacaatcctcattcgcaccggcctgcttgtcatctccgggctgttccctgtgtctattcccatcacagctgccgcctggtacctgtgggaagttaaaaagcagagagctggagtgctctgggacgtcccgagccctccccctgtgggcaaggcggagctggaagatggggcctatcggatcaaacagaagggcattcttggctactcccaaatcggcgctggggtttataaagagggaacctttcatacgatgtggcacgtgacccgcggcgccgtcctgatgcataaggggaaaagaattgaaccctcttgggccgacgtgaagaaggatctcatcagctacggaggcgggtggaaactggagggagagtggaaggaaggcgaggaagtgcaggttctcgctctggagcccggcaaaaatcctcgggccgtccagacaaagccggggcttttcaaaaccaacacaggaaccattggcgcggtgtccctggactttagccccgggacatctggatcccctatcatcgataagaagggcaaagtggtcgggctgtacggaaatggcgtggttacgagaaacggcgcttatgtgagcgccattgcccagaccgaaaagtctatcgaggacaaccccgagattgaagatgacatcttccgcaaaaagcggctcacaattatggatctgcaccctggggctggaaaaaccaagagataccttcccgccatcgtccgcgaggcgatcaagcggggcctgagaaccctcattctggctcctacacgcgtggttgccgccgaaatggaggaagctctccgggggctgccgatcagatatcaaacgcccgccattcgcgctgagcataccggacgggagatcgtggaccttatgtgtcacgccacattcaccatgagactgctgtcccctgtccgggtgcccaattacaacctcattatcatggacgaagcgcactttacagatcctgccagcattgctgcccgcggctatatctccaccagagttgagatgggggaagctgccggcatcttcatgacggccacacccccgggatctcgggacccttttccccagagcaatgctcccattatggatgaggagcgcgaaatccctgagagatcctggaacagcggccatgaatgggtgaccgacttcaaagggaagaccgtctggtttgtgccctctattaaagcgggaaatgatatcgccgcttgcctgcggaagaacggcaaaaaggtgattcagctttccagaaagacattcgacagcgagtacgtcaaaacccgcacaaatgattgggactttgttgtgaccacggatatctctgaaatgggggccaacttcaaggccgagcgggtgatcgaccctagacgctgtatgaaaccggtcattctgacagatggagaggaacgggtgatcctcgctggccccatgcctgttacccacagctccgccgcgcaaagacgcgggcggattggcagaaatcccaagaacgagaatgaccagtatatctacatgggagaacctctggagaacgacgaagattgcgctcattggaaagaggccaagatgctgctcgacaatattaacacacccgagggcatcatcccgtctatgtttgaacctgagcgcgaaaaagtggatgccattgacggggagtacagacttcggggagaagctcgcaagaccttcgtcgatctgatgagacggggcgacctgcccgtgtggctcgcctataaggttgcggccgaggggatcaattacgctgatcgcagatggtgttttgacggcattcggaacaaccagatcctggaggaaaatgtggaggtcgaaatttggacgaaagagggagagagaaagaaacttaagcctcgctggctggatgcccggatctatagcgaccccctcgctctgaaagagttcaaggagttcgccgctgggagaaagtccctgaccctcaaccttattacagaaatgggccgcctgcctacctttatgacacagaaagcccgggatgcgctggacaatctcgccgtgctgcacaccgctgaggccggaggcagagcttacaaccacgccctttctgaactgcccgagacactcgagaccctgctgctccttacgctgctggccacagtcaccgggggaatcttcctctttctgatgagcggccgggggatcggaaagatgacccttggcatgtgctgcattatcacagcttccattctgctctggtatgcgcaaatccagccgcattggattgccgctagcatcatcctggagttctttctgattgtgctccttatccctgagcccgaaaaacagcgcacaccccaggataatcaactgacatacgttgtgattgccatcctgacggtggtcgccgctaccatggccaacgagatgggcttcctcgaaaagaccaagaaagacctggggcttggatctattaccacacagcagcctgagtccaatatcctggacatcgatctcagaccggcgagcgcctggaccctgtatgctgttgccacgacctttgtgacacccatgctgcggcactccattgagaactctagcgtgaatgtctccctcaccgctatcgccaaccaggcgacagtgcttatgggcctggggaagggatggcctctgtctaaaatggacattggcgttcccctcctggccatcgggtgttacagccaagtgaatcctattacccttacggctgccctgctcctgctggtcgctcattacgccatcattggacccggcctccaggctaaggccacacgcgaagcgcagaaaagagccgctgccggcatcatgaagaaccctaccgtggatgggatcacagtcattgaccttgatccgatcccctatgaccctaaattcgagaagcagctgggacaagtgatgctgctcgttctgtgcgtgacccaggtccttatgatgcggaccacatgggctctgtgtgaagccctcacgctggccaccggccccatttccacactgtgggaggggaatcctggacgcttttggaacaccacaatcgcggtgagcatggctaatattttcagaggctcttacctcgccggggctggacttctgttttccatcatgaagaacaccacgaatacacggcgcggcaccggcaacatcggggaaaccctgggagagaaatggaagaacagactcaatgccctgggcaaaagcgagttccagatttataagaaatctgggatccaagaagttgatcggacacttgccaaggagggaattaaaagaggcgaaaccgaccaccatgctgtgtcccgcgggagcgccaagctgcggtggtttgtcgagagaaacatggtgacacccgagggaaaggtggttgatctcggctgcggccgcgggggatggtcttactattgtggcgggctgaaaaatgtccgggaagtgaagggactgacgaaaggcgggccgggacacgaggaacctatccccatgagcacctacggctggaacctcgtgagacttcagtccggcgtcgacgttttcttcacaccccctgagaagtgcgataccctgctgtgtgacattggggaatctagccccaatcctacagtggaggcgggacgcaccctccgggtgctgaaccttgtcgagaattggctgaacaataacatccagttttgcatcaaagtgctcaatccgtatatgccctccgttattgaaaagatggaggccctgcagagaaagtacggcggggctctggtgcgcaaccctctcagcagaaattccacgcacgaaatgtactgggtctctaacgccagcggaaatatcgtgtcctctgttaacatgattagcagaatgcttatcaaccgcttcaccatgaaacataagaaagctacatatgagcccgatgtggacctgggctccgggacccggaatattggaatcgaatctgaggtccctaacctggacatcattggcaagagaatcgagaaaattaagcaagaacacgagacaagctggcattacgatcaggaccacccctataagacctgggcctaccacggctcctatgaaacaaaacagaccgggagcgcgtcttccatggtgaatggagtggtccgcctcctgacgaagccgtgggatgttgtgcctatggtgacacagatggccatgaccgacaccacaccctttggccaacagagagtcttcaaagagaaggtggatacgcggacccaggaacctaaagaggggacaaagaaacttatgaaaatcaccgctgagtggctgtggaaggaactcggcaagaagaaaacaccccgcatgtgtaccagagaggaatttacacggaaggttagaagcaacgccgctctgggcgccattttcaccgacgagaataaatggaagtctgctcgggaggccgtggaagattcccgcttttgggggctggtcgacaaggagagaaacctccatctggaaggaaaatgcgagacgtgtgtgtacaatatgatgggcaagcgggagaagaaacttggcgagttcgggaaagcgaaaggaagccgcgccatctggtatatgtggctgggcgctagatttctcgagttcgaagccctggggtttcttaacgaggatcactggttctctcgggaaaattccctgagcggagttgagggcgaagggctccataagctgggctacattctgcgcgacgtgtccaaaaaggagggaggcgctatgtacgccgatgacaccgccgggtgggacacaagaatcaccctcgaggatctgaaaaacgaagagatggtcacaaatcacatggaaggagagcataagaaacttgcggaagctatctttaagctgacctatcagaacaaggtggttcgggtgcaacgccctacgcccagaggcacagtcatggacattatcagccggcgcgatcagagagggtctggacaggtgggcacctacgggctcaatacattcaccaacatggaggcccaactgattcggcagatggagggcgaaggagtcttcaaaagcatccagcaccttacggtgaccgaggaaattgccgttcagaattggctggctcgcgtgggcagagagcggctctccagaatggccatctctggggacgattgcgtcgtgaagccgctggacgatcgctttgctagcgccctgacagcgctcaacgacatgggaaaagtgcggaaggatatccaacagtgggagccttccagaggctggaacgactggacccaggttcccttctgctctcaccattttcacgaactgattatgaaagatgggcgcgtgcttgtcgtgccctgtcggaatcaggacgagctgatcggacgggcccgcattagccaaggcgctgggtggtccctccgggaaacagcctgcctgggcaagtcttatgctcagatgtggagccttatgtacttccatagacgcgatctgcggctcgccgcgaacgccatctgttccgctgttcctagccactgggtgccgacctctagaacaacctggtccattcacgccaagcatgagtggatgacgacagaagacatgctgaccgtctggaatcgcgtgtggatccaggagaacccctggatggaggacaaaacccctgtcgaaagctgggaggaaatcccctatctgggaaagcgggaggatcagtggtgcggctctctcattgggctgacatccagagctacctgggccaaaaatatccaaacagctattaaccaggtgcggagccttatcggaaatgaagagtacacggactatatgccttccatgaagagatttcgccgggaggaagaggaagccggcgttctgtggtga

SEQ ID NO: 19530 - RNA, 9876 nt, synthetic construct
  misc_feature 1..9876: note = derived and/or modified CDS sequence (opt5) from DENV-2__AB543624__SS-prME
  source 1..9876: mol_type = other RNA
agcgccggcatgatcattatgctgatccccaccgtgatggctttccacctgaccacgagaaatggggaacctcatatgattgttggaatccaggaaaagggcaagtccctgctttttaagaccgaggacggggttaatatgtgcacactgatggccatggatctcggagaactgtgtgaggacaccattacatacaaatgcccccttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgttacctgcgctatgtttacatgcaagaaaaacatggaaggcaagatcgtccagcctgagaatctcgaatacacgattgtggtgacaccccactctggggaggagcatgccgtcggaaacgacacaggcaaacacggcaaggaaatcaaagtgacccctcagtccagcatcacagaggcggaactgattgggtatggaaccgttacgatggagtgttctcccagaaccggccttgatttcaatgaaatggtgctgctccaaatggagaacaaggcctggctggtccaccggcagtggtttcttgacctgccgctcccttggctgcccggggctgataagcaggagtccaattggatccagaaagaaacactggtgaccttcaagaaccctcatgccaaaaagcaagacgttgtggtcctcggaagccccgagggcgctatgcacacagccctgaccggggccacggaaattcagatgtcctctggcaatcttctgtttacaggacatctcaaatgccgcctgagaatggacaaacttcagctgaagggcatgagctactccatgtgtaccgggaaattcaaggtggtcaaagagatcgctgagacacaacacggaaccattgtgatccgggttcagtatgaaggcgatgggagcccctgcaagatccctttcgagattatggacctcgagaagcggtacgtgctgggacgcctgatcaccgtcaacccgattgtgacagagaaggataaccccgttaatatcgaagcggagcctccctttggcgactcttacattatcattggggtggagcctggccagctcaagctgaactggttcaaaaagggatccagcatcggccagatgtttgaaacgaccatgagaggggctaaaagaatggctatccttggagatacagcctgggacttcggctctctcgggggagtctttaccagcattggcaaggccctccatcaagtgttcggggctatctatggcgccgcgttttccggagtgtcttggacaatgaaaattctgatcggcgttattatcacctggatcgggatgaatagccgctccacgagcctgtctgtctcccttgtgctcgtgggaattgtcacactgtacctgggcgtgatggttcaggctgatagcgggtgtgtggtctcttggaagaacaaggagctcaaatgcggatccggcatcttcattaccgacaatgtgcacacctggacagaacagtataagtttcagcccgagagcccgtccaaactggcctctgccatccaaaaggctcaggaagaggggatttgtggcatccggagcgttaccagacttgagaacctgatgtggaaacagatcgcccctgaactcaatcacattctggctgagaacgaagtgaagctgacaatcatgacgggagatattaaaggcatcatgcaggccgggaagcgctcccttcggccccaacctaccgagctcaagtactcttggaaaacatggggaaaggcgaaaatgctgagcaccgaatcctataatcagacattcctgattgacggccccgagaccgccgagtgccctaacacgaatagagcttggaacagcctcgaagtcgaggattacgggtttggagtgttcaccacaaatatctggctgaaacttaaagaacgccaggacgccttttgtgactctaagctgatgtccgctgccatcaaggataaccgggcggttcatgccgacatgggctattggattgagagcgctctcaatgatacctggaaaatcgagaaggcctctttcattgaagtgaaaaactgccactggcccaagtcccatacactgtggagcaacggcgtcctggagtctgaaatgatcattccgaaaaatcttgctgggcctgtgagccagcacaactacagacccggataccacacccaaatcgccggcccctggcatctcgggaagctggagatggacttcgatttttgtgacggaacaaccgtgattgtcacggaagattgcggcaatcgcgggccttccctgcggacaaccaccgccagcggaaagctcatcacagagtggtgctgtagatcttgcaccctgccgccccttcggtatcgcggcgaggacggctgttggtacgggatggaaatcagacctctgaaagagaaggaagagaacctcgttaattccctggtgacggctggacacggccaggtggataacttcagcctgggggtccttggaatggcgctctttctggaagagatgctgcggacaagagtgggcaccaaacatgccattctcctggttgctgtgtccttcgtcacacttatcaccgggaatatgtcttttaaggacctgggacgcgtggttgtgatggtcggcgccacaatggccgatgacattggcatgggggtgacctatctcgctctgctggccgcgttcaaagttcggcccacgtttgctgccggacttctgctcagaaagctgaccagcaaggagctcatgatgacaaccatcggcattgtgctgctttcccagtctacaatccctgaaaccgtcctggagctcacggatgccctggctctggggatgatggtgcttaaaatcgtgcgcaacatggaaaagtaccaactggccgtcacaattatggcgatcctctgcgttcccaatgctgtgattctgcagaacgcctggaaagtgagctgtaccatcctcgccgtcgtgtccgtttctcctctgcttctgacaagctcccagcagaagaccgactggattcccctcgctctgaccatcaaaggactgaatccgacagccatcttccttacgaccctgagcagaacaaacaagaaacggtcttggcctctcaatgaggctattatggccgtgggcatggtctccatcctggcgagctctctcctgaagaacgacattcccatgaccgggcctcttgtggccggaggcctgctgacagtttgctatgtgctcaccggccgctccgctgatctggaacttgagagagccacggacgtcaagtgggaggatcaagctgaaatcagcgggtcttcccccattctgagcatcacaatttccgaggacggaagcatgtctatcaaaaatgaagaggaggaacagaccctcaccatcctgattcggacaggcctcctggtgatcagcgggctttttccgatttccatccctattaccgccgccgcttggtacctgtgggaggtcaagaaacagcgcgcgggagtgctgtgggatgttccctctcctccgcccatgggcaaggccgaactcgaggacggggcttatagaatcaaacagaagggaatcctgggctacagccaaattggcgccggggtgtacaaggaaggaacattccacacgatgtggcatgtcacccggggcgccgtgcttatgcacaaagggaagcgcatcgagccttcctgggctgatgttaaaaaggacctgatttcttatggaggcgggtggaaactcgagggagaatggaaggagggcgaagaggtgcaggtcctggccctcgaaccgggcaagaaccccagagcggtgcagacaaaacctgggctgtttaagaccaacaatggaacaatcggcgctgtgagccttgatttctcccccgggacctctggaagccctattatcgacaaaaagggcaaagttgtcgggctgtacggaaacggcgtggtgacgcggtccggcgcctatgtcagcgccatcgctcagaccgagaagtctattgaggataatcccgaaatcgaggacgatatttttcgcaagagacggctgacaatcatggacctccaccctggggccggaaaaaccaagagatacctgccggcgattgtgcgcgaagctatcaaacggggccttagaacactgattctcgcccccacccgcgttgtggccgctgagatggaagaggccctgcgggggctccctatcagatatcaaacacccgctatccgcgccgagcatacgggacgggaaattgtcgacctgatgtgtcacgcgaccttcacaatgagacttctgtcccctgtgcgcgttcccaactacaatctgatcattatggatgaggcccatttcaccgacccggctagcatcgccgctcggggctatatttctaccagagtggaaatgggggaggccgccggcatctttatgacagctacgcctcccggatcccgggatcccttccctcagagcaacgcgcccatcattgacgaggaacgcgagatccctgaaagatcctggaactctggccacgagtgggtcaccgattttaaggggaaaacagtgtggttcgttccgagcattaaggccggaaacgacatcgctgcctgcctccggaagaatggcaaaaaggtgattcagctgtcccgcaaaacctttgatagcgaatacgtcaagacaagaaccaacgactgggatttcgtggtgacgacagacatctctgagatgggggccaattttaaagctgagcgggtcatcgatcccagacgctgtatgaagcctgttattcttaccgacggagaggaacgggtgatcctggccggccccatgcctgtgacccattccagcgcggctcaaagacgcgggcggattggcagaaaccccaaaaatgaaaacgaccagtacatctatatgggagagccgctcgaaaatgatgaggactgcgcccactggaaggaggccaagatgctgctggataacattaacacacctgaaggcatcattccctctatgttcgagcctgaacgcgagaaagtcgacgctatcgatggggaataccggctcagaggagaggcccgcaagacctttgtggaccttatgagacggggcgatctgcccgtttggctggcgtataaagtggccgctgaggggatcaattacgccgaccgcagatggtgtttcgatggaattaagaacaatcagatcctcgaagagaacgtcgaagtggagatttggacaaaagagggcgaacggaagaagctgaaacctcgctggcttgacgctagaatctatagcgatcccctggccctcaaggagtttaaagagttcgctgccgggcggaagtccctgaccctgaatctcattacggagatgggcagacttccgacattcatgacccagaaaacacgcgacgcgctggataacctggccgttctccacaccgctgaagccggaggccgggcttacaatcatgccctgtctgagcttcctgagacgctggaaaccctcctgctgctcacacttctggccaccgtgacagggggaatctttctgttcctcatgagcggcagagggatcggaaagatgaccctgggcatgtgctgcattatcacagcttccattcttctgtggtatgcgcaaatccagccccactggattgccgcttctatcatcctcgagtttttcctgattgtcctgctcatccccgaacctgagaagcagcgcaccccgcaggacaaccaacttacgtacgtggtcattgccatcctgacagtggttgccgctaccatggccaatgaaatgggctttctggagaaaaccaagaaagacctcgggctgggaagcattgcgacacagcatcccgagtccaacatccttgatattgacctgcggcctgccagcgcttggaccctctacgccgtggctacaacgttcatcacccccatgctgagacactctatcgaaaattccagcgtgaacgtctccctgacagccattgcgaatcaggccaccgttctcatgggccttgggaagggatggcctctgtctaaaatggatatcggcgtgcccctgctcgctattgggtgttatagccaggtgaaccctatcacactgaccgccgcccttctgctcctggtcgcccactacgctattatcggaccgggcctgcaagccaaggcgacgcgggaggcccagaagcgcgctgccgctggcatcatgaaaaatcccaccgtggacgggattacagttatcgatctcgaccctattccctatgatcctaagtttgaaaaacagcttggacaggtgatgctgctgatcctctgcgtcacccaagtgctgatgatgagaacaacctgggccctttgtgaggccctgacgctcgcgacaggccccatttccccgctgtgggaagggaaccctggacggttctggaataccacaatcgctgtctctatggccaacatctttcgcggcagctacctggctggggccggactccttttctccattatgaagaacaccaccaatacaagacggggcacgggcaacatcggggagaccctgggagagaaatggaaaagccgcctgaatgccctcggcaaatctgaatttcagatttataagaagtccgggatccaggaggtggacagaacactggctaaagaaggaattaagcggggcgagaccgatcatcacgccgttagccgcgggtctgcgaaacttagatggttcgtggagcggaacatggtcacacccgaaggaaaggtggttgacctgggctgcggcagagggggatggtcctactattgtggcgggctcaaaaatgtgcgcgaggtcaagggactgaccaagggcgggcccggacatgaagaacctatccccatgagcacgtacggctggaacctggtgcggctccaatctggcgtggatgtctttttcatccctccggaaaaatgcgacacacttctgtgtgatattggggagagctcccccaatcctaccgtcgaggccggaagaaccctgcgcgtgctcaacctggtggaaaattggcttaacaatcacacacatttctgcatcaaggtcctgaacccctacatgccttctgttctcgagaaaatggaagctctgcagcggaagtatggcggggccctggtgagaaatcccctcagccgcaactccacccacgagatgtactgggtgagcaatgcttccggaaacattgtctctagcgtgaacatgatctcccggatgcttattaatagatttacaatgcgccacaaaaaggccacgtatgaaccggacgttgacctgggctctgggacccggaacatcggaattgagagcgagatccctaatctggatatcattggcaagagaatcgagaagattaagcaggagcatgaaacatcctggcactacgaccaggatcatccctataaaacctgggcgtaccacggctcttatgagacaaagcaaaccgggagcgcctccagcatggtgaacggagtcgtgcgcctcctgacgaaaccttgggacgttcttcccaccgtgacacagatggctatgaccgatacaacccctttcggccagcagcgggtctttaaggaaaaggtggacacaagaacccaagagcccaaagaggggacgaagaaactgatgaagatcacagccgaatggctctggaaagagctgggaaagaaaaagaccccgcgcatgtgtaccagagaagagttcacacggaaggtgcgctctaatgctgccctgggcgctatttttacggatgagaacaaatggaagtccgccagagaagcggtcgaggacagccggttctgggaactcgttgataaagagagaaatctgcaccttgaagggaagtgcgagacctgtgtgtacaacatgatgggaaaacgggagaagaagctgggcgaatttggcaaagccaaggggtctcgcgctatctggtacatgtggctcggagccagattcctggagtttgaagctcttggcttcctgaatgaggaccattggttttcccgggaaaacagcctctctggggtggagggagagggcctgcacaaactggggtatatcctccgcgatgtctccaagaaagaaggcggagccatgtacgccgacgacacagcgggctgggataccagaattacactggaggaccttaagaatgaagagatggtgaccaaccatatggaaggggagcacaagaaactggctgaggccatcttcaagctcacatatcagaataaagttgtgcgggtccagcgccctacccccagaggaacggtgatggatattatcagccggcgcgaccagagaggctccgggcaagttggaacctacggcctgaacacatttaccaatatggaagcccagcttattcggcagatggagggggaaggcgtgttcaagaacatccaacgcctgacagtcaccgaggaggtggctgttcataactggctcgccagagtgggacgggaacgcctgagcagaatggctatctctggcgatgactgcgtcgtgaaacccctggatgaccggttcgccaatgcgctcacggccctgaacgatatggggaagattagaaaggacatccagcagtgggagcctagcaaaggatggaatgattggacacaggtcccgttttgctcccaccacttccatgaacttattatgaaggacggccgcgtgctggttgtgccctgtcggaaccaagatgagctcatcgggagagctcgcatttctcagggagccggctggagcctgcgggaaaccgcttgccttgggaaatcctatgcccagatgtggtctctgatgtactttcacagacgcgacctccggctggcggccaatgctatctgtagcgccgtcccttcccattgggtgcccacatctagaaccacgtggagcattcacgctaagcacgagtggatgaccacagaggacatgctgaccgtgtggaaccgcgtttggatccgggaaaatccttggatggaggataaaacacccgtggaatcctgggaggaaatcccttatctcggcaagagagaggaccagtggtgcggaagcctgattggccttacctctcgcgccacatgggctaagaacatccaagccgcgattaatcaggtccggtccctgatcgggaacgaggaatacaccgattacatgcccagcatgaaaagattccggagagaggaagaggaagccggagtgctctggtga

SEQ ID NO: 19531 - RNA, 9876 nt, synthetic construct
  misc_feature 1..9876: note = derived and/or modified CDS sequence (opt5) from DENV-2__AB189122__SS-prME
  source 1..9876: mol_type = other RNA
accgccggcgtgatcattatgatgatccccaccgtcatggctttccacctgacgaccagaaacggggagcctcatatgattgttagccggcaggaaaagggaaaatccctcctgtttaagacggagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtgacgtatggaacctgtacagcgaccggcgagcacagacgggaaaaacgctccgtcgctctggcccctcatgtggggatgggactcgagacaagaaccgaaacgtggatgtctagcgagggcgcctggaagcacgctcagcggatcgagacatgggttctgcgccatcccggcttcaccatcatggccgctattctggcctacacaatcgggaccacctattttcagagagtgctcattttcatcctgcttacagcggtcgccccttccatgacgatgcggtgcattggaatctctaaccgcgactttgtggaaggcgttagcgggggatcctgggtggatattgtcctggagcacggcagctgtgtgaccacaatggctaaaaataagcccaccctcgacttcgaactgatcaagacagaggccaaacaccctgctacccttagaaagtactgcatcgaagccaaactgacgaacacaaccaccgcgtctcggtgtccgacacagggggagccctccctcaatgaggaacaagataagcgctttgtgtgcaaacatagcatggtcgacagaggatggggcaacggctgtgggctgttcggaaagggcgggattgttacctgcgccatgtttacatgcaagaaaaatatggagggaaaggtggtgcagcctgaaaacctggagtatacgatcgtcattacaccccactctggcgaagagaatgctgtggggaacgatacaggaaaacatggcaaggagatcaaagttacccctcagtccagcattacagaagccgagctcaccggctacgggacggtgaccatggaatgttctccccggacaggactggacttcaatgagatggtccttctgcagatggaaaacaaggcttggctcgtgcaccgccaatggtttctggatcttccgctgccttggctccccggcgccgacacccaggggtccaactggatccagaaagagacactggttaccttcaagaatcctcacgccaagaaacaggatgtggtcgtgctgggaagccaagagggcgctatgcatacggcgctcacaggggccaccgaaatccagatgtcctctggcaacctgctttttacaggacacctgaagtgcagactccggatggacaaactgcagcttaagggcatgagctattccatgtgtaccgggaaattcaaggtcgtgaaggagattgctgaaacccaacatggaacaatcgttattagagtgcagtacgagggcgacgggagcccctgcaaaatccccttcgagattatggatctggaaaagcgccacgtcctcggacggctgatcacggtgaatcctatcgttaccgagaaagactctccggtgaacattgaagccgagcccccttttggcgattcctacatcattatcggggtcgaacccggccagctgaagctcaattggttcaaaaagggaagctctattggccagatgtttgagacaaccatgagaggggccaagcgcatggctatcctgggagacacagcctgggatttcggcagccttgggggagtgtttacctccattggcaaagcgctgcatcaagtgttcggggctatctatggcgccgccttttctggagttagctggacgatgaagatcctcattggcgtcgtgatcacatggattgggatgaactcccggagcacctctctgtccgtgagcctggtccttgtgggagttgtgaccctctacctgggcgtcatggtgcaggctgactctgggtgtgttgtgtcctggaaaaataaggagctgaaatgcggaagcggcatcttcattacagataacgtccacacctggacagaacagtataagtttcagcctgagtccccctctaagctcgccagcgctatccaaaaagcccacgaagaggggatctgtggcattagatccgtgacgcgcctggaaaatcttatgtggaagcagatcaccccggagctgaaccatattctctctgagaatgaagttaaactgacaatcatgaccggagacattaagggcatcatgcaggcggggaaacggagcctgagacctcagcccacagagcttaagtactcctggaaagcctggggaaaggctaagatgctcagcaccgaactgcacaaccatacgttcctgatcgatggccctgagaccgccgaatgccccaatacaaaccgcgcttggaactctctcgaggtggaggactatgggtttggagtcttcaccacaaacatttggctgaaacttaaggaacggcaagatgtgttttgtgactccaaactgatgagcgccgcgatcaaggacaacagagccgtgcacgctgatatgggctactggattgagtctgccctcaatgacacctggaaaatcgaaaaggcttccttcattgaggtcaagagctgccactggcctaaatctcatacactgtggagcaacggcgttctggagtccgaaatgatcatccccaagaatttcgccgggccggtgagccagcacaactatcgccctggataccatacccagacggccggcccctggcaccttgggaaactcgagatggattttgacttctgtgaaggaacaaccgtggtcgtgaccgaggattgcggcaatcgggggccctctctgagaacaaccacggcttccggaaagctgattacagaatggtgctgtcggagctgcaccctccctccgctgcgctacagaggcgaggacggctgttggtatgggatggagatccggccccttaaagaaaaggaggaaaacctggttaattccctcgtgacagcgggacatggccagattgataacttttctctgggggtcctgggaatggcccttttcctcgaggaaatgctgagaacccgcgtgggcacaaagcacgctatcctgctcgttgccgtgagctttgtcaccctgattacggggaatatgtccttccgggaccttggaagagtgatggttatggtgggcgccaccatgacagatgacatcggcatgggggtcacctacctggctctcctggccgcgtttaaagtgcgccctacattcgctgccggactgcttctgagaaagctcacctctaaagagctgatgatgacgacaattggcatcgtgctcctgagccaatccaccatccccgagacaattcttgaactgaccgatgccctcgctctggggatgatggtcctgaagatcgttcggaacatggagaaatatcagcttgccgtgaccattatggcgatcctgtgcgtgcctaatgctgtcattctccagaacgcctggaaggtgtcttgtacaacgctggccgttgtgagcgtcagccccctcctgcttaccagctctcaacagaaggctgactggatccctctggccctcacaatcaaaggactgaatcccaccgctatttttctgacaaccctttcccgcacgagcaagaaaagatcttggccgctgaacgaagccatcatggcggtgggcatggtttccattctcgccagctctctgctcaagaatgatatccctatgacagggcccctggtggctggaggccttctgaccgtctgctacgtgctgaccggccggtccgccgacctcgagctggaacgcgctgccgacgtcagatgggaggagcaggccgaaattagcgggtccagccctatcctttctatcacaattagcgaggatggatccatgtctatcaaaaacgaagaggaggaacagaccctgacaattctcatccggacgggcctgctcgtgattagcgggctgttccccgtttccatcccgattaccgctgcggcctggtatctttgggaggtgaagaaacaacgcgctggagtcctgtgggacgtgccttctccccctcccgttggcaaggccgaactggaggatggggcctacagaatcaagcagaaaggaatcctcggctatagccagattggcgtgggggtctacaaggaaggaacatttcacaccatgtggcatgtgacacggggcgctgtgctgatgcacaaagggaagcgcatcgagccctcctgggccgacgttaaaaaggatcttatttcttacggaggcgggtggaagctggagggagaatggaaagagggcgaagaggtccaggtgctcgcgctggaacctggcaagaacccgagagctgtgcaaaccaaacccggactcttcaagacgaataccggaacaatcggcgccgtcagcctggacttttcccctgggaccagcggatctcccattgtggataaaaagggcaaggttgtggggctttatggaaacggcgtcgtgacacggtccggcacctacgttagcgccatcgctcagacagagaaaaatatcgaggacaaccctgaaattgaggatgacatcttcagaaagaaacgcctgacgattatggatctgcatcccggggccggaaagaccaaacggtatctccctgcgatcgtgagagaagctattaagcgcggcctgcggacacttatcctggccccgaccagagtcgtggccgctgagatggaagaggccctccgcgggctgcccatccggtaccagacccctgctattagagccgagcacacaggacgcgaaatcgttgacctcatgtgtcatgcgacgttcaccatgcggctgctttctcccattagagtgcctaattataacctgatcattatggatgaggcccactttacagaccccgcttccatcgccgctcggggctacattagcacccgcgtcgaaatgggggaggccgccggcatcttcatgacagctaccccgcctggatccagagacccctttccccagtctaatgcgcctatcatggatgaggaacgggagattcccgaacgcagctggaactccggccacgagtgggtgacggacttcaaggggaaaacagtgtggtttgtccctagcatcaaggccggaaatgatattgctgcctgcctgcgcaaaaatggcaagaaagttatccaactctctcggaagaccttcgactccgaatatattaagaccagaacaaatgattgggactttgtggtgaccacagatatcagcgagatgggggccaacttcaaagctgagcgcgtcatcgacccgcggagatgtatgaagcccgtgattctgaccgatggagaagaaagagttatccttgccggccctatgcccgtgacgcattctagcgcggctcagcggagagggcgcgtcggccggaatcctaaaaacgaaaatgaccagtacatttacatgggagagcccctggaaaacgatgaggactgcgcccactggaaggaggccaaaatgctcctggacaacatcaatacaccggaaggcattatcccttccatgtttgagcccgaaagagagaaggtggatgctatcgacggggaatatcgcctgagaggagaggcccggaaaaccttcgttgatctcatgcgcagaggcgaccttcctgtgtggctggcgtaccgggtcgccgctgaggggattaactatgccgatcgcagatggtgttttgacggagtgaagaataaccaaatcctggaagagaatgtcgaagtggagatttggacaaaggagggcgaacggaaaaagctcaaacccagatggctggatgctcgcatctactctgaccctcttgccctgaaggagttcaaagagttcgctgccgggcggaagtccctcaccctgaacctgattacggagatgggcagactccccacctttatgacacagaaggcgcgcaatgcccttgataacctggctgttctgcataccgccgaagctggaggccgggcctataatcacgccctctccgagctgccggagacacttgaaaccctgctcctgctgacactccttgctaccgtgacaggcgggatcttcctgtttctgatgtctgggaaagggattggaaagatgacactcggcatgtgctgcatcatcaccgcgagcgtgctgctttggtacgcccagattcagcctcactggatcgctgcctccattatcctggagttctttctcattgtcctgctgatccccgaacccgagaaacaaagaacccctcaggacaaccagctcacatatgttgtgatcgccattcttaccgtggtcgctgccacaatggcgaatgaaatgggcttcctggagaagacgaaaaaggattttgggctgggaagcatcgccacccagcaaccggagtctaacattctcgacatcgatctgcggcccgcttccgcctggacactttacgctgtggccaccacattcattacccctatgctgcgccatagcatcgaaaattcctctgttaacgtgagcctcacggcgatcgccaatcaggctaccgtcctgatgggcctggggaagggatggcccctctccaaaatggacattggcgtgcctcttctggccatcgggtgttactctcaggtcaaccccattacactgaccgctgccctcctgcttctggtggctcactatgccatcattggacctggcctccaggcgaaggccacaagagaggctcaaaaacgggccgctgccggcatcatgaagaatccgaccgttgacgggattacggtgatcgatctggaccccatcccttacgatcccaaatttgaaaagcagctgggacaggtcatgctccttgtgctgtgcgttacacaggtgctgatgatgcgcaccacatgggccctctgtgaggcgctgacccttgctaccggccctattagcacactgtgggaagggaaccccggaagattctggaacacgaccatcgccgtctccatggctaatatttttcggggcagctatctcgccggggccggactgctgttctctatcatgaagaacacagctaatacccgcagaggcacaggcaacaccggggagacgctcggagagaaatggaagaatcggcttaacgccctgggcaaatccgaatttcaagtgtacaagaaaagcgggattcaggaggtggaccgcacactggcgaaggaaggaatcgagagaggcgagaccgatcatcacgccgtttctcgggggtccgctaaactcagatggttcgtcgaacgcaatctggtgaccccggagggaaaggtggtcgaccttggctgcggcagagggggatggagctattactgtggcgggctgaagaacgttaaagaagtgaagggactcacaaaaggcgggcctggacatgaggaacccatccccatgtctacctatggctggaatctggtgcggctgcagagcggcgtcgatgtgttctttacacctcccgagaagtgcgacacgctcctttgtgatattggggagtcctctcctaacccgaccgttgaagccggacgcacactgcgggtgctgaatctcgtcgagaactggctgaataacaatacccaattctgcatcaaagtgcttaacccctacatgcctagcgttattgaaaagatggaggctctgcagagaaagtacggcggggccctcgtgcgcaaccccctgtcccggaatagcacacacgaaatgtattgggtctccaacgcgtctggaaatatcgtgagctccgtgaacatgatttctagaatgctgatcaatcgctttaccatgcggcacaaaaaggccacgtacgagcctgacgtcgatctcggcagcgggaccagaaacatcggaattgagtccgaaatccccaatcttgacattatcggcaaacgcattgagaagatcaaacaggaacatgagacatcttggcactatgatcaggaccatccgtacaagacctgggcttatcacggcagctacgaaacaaagcaaaccgggtccgccagctctatggttaacggagtggtgcggctgctgacaaaaccttgggacgtcatccccatggtgacccagatggctatgacggatacaacccctttcggccagcagagagtttttaaggagaaagtggacacccgcacacaagagcccaaggaagggacgaaaaagctcatgaagattaccgccgagtggctgtggaaagaacttggaaagaaaaagacacctagaatgtgtacccgggaggagttcacacgcaaagtcagatccaatgctgccctgggcgcgatctttaccgatgaaaacaagtggaaaagcgcccgggaggctgtggaagactctgggttctgggagctcgttgataaggaaagaaatctgcacctggagggaaagtgcgagacatgtgtgtataacatgatgggcaaacgggaaaagaaactcggcgagtttgggaaggccaaaggatcccgcgctatttggtacatgtggctgggcgccagattccttgaatttgaggccctggggttcctcaatgaagaccattggtttagccgggagaactctctgtccggagtcgagggcgaagggcttcacaagctgggctacatcctccgcgatgtgagcaagaaagagggaggcgcgatgtatgctgacgataccgccgggtgggacacgagaattaccctggaagatctgaagaatgaggaaatggttacaaaccatatggagggagagcacaaaaagctcgccgaagctatcttcaaactgacctaccagaacaaggtggtccgggtgcagcgccccacaccgagaggcaccgtcatggacattatctcccggcgcgaccagagagggagcggacaagtggttacgtatggccttaatacattcaccaacatggaggcccagctgatccggcagatggaaggggagggcgtgtttaagtctattcaacatctcacagtcaccgaggaaatcgctgtgaaaaattggctggcccgcgtgggaagagagcggcttagccgcatggcgatttccggcgatgactgcgttgtgaagcctctggatgacagattcgcctctgctctcacggccctgaacgatatggggaaagtccggaaggacatccagcagtgggaacccagcagaggatggaatgattggacccaggtgcccttttgctcccaccacttccatgagctgattatgaaagacggccgcgttctcgtggtcccttgtcggaaccaagatgaactgatcgggagagctcgcatctctcagggagccggctggagccttcgggagacagcgtgcctggggaagtcctacgcccagatgtggtctctcatgtattttcacagacgcgacctgcggcttgctgccaatgctatttgtagcgccgtgccgtcccattgggtccccaccagcagaacaacctggtctatccacgctacacacgagtggatgaccacggaagatatgctgacagtgtggaaccgcgtttggattcaggagaatccttggatggaagacaagacccccgtggagtcctgggaagagatcccttacctcggcaaacgggaggatcaatggtgcggaagcctgattggcctgacctctagagccacatgggcgaagaacatccagaccgccatcaatcaggtccgctccctcattgggaacgaagagtatacagactacatgcccagcatgaaacggttcagacgggaagaggaagaggctggagtgctgtggtga

SEQ ID NO: 19532 - RNA, 9876 nt, synthetic construct
  misc_feature 1..9876: note = derived and/or modified CDS sequence (opt5) from DENV-2__AB189123__SS-prME
  source 1..9876: mol_type = other RNA
accgccggagtgatcattatgatgatccccaccgtcatggctttccacctgacgaccagaaacggggaacctcatatgattgttagccggcaggaaaagggaaaatccctcctgtttaagacggagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtgacgtatggaacctgtacagcgaccggcgagcacagacgggaaaaacgctccgtcgctctggcccctcatgtggggatgggactcgagacaagaaccgaaacgtggatgtctagcgagggcgcctggaagcacgctcagcggatcgagacatgggttctgcgccatcccggcttcaccatcatggccgctattctggcctacacaatcgggaccacctattttcagagagtgctcattttcatcctgcttacagcggtcgccccttccatgacgatgcggtgcattggaatctctaaccgcgactttgtggaaggcgttagcgggggatcctgggtggatattgtcctggagcacggcagctgtgtgaccacaatggctaaaaataagcccaccctcgacttcgaactgatcaagacagaggccaaacaccctgctacccttagaaagtactgcatcgaagccaaactgacgaacacaaccaccgcgtctcggtgtccgacacagggggagccctccctcaatgaggaacaagataagcgctttgtgtgcaaacatagcatggtcgacagaggatggggcaacggctgtgggctgttcggaaagggcgggattgttacctgcgccatgtttacatgcaagaaaaatatggagggaaaggtggtgcagcctgaaaacctggagtatacgatcgtcattacaccccactctggcgaagagaatgctgtggggaacgatacaggaaaacatggcaaggagatcaaagttacccctcagtccagcattacagaagccgagctcaccggctacgggacggtgaccatggaatgttctccccggacaggactggacttcaatgagatggtccttctgcagatggaaaacaaggcttggctcgtgcaccgccaatggtttctggatcttccgctgccttggctccccggcgccgacacccaggggtccaactggatccagaaagagacactggttaccttcaagaatcctcacgccaagaaacaggatgtggtcgtgctgggaagccaagagggcgctatgcatacggcgctcacaggggccaccgaaatccagatgtcctctggcaacctgctttttacaggacacctgaagtgcagactccggatggacaaactgcagcttaagggcatgagctattccatgtgtaccgggaaattcaaggtcgtgaaggagattgctgaaacccaacatggaacaatcgttattagagtgcagtacgagggcgacgggagcccctgcaaaatccccttcgagattatggatctggaaaagcgccacgtcctcggacggctgatcacggtgaatcctatcgttaccgagaaagactctccggtgaacattgaagccgagcccccttttggcgattcctacatcattatcggggtcgaacccggccagctgaagctcaattggttcaaaaagggaagctctattggccagatgtttgagacaaccatgagaggggccaagcgcatggctatcctgggagacacagcctgggatttcggcagccttgggggagtgtttacctccattggcaaagcgctgcatcaagtgttcggggctatctatggcgccgccttttctggagttagctggacgatgaagatcctcattggcgtcgtgatcacatggattgggatgaactcccggagcacctctctgtccgtgagcctggtccttgtgggagttgtgaccctctacctgggcgtcatggtgcaggctgactctgggtgtgttgtgtcctggaaaaataaggagctgaaatgcggaagcggcatcttcattacagataacgtccacacctggacagaacagtataagtttcagcctgagtccccctctaagctcgccagcgctatccaaaaagcccacgaagaggggatctgtggcattagatccgtgacgcgcctggaaaatcttatgtggaagcagatcaccccggagctgaaccatattctctctgagaatgaagttaaactgacaatcatgaccggagacattaagggcatcatgcaggcggggaaacggagcctgagacctcagcccacagagcttaagtactcctggaaagcctggggaaaggctaagatgctcagcaccgaactgcacaaccatacgttcctgatcgatggccctgagaccgccgaatgccccaatacaaaccgcgcttggaactctctcgaggtggaggactatgggtttggagtcttcaccacaaacatttggctgaaacttaaggaacggcaagatgtgttttgtgactccaaactgatgagcgccgcgatcaaggacaacagagccgtgcacgctgatatgggctactggattgagtctgccctcaatgacacctggaaaatcgaaaaggcttccttcattgaggtcaagagctgccactggcctaaatctcatacactgtggagcaacggcgttctggagtccgaaatgatcatccccaagaatttcgccgggccggtgagccagcacaactatcgccctggataccatacccagacggccggcccctggcaccttgggaaactcgagatggattttgacttctgtgaaggaacaaccgtggtcgtgaccgaggattgcggcaatcgggggccctctctgagaacaaccacggcttccggaaagctgattacagaatggtgctgtcggagctgcaccctccctccgctgcgctacagaggcgaggacggctgttggtatgggatggagatccggccccttaaagaaaaggaggaaaacctggttaattccctcgtgacagcgggacatggccagattgataacttttctctgggggtcctgggaatggcccttttcctcgaggaaatgctgagaacccgcgtgggcacaaagcacgctatcctgctcgttgccgtgagctttgtcaccctgattacggggaatatgtccttccgggaccttggaagagtgatggttatggtgggcgccaccatgacagatgacatcggcatgggggtcacctacctggctctcctggccgcgtttaaagtgcgccctacattcgctgccggactgcttctgagaaagctcacctctaaagagctgatgatgacgacaattggcatcgtgctcctgagccaatccaccatccccgagacaattcttgaactgaccgatgccctcgctctggggatgatggtcctgaagatcgttcggaacatggagaaatatcagcttgccgtgaccattatggcgatcctgtgcgtgcctaatgctgtcattctccagaacgcctggaaggtgtcttgtacaacgctggccgttgtgagcgtcagccccctcctgcttaccagctctcaacagaaggctgactggatccctctggccctcacaatcaaaggactgaatcccaccgctatttttctgacaaccctttcccgcacgagcaagaaaagatcttggccgctgaacgaagccatcatggcggtgggcatggtttccattctcgccagctctctgctcaagaatgatatccctatgacagggcccctggtggctggaggccttctgaccgtctgctacgtgctgaccggccggtccgccgacctcgagctggaacgcgctgccgacgtcagatgggaggagcaggccgaaattagcgggtccagccctatcctttctatcacaattagcgaggatggatccatgtctatcaaaaacgaagaggaggaacagaccctgacaattctcatccggacgggcctgctcgtgattagcgggctgttccccgtttccatcccgattaccgctgcggcctggtatctttgggaggtgaagaaacaacgcgctggagtcctgtgggacgtgccttctccccctcccgttggcaaggccgaactggaggatggggcctacagaatcaagcagaaaggaatcctcggctatagccagattggcgctggggtgtacaaggaaggaacatttcacaccatgtggcatgtcacacggggcgccgtgctgatgcacaaagggaagcgcatcgagccctcctgggcggacgtgaaaaaggatcttatttcttacggaggcgggtggaagctggagggagaatggaaagagggcgaagaggttcaggtcctcgctctggaacctggcaagaacccgagagccgtgcaaaccaaacccggactcttcaagacgaataccggaacaatcggcgccgtgagcctggacttttcccctgggaccagcggatctcccattgtcgataaaaagggcaaggtggttgggctttatggaaacggcgtggtcacacggtccggcacctacgtgagcgctatcgcccagacagagaaaaatatcgaggacaaccctgaaattgaggatgacatcttcagaaagaaacgcctgacgattatggatctgcatcccggggcgggaaagaccaaacggtatctccctgctatcgttagagaagccattaagcgcggcctgcggacacttatcctggccccgaccagagtggtcgctgccgagatggaagaggctctccgcgggctgcccatccggtaccagacccctgccattagagcggagcacacaggacgcgaaatcgtggacctcatgtgtcatgccacgttcaccatgcggctgctttctcccattagagttcctaattataacctgatcattatggatgaggctcactttacagaccccgcctccatcgctgcccggggctacattagcacccgcgtggaaatgggggaggccgctggcatcttcatgacagcgaccccgcctggatccagagacccctttccccagtctaatgcccctatcatggatgaggaacgggagattcccgaacgcagctggaactccggccacgagtgggtcacggacttcaaggggaaaacagtgtggtttgtgcctagcatcaaggctggaaatgatattgccgcctgcctgcgcaaaaatggcaagaaagtcatccaactctctcggaagaccttcgactccgaatatattaagaccagaacaaatgattgggactttgttgtgaccacagatatcagcgagatgggggctaacttcaaagccgagcgcgtgatcgacccgcggagatgtatgaagcccgtcattctgaccgatggagaagaaagagtgatccttgcgggccctatgcccgttacgcattctattgctgcccagcggagagggcgcgtgggccggaatcctaaaaacgaaaatgaccagtacatctacatgggagagcccctggaaaacgatgaggactgcgcccactggaaggaggctaaaatgctcctggacaacattaatacaccggaaggcatcatccctagcatgtttgagcccgaaagagagaaggtcgatgccattgacggggaatatcgcctgagaggagaggcgcggaaaaccttcgtggatctcatgcgcagaggcgaccttcctgtttggctggcctaccgggtggctgccgaggggatcaactatgctgatcgcagatggtgttttgacggagtcaagaataaccaaattctggaagagaatgtggaagtcgagatctggacaaaggagggcgaacggaaaaagctcaaacccagatggctggatgcccgcatttactccgaccctcttgctctgaaggagttcaaagagttcgccgcggggcggaagtctctcaccctgaacctgatcacggagatgggcagactccccacctttatgacacagaaggcccgcaatgctcttgataacctggccgtgctgcataccgctgaagccggaggccgggcctataatcacgctctcagcgagctgccggagacacttgaaaccctgctcctgctgacactccttgcgaccgttacaggcgggattttcctgtttctgatgtccgggaaagggatcggaaagatgacactcggcatgtgctgcatcattaccgcctctgtgctgctttggtacgctcagatccagcctcactggattgccgccagcatcattctggagttctttctcatcgtgctgctgatccccgaacccgagaaacaaagaacccctcaggacaaccagctcacatatgtcgttattgctatccttaccgtggtggccgcgacaatggccaatgaaatgggcttcctggagaagacgaaaaaggattttgggctgggatccattgctacccagcaaccggagagcaacatcctcgacattgatctgcggcccgcctctgcttggacactttacgccgtcgcgaccacattcatcacccctatgctgcgccattccatcgaaaatagctccgtgaacgtttctctcacggccattgctaatcaggccaccgtgctgatgggcctggggaagggatggcccctcagcaaaatggacatcggcgtccctcttctggctattgggtgttactcccaggtgaaccccatcacactgaccgccgctctcctgcttctggtcgcccactatgcgattatcggacctggcctccaggccaaggctacaagagaggcccaaaaacgggctgccgccggcattatgaagaatccgaccgtggacgggatcacggttatcgatctggaccccattccttacgatcccaaatttgaaaagcagctgggacaggtgatgctccttgtcctgtgcgtgacacaggttctgatgatgcgcaccacatgggcgctctgtgaggctctgacccttgccaccggccctatctctacactgtgggaagggaaccccggaagattctggaacacgaccattgctgtgagcatggccaatatctttcggggctcctatctcgccggggctggactgctgttcagcattatgaagaacacagccaatacccgcagaggcacaggcaacaccggggagacgctcggagagaaatggaagaatcggcttaacgcgctgggcaaatctgaatttcaaatctacaagaaatccgggatccaggaggtcgaccgcacactggccaaggaaggaattgagagaggcgagaccgatcatcacgctgtgagccgggggtctgccaaactcagatgcttcgtggaacgcaatctggttaccccggagggaaaggtcgtggaccttggctgtggcagagggggatggtcctattactgcggcgggctgaagaacgtgaaagaagtcaagggactcacaaaaggcgggcctggacatgaggaacccatccccatgagcacctatggctggaatctggttcggctgcagtctggcgtggatgtgttctttacacctcccgagaagtgtgacacgctcctttgcgatattggggagagctcccctaacccgaccgtcgaagctggacgcacactgcgggtgctgaatctcgttgagaactggctgaaaaataacacccaattctgtatcaaggtgcttaatccctacatgccttctgtcattgaaaagatggaggccctgcagagaaaatacggcggggcgctcgtgcgcaaccccctgagccggaactccacacacgaaatgtattgggttagcaatgcctccggaaacatcgtgtctagcgtcaatatgatctccagaatgctgattaaccgctttaccatgcggcacaagaaagctacgtacgagcctgacgtggatctcggctctgggaccagaaatatcggaattgagagcgaaatccccaaccttgacattatcggcaagcgcatcgagaaaattaagcaggaacatgagacatcctggcactatgatcaggaccatccgtacaagacctgggcctatcacggctcttacgaaacaaaacaaaccgggagcgcttccagcatggtgaatggagtcgttcggctgctgacaaagccttgggacgtgatccccatggtgacccagatggccatgacggatacaacccctttcggccagcagagagtctttaaagagaaggtggacacccgcacacaagagcccaaagaagggacgaagaagctcatgaaaattaccgctgagtggctgtggaaggaacttggcaaaaagaaaacacctagaatgtgcacccgggaggagttcacacgcaaggttagatctaacgccgcgctgggcgccatctttaccgatgaaaataaatggaagtccgctcgggaggccgtggaagacagcgggttctgggagctcgtcgataaggaaagaaacctgcacctggagggaaaatgtgagacatgcgtgtataatatgatgggcaagcgggagaaaaagctcggcgagtttgggaaagctaagggatctcgcgccatttggtacatgtggctgggcgccagattccttgaatttgaggcgctggggttcctcaacgaagaccattggttttcccgggagaatagcctgtctggagttgagggcgaagggcttcacaagctgggctacatcctccgcgatgtgtccaaaaaggagggaggcgctatgtatgccgacgataccgccgggtgggacacgagaattaccctggaagatctgaaaaacgaggaaatggtcacaaatcatatggagggagagcacaagaaactcgctgaagccatcttcaagctgacctaccagaacaaggtggttcgggtgcagcgccccacaccgagaggcaccgtccttgacatcattagccggcgcgaccagagagggtccggacaagtggtcacgtatggcctgaacacattcaccaatatggaggctcagctcatccggcagatggaaggggagggcgtgtttaaaagcattcaacatctgacagttaccgaggaaatcgccgtgaagaactggcttgcgcgcgtcggaagagagcggctgtctcgcatggccattagcggcgatgactgcgtggtgaaacctctcgatgacagattcgcttccgccctgacggctctgaatgatatggggaaggttcggaaagacatccagcagtgggaaccctctagaggatggaacgattggacccaggtgcccttttgtagccaccacttccatgagctcatcatgaaggacggccgcgtcctggtggttccttgccggaatcaagatgaacttattgggagagcccgcatctcccagggagcgggctggtctctgcgggagacagcctgtctcgggaagtcctacgctcagatgtggtccctgatgtattttcacagacgcgaccttcggctggccgctaacgccatttgctctgctgtgccgagccattgggtccccacctccagaacaacctggagcatccacgccacacacgagtggatgaccacggaagatatgctcacagtgtggaatcgcgtctggattcaggagaacccttggatggaagacaaaacccccgtggagtcttgggaagagatcccttacctgggcaagcgggaggatcaatggtgtggatccctgatcggcctcaccagcagagcgacatgggccaaaaatattcagaccgctatcaaccaggttcgctctctgattgggaatgaagagtatacagactacatgccctccatgaagcggttcagacgggaagaggaagaggccggagtgctttggtga

SEQ ID NO: 19533 - RNA, 9876 nt, synthetic construct
  misc_feature 1..9876: note = derived and/or modified CDS sequence (opt5) from DENV-2__AB189124__SS-prME
  source 1..9876: mol_type = other RNA
accgccggagtgatcattatgatgatccccaccgtcatggctttccacctgacgaccagaaacggggagcctcatatgattgttagccggcaggaaaagggaaaatccctcctgtttaagacggagaatggcgtgaacatgtgcacccttatggccatggacctgggggaactctgtgaggatacaatcacctacaattgcccgctgcttcgccaaaacgaacccgaggacattgattgttggtgcaattctacaagcacctgggtgacgtatggaacctgtacagcgaccggcgagcacagacgggaaaaacgctccgtcgctctggcccctcatgtggggatgggactcgagacaagaaccgaaacgtggatgtctagcgagggcgcctggaagcacgctcagcggatcgagacatgggttctgcgccatcccggcttcaccatcatggccgctattctggcctacacaatcgggaccacctattttcagagagtgctcattttcatcctgcttacagcggtcgccccttccatgacgatgcggtgcattggaatctctaaccgcgactttgtggaaggcgttagcgggggatcctgggtggatattgtcctggagcacggcagctgtgtgaccacaatggctaaaaataagcccaccctcgacttcgaactgatcaagacagaggccaaacaccctgctacccttagaaagtactgcatcgaagccaaactgacgaacacaaccaccgcgtctcggtgtccgacacagggggagccctccctcaatgaggaacaagataagcgctttgtgtgcaaacatagcatggtcgacagaggatggggcaacggctgtgggctgttcggaaagggcgggattgttacctgcgccatgtttacatgcaagaaaaatatggagggaaaggtggtgcagcctgaaaacctggagtatacgatcgtcattacaccccactctggcgaagagaatgctgtggggaacgatacaggaaaacatggcaaggagatcaaagttacccctcagtccagcattacagaagccgagctcaccggctacgggacggtgaccatggaatgttctccccggacaggactggacttcaatgagatggtccttctgcagatggaaaacaaggcttggctcgtgcaccgccaatggtttctggatcttccgctgccttggctccccggcgccgacacccaggggtccaactggatccagaaagagacactggttaccttcaagaatcctcacgccaagaaacaggatgtggtcgtgctgggaagccaagagggcgctatgcatacggcgctcacaggggccaccgaaatccagatgtcctctggcaacctgctttttacaggacacctgaagtgcagactccggatggacaaactgcagcttaagggcatgagctattccatgtgtaccgggaaattcaaggtcgtgaaggagattgctgaaacccaacatggaacaatcgttattagagtgcagtacgagggcgacgggagcccctgcaaaatccccttcgagattatggatctggaaaagcgccacgtcctcggacggctgatcacggtgaatcctatcgttaccgagaaagactctccggtgaacattgaagccgagcccccttttggcgattcctacatcattatcggggtcgaacccggccagctgaagctcaattggttcaaaaagggaagctctattggccagatgtttgagacaaccatgagaggggccaagcgcatggctatcctgggagacacagcctgggatttcggcagccttgggggagtgtttacctccattggcaaagcgctgcatcaagtgttcggggctatctatggcgccgccttttctggagttagctggacgatgaagatcctcattggcgtcgtgatcacatggattgggatgaactcccggagcacctctctgtccgtgagcctggtccttgtgggagttgtgaccctctacctgggcgtcatggtgcaggctgactctgggtgtgttgtgtcctggaaaaataaggagctgaaatgcggaagcggcatcttcattacagataacgtccacacctggacagaacagtataagtttcagcctgagtccccctctaagctcgccagcgctatccaaaaagcccacgaagaggggatctgtggcattagatccgtgacgcgcctggaaaatcttatgtggaagcagatcaccccggagctgaaccatattctctctgagaatgaagttaaactgacaatcatgaccggagacattaagggcatcatgcaggcggggaaacggagcctgagacctcagcccacagagcttaagtactcctggaaagcctggggaaaggctaagatgctcagcaccgaactgcacaaccatacgttcctgatcgatggccctgagaccgccgaatgccccaatacaaaccgcgcttggaactctctcgaggtggaggactatgggtttggagtcttcaccacaaacatttggctgaaacttaaggaacggcaagatgtgttttgtgactccaaactgatgagcgccgcgatcaaggacaacagagccgtgcacgctgatatgggctactggattgagtctgccctcaatgacacctggaaaatcgaaaaggcttccttcattgaggtcaagagctgccactggcctaaatctcatacactgtggagcaacggcgttctggagtccgaaatgatcatccccaagaatttcgccgggccggtgagccagcacaactatcgccctggataccatacccagacggccggcccctggcaccttgggaaactcgagatggattttgacttctgtgaaggaacaaccgtggtcgtgaccgaggattgcggcaatcgggggccctctctgagaacaaccacggcttccggaaagctgattacagaatggtgctgtcggagctgcaccctccctccgctgcgctacagaggcgaggacggctgttggtatgggatggagatccggccccttaaagaaaaggaggaaaacctggttaattccctcgtgacagcgggacatggccagattgataacttttctctgggggtcctgggaatggcccttttcctcgaggaaatgctgagaacccgcgtgggcacaaagcacgctatcctgctcgttgccgtgagctttgtcaccctgattacggggaatatgtccttccgggaccttggaagagtgatggttatggtgggcgccaccatgacagatgacatcggcatgggggtcacctacctggctctcctggccgcgtttaaagtgcgccctacattcgctgccggactgcttctgagaaagctcacctctaaagagctgatgatgacgacaattggcatcgtgctcctgagccaatccaccatccccgagacaattcttgaactgaccgatgccctcgctctggggatgatggtcctgaagatcgttcggaacatggagaaatatcagcttgccgtgaccattatggcgatcctgtgcgtgcctaatgctgtcattctccagaacgcctggaaggtgtcttgtacaacgctggccgttgtgagcgtcagccccctcctgcttaccagctctcaacagaaggctgactggatccctctggccctcacaatcaaaggactgaatcccaccgctatttttctgacaaccctttcccgcacgagcaagaaaagatcttggccgctgaacgaagccatcatggcggtgggcatggtttccattctcgccagctctctgctcaagaatgatatccctatgacagggcccctggtggctggaggccttctgaccgtctgctacgtgctgaccggccggtccgccgacctcgagctggaacgcgctgccgacgtcagatgggaggagcaggccgaaattagcgggtccagccctatcctttctatcacaattagcgaggatggatccatgtctatcaaaaacgaagaggaggaacagaccctgacaattctcatccggacgggcctgctcgtgattagcgggctgttccccgtttccatcccgattaccgctgcggcctggtatctttgggaggtgaagaaacaacgcgctggagtcctgtgggacgtgccttctccccctcccgttggcaaggccgaactggaggatggggcctacagaatcaagcagaaaggaatcctcggctatagccagattggcgctggggtgtacaaggaaggaacatttcacaccatgtggcatgtcacacggggcgccgtgctgatgcacaaagggaagcgcatcgagccctcctgggcggacgtgaaaaaggatcttatttcttacggaggcgggtggaagctggagggagaatggaaagagggcgaagaggttcaggtcctcgctctggaacctggcaagaacccgagagccgtgcaaaccaaacccggactcttcaagacgaataccggaacaatcggcgccgtgagcctggacttttcccctgggaccagcggatctcccattgtcgataaaaagggcaaggtggttgggctttatggaaacggcgtggtcacacggtccggcacctacgtgagcgctatcgcccagacagagaaaaatatcgaggacaaccctgaaattgaggatgacatcttcagaaagaaacgcctgacgattatggatctgcatcccggggcgggaaagaccaaacggtatctccctgctatcgttagagaagccattaagcgcggcctgcggacacttatcctggccccgaccagagtggtcgctgccgagatggaagaggctctccgcgggctgcccatccggtaccagacccctgccattagagcggagcacacaggacgcgaaatcgtggacctcatgtgtcatgccacgttcaccatgcggctgctttctcccattagagttcctaattataacctgatcattatggatgaggctcactttacagaccccgcctccatcgctgcccggggctacattagcacccgcgtggaaatgggggaggccgctggcatcttcatgacagcgaccccgcctggatccagagacccctttccccagtctaatgcccctatcatggatgaggaacgggagattcccgaacgcagctggaactccggccacgagtgggtcacggacttcaaggggaaaacagtgtggtttgtgcctagcatcaaggctggaaatgatattgccgcctgcctgcgcaagaatggcaagaaagtcatccaactctctcggaagaccttcgactccgaatatattaagaccagaacaaatgattgggactttgttgtgaccacagatatcagcgagatgggggctaacttcaaagccgagcgcgtgatcgacccgcggagatgtatgaagcccgtcattctgaccgatggagaagaaagagtgatccttgcgggccctatgcccgttacgcattctagcgctgcccagcggagagggcgcgtgggccggaatcctaaaaacgaaaatgaccagtacatttacatgggagagcccctggaaaacgatgaggactgcgcccactggaaggaggctaaaatgctcctggacaacatcaatacaccggaaggcattatcccttccatgtttgagcccgaaagagagaaggtcgatgccatcgacggggaatatcgcctgagaggagaggcgcggaaaaccttcgtggatctcatgcgcagaggcgaccttcctgtttggctggcctaccgggtggctgccgaggggattaactatgctgatcgcagatggtgttttgacggagtcaagaataaccaaatcctggaagagaatgtggaagtcgagatttggacaaaggagggcgaacggaaaaagctcaaacccagatggctggatgcccgcatctactctgaccctcttgctctgaaggagttcaaagagttcgccgcggggcggaagtccctcaccctgaacctgattacggagatgggcagactccccacctttatgacacagaaggcccgcaatgctcttgataacctggccgtgctgcataccgctgaagccggaggccgggcctataatcacgctctctccgagctgccggagacacttgaaaccctgctcctgctgacactccttgcgaccgttacaggcgggatcttcctgtttctgatgtctgggaaagggattggaaagatgacactcggcatgtgctgcatcatcaccgccagcgtgctgctttggtacgctcagattcagcctcactggatcgccgcctccattatcctggagttctttctcattgtgctgctgatccccgaacccgagaaacaaagaacccctcaggacaaccagctcacatatgtcgttatcgctattcttaccgtggtggccgcgacaatggccaatgaaatgggcttcctggagaagacgaaaaaggattttgggctgggaagcatcgctacccagcaaccggagtctaacattctcgacatcgatctgcggcccgcctccgcttggacactttacgccgtcgcgaccacattcattacccctatgctgcgccatagcatcgaaaattcctctgtgaacgttagcctcacggccatcgctaatcaggccaccgtgctgatgggcctggggaagggatggcccctctccaaaatggacattggcgtccctcttctggctatcgggtgttactctcaggtgaaccccattacactgaccgccgctctcctgcttctggtcgcccactatgcgatcattggacctggcctccaggccaaggctacaagagaggcccaaaaacgggctgccgccggcatcatgaagaatccgaccgtggacgggattacggttatcgatctggaccccatcccttacgatcccaaatttgaaaagcagctgggacaggtgatgctccttgtcctgtgcgtgacacaggttctgatgatgcgcaccacatgggcgctctgtgaggctctgacccttgccaccggccctattagcacactgtgggaagggaaccccggaagattctggaacacgaccatcgctgtgtccatggccaatatttttcggggcagctatctcgccggggctggactgctgttctctatcatgaagaacacagccaatacccgcagaggcacaggcaacaccggggagacgctcggagagaaatggaagaatcggcttaacgcgctgggcaaatccgaatttcaaatttacaagaaaagcgggatccaggaggtcgaccgcacactggccaaggaaggaatcgagagaggcgagaccgatcatcacgctgtgtctcgggggtccgccaaactcagatggttcgtggaacgcaatctggttaccccggagggaaaggtcgtggaccttggctgcggcagagggggatggagctattactgtggcgggctgaagaacgtgaaagaagtcaagggactcacaaaaggcgggcctggacatgaggaacccattcccatgtctacctatggctggaatctggttcggctgcagagcggcgtggatgtgttctttacacctcccgagaagtgcgacacgctcctttgtgatatcggggagtcctctcctaacccgaccgtcgaagctggacgcacactgcgggtgctgaatctcgttgagaactggctgaaaaataacacccaattctgcattaaggtgcttaatccctacatgcctagcgtcatcgaaaagatggaggccctgcagagaaaatacggcggggcgctcgtgcgcaaccccctgtcccggaacagcacacacgaaatgtattgggtttccaatgcctctggaaacattgtgagctccgtcaatatgatctctagaatgctgatcaaccgctttaccatgcggcacaagaaagctacgtacgagcctgacgtggatctcggcagcgggaccagaaatattggaatcgagtccgaaattcccaaccttgacatcattggcaagcgcatcgagaaaatcaagcaggaacatgagacatcttggcactatgatcaggaccatccgtacaagacctgggcctatcacggcagctacgaaacaaaacaaaccgggtccgctagctctatggtgaatggagtcgttcggctgctgacaaagccttgggacgtgattcccatggtgacccagatggccatgacggatacaacccctttcggccagcagagagtctttaaagagaaggtggacacccgcacacaagagcccaaagaagggacgaagaagctcatgaaaatcaccgctgagtggctgtggaaggaacttggcaaaaagaaaacacctagaatgtgtacccgggaggagttcacacgcaaggttagatccaacgccgcgctgggcgccatttttaccgatgaaaataaatggaaaagcgctcgggaggccgtggaagactctgggttctgggagctcgtcgataaggaaagaaacctgcacctggagggaaaatgcgagacatgtgtgtataatatgatgggcaagcgggagaaaaagctcggcgagtttgggaaagctaagggatcccgcgccatctggtacatgtggctgggcgccagattccttgaatttgaggcgctggggttcctcaacgaagaccattggtttagccgggaaaattctctgtccggagttgagggcgaagggcttcacaagctgggctacattctccgcgatgtgagcaaaaaggagggaggcgctatgtatgccgacgataccgccgggtgggacacgagaatcaccctggaagatctgaaaaacgaggaaatggtcacaaatcatatggagggagagcacaagaaactcgctgaagccattttcaagctgacctaccagaacaaggtggttcgggtgcagcgccccacaccgagaggcaccgtcatggacatcatctcccggcgcgaccagagagggagcggacaagtggtcacgtatggccttaacacattcaccaatatggaggctcagctgattcggcagatggaaggggagggcgtgtttaaatctatccaacatctcacagttaccgaggaaattgccgtgaagaactggctggcgcgcgtcggaagagagcggcttagccgcatggccatctccggcgatgactgcgtggtgaaacctctggatgacagattcgcttctgccctcacggctctgaatgatatggggaaggttcggaaagacattcagcagtgggaacccagcagaggatggaacgattggacccaggtgcccttttgctcccaccacttccatgagctgatcatgaaggacggccgcgtcctcgtggttccttgtcggaatcaagatgaactgatcgggagagcccgcatttctcagggagcgggctggagccttcgggagacagcctgcctggggaagtcctacgctcagatgtggtctctcatgtattttcacagacgcgacctgcggcttgccgctaacgccatctgtagcgctgtgccgtcccattgggtccccaccagcagaacaacctggtctattcacgccacacacgagtggatgaccacggaagatatgctgacagtgtggaatcgcgtctggatccaggagaacccttggatggaagacaaaacccccgtggagtcctgggaagagattccttacctcggcaagcgggaggatcaatggtgcggaagcctgatcggcctgacctctagagcgacatgggccaaaaatatccagaccgctattaaccaggttcgctccctcatcgggaatgaagagtatacagactacatgcccagcatgaagcggttcagacgggaagaggaagaggccggagtgctgtggtga

SEQ ID NO: 19534 - RNA, 9876 nt, synthetic construct
  misc_feature 1..9876: note = derived and/or modified CDS sequence (opt5) from DENV-2__AB122020__SS-prME
  source 1..9876: mol_type = other RNA
acagccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaagaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggtgctgaaaattgtccggaacatggaaaagtaccaactcgccgtgaccatcatggcgatctcttgcgttcctaatgctgtgattctgcagaacgcctggaaggtcagctgtacaatcctcgccgctgtgtccgtgagccccctgcttctgacctcttcccagcagaaagccgactggattcctctcgctctgacaatcaagggcctgaatcccaccgccatttttcttacgacactgagccgcacctctaaaaagagatcctggccgctcaacgaggcgatcatggccgtcgggatggttagcatcctggcttcttccctcctgaaaaatgacattcctatgaccggaccccttgtggccggcggcctgctgacagtgtgctatgtcctcaccgggcggagcgctgatctggaacttgagcgcgccgccgacgtgaagtgggaggatcaagctgaaatctccggaagctctcctattctgagcatcacaatttccgaggacggctctatgagcatcaaaaacgaagaggaggaacagacgctcaccattctgatcagaacagggctcctggttatctccggagtgttccccgtctctattccgatcaccgcggccgcttggtacctttgggaggtgaagaagcagcgggccggcgttctgtgggatgtgccttctccccctcccgtcgggaaagccgaactggaggacggagcttatcgcattaagcagagaggcatcctcggctactcccaaattggggccggagtgtataaagaaggcacatttcacaccatgtggcatgtcacgagaggggcggtgctgatgcaccgcggaaagagaatcgagccctcctgggctgatgttaaaaaggaccttatcagctacggcgggggatggaagctggagggcgaatggaaagagggcgaagaggtgcaggtcctcgccctggaacctgggaagaatccgcgggccgtgcagaccaaacccggaattttcaagacaaacaccggcacaatcggggctgtttccctcgattttagccctggaacctctggctcccccattgtggacagaaaagggaaggtcgtgggactgtacggcaatggcgtggttacacgcagcggggcctatgtctctgcgatcgctcagacggagaagtccattgaggataaccctgaaatcgaggacgatatcttccggaaaaagagacttaccattatggacctgcatcccggagccggcaaaacaaagcgctacctgcctgccatcgtgcgggaagctattaaaagagggctccgcaccctgatccttgccccgacccgggtggtcgctgccgagatggaagaggcgctgagaggactccccattcgctatcaaacccctgccatccgggctgagcacacgggcagagaaattgtggacctgatgtgtcatgccaccttcacaatgcggctcctgagccccgttcgcgtgcctaactacaatcttatcatcatggatgaggctcactttaccgaccccgcctccattgccgctagagggtatatctctacacgggtcgaaatgggcgaggcggccggaattttcatgaccgctacgccgcctggcagccgcgatccctttccccagtccaacgcccctatcatggacgaggaaagagagattcccgaacggagctggaactctgggcacgagtgggtgacagatttcaagggaaagaccgtttggtttgtgccttccatcaaagccggcaacgacatcgctgcctgcctgagaaagaatgggaaaaaggtcattcagctgagccgcaaaaccttcgattctgaatacgtgaagacacgggcgaacgactgggattttgttgtgaccacagacatcagcgagatgggagctaatttcaaggccgagagagtcattgatccgcgccggtgtatgaaacccgtgatcctcaccgacggcgaagagagagtgattctggccgggcctatgcccgtcacgcattcctctgctgcccaacgccggggcagaatcggacgcaaccctaagaatgaaaacgaccagtatatctacatgggcgagccccttgaaaatgatgaggactgcgcgcactggaaagaggccaagatgctgctcgataacattaatacaccggaagggatcattcctagcatgtttgagcccgaaagagagaaagttgacgctatcgatggagaataccggctgcgcggcgaggccagaaagaccttcgtggacctgatgcggcgcggggatctccctgtgtggcttgcttataaagtcgccgctgagggaattaactacgccgacagaaagtggtgttttgatggcatcaagaataaccagattctggaagagaacgtggaagttgagatctggacaaaagagggggaacggaagaaactgaagcccagatggctcgacgcgcgcatctattccgatcctctggcccttaaagagttcaaggagttcgctgccggccggaagtctctgaccctcaatctgattacggagatgggaagactgcccacctttatgacacagaaagctcgcaacgccctcgacaatcttgccgtgctgcataccgctgaagtcggcgggcgggcgtacaaccacgccctgagcgagctcccggagacactggaaacccttctgctcctgacactgctcgctaccgtgacgggaggcatcttcctttttctgatgtccgggaagggaattggcaaaatgacactgggcatgtgctgcatcattaccgccagcatcctcctgtggtatgcccaaatccagcctcactggattgctgcctctatcattcttgagttctttctgatcgttctcctgattcccgaacccgagaagcagagaacccctcaggataatcaactgacatacgtggtcatcgcgatcctcaccgtggtcgccgctacaatggccaacgaaatggggttccttgagaaaacgaagaaggacctgggatttggctccattaccacacaggagagcgaatccaatatcctggacattgatctccggccggcttctgcctggaccctgtatgcggtggccacaaccttcgttacgcccatgcttcgccatagcatcgagaactcctctgtgaatgtgagcctgaccgctattgccaaccaggctacagtcctcatggggctgggaaaaggctggcctctgtccaagatggacatcggggttcccctccttgccattggatgttacagccaggtgaatcctatcaccctgacagctgccctgctcctgcttgtggcgcactacgccatcattggccccggcctgcaagctaaagccaccagagaagctcagaagcgggccgccgcggggatcatgaaaaaccctacggtcgatggaattacagtgatcgacctcgagccgattccctatgatcctaagtttgaaaagcagctgggccaggttatgctgctcatcctttgcgtgacccaagtcctgatgatgcgcacaacctgggctctgtgtgaggccctcaccctggctacagggcccatctctacgctttgggagggaaatcctggcagattctggaacaccacaattgccgtgtccatggccaatatctttcgggggagctacctggctggagccggcctcctgttctctattatgaaaaacaccacaaatacccgcagaggcacggggaacgtcggagaaacactgggcgagaagtggaaatcccggctcaacgcgcttggaaagagcgaatttcagatctataaaaagtctggcattcaggaggtggaccgcaccctggccaaagagggcatcaagagaggggaaaccgatcatcacgctgttagccggggatccgccaagctgagatggttcgtggagcgcaatatggtcacacccgaaggcaaagtggttgacctcggctgcgggcggggaggctggtcttactattgtgggggactgaagaacgtgagagaggtcaaaggccttaccaaagggggaccgggccatgaggaacctatccccatgagcacatacggctggaatctggtgcgcctccaatccggggtggatgttttctttacgccccctgagaaatgcgacaccctgctgtgtgatattggagaaagctcccccaaccctacaatcgaggctggccggaccctcagagtccttaatctggtggaaaactggctgaataacaatacacagttctgcattaaggtgctcaacccgtatatgccctctgtcatcgagaagatggaaaccctgcagcgcaaatacgggggagcccttgttcggaatcctctgagcagaaactccacgcacgagatgtactgggtgtctaatgcgaccggcaacattgtgagctccgtcaatatgatctctcgcatgctcatcaaccggtttacaatgaagcacaaaaaggccacctatgagcccgacgtggatctggggagcggaacaagaaacattggcatcgaatccgagattcctaatctggacatcattggcaaacgcatcgaaaagattaagcaggagcatgaaaccagctggcactacgaccaagatcatccctataaaacatgggcttaccacgggtcttatgagaccaagcagacgggatccgccagctctatggttaacggcgtggtccggctccttacaaaaccgtgggacgtggttcctatggtgacccagatggctatgaccgatacaacgcccttcgggcagcaaagagtctttaaggagaaagtggacacccgcacacaggaacctaaggagggaaccaagaaactgatgaagatcacagccgaatggctgtggaaagagctcggcaaggagaaaacccccagaatgtgtacacgggaagagttcacccgcaaggtgagatccaatgctgccctgggggcgatctttacggatgaaaacaaatggaaaagcgcccgggaggctgtcgaagacggaagattctgggagcttgttgatcgggagcgcaatctgcacctcgaaggcaagtgcgagacctgtgtgtacaacatgatgggcaaaagagaaaagaaactgggggagtttggaaaggccaaaggctctcgggctatttggtatatgtggctgggggcccgcttcctcgaatttgaggccctgggattccttaatgaggaccattggttttccagaggcaacagcctgtccggggtggaaggcgagggactccaccggctgggctacatccttcgcgaagtcgggaagaaggagggaggcgcgatgtacgctgatgacacagccgggtgggataccagaattacactggaagacctcaaaaatgaggagatggtgaccaaccatatgaagggagaacacaaaaagctggccgaggctatcttcaaactgacgtatcagaataaggttgtgcgggtccagcgccctacacccagaggcaccgtgatggacattatcagccggaaggatcaacgcgggtctggccaggttggaacatacggcctcaacaccttcacgaatatggaagcccagctgatcagacaaatggagggggagggaatttttaaaagcatccagcatcttaccgctacagaagagattgccgtgcagaactggctggcgcgggtcggccgcgaaagactctcccggatggccatctctggggacgattgcgtggttaagccgattgacgatagattcgctagcgccctgaccgctcttaatgacatgggaaaagtgcgcaaggatatccagcaatgggagccttcccggggctggaacgactggacacaggtccccttttgctctcaccacttccatgaactggtgatgaaagatgggagagtcctcgtggttccctgtcgcaaccaggacgagctgatcggccgggccagaattagccagggagcgggctggtccctgaaggagaccgcctgcctcgggaagtcttatgctcaaatgtggacactgatgtactttcaccgccgggatcttagactggccgctaatgccatctgtagcgctgtgccttcccattgggtcccgaccagccgcacgacatggtctattcacgccaaacacgaatggatgaccaccgaggacatgctcgcggtgtggaaccgggtgtggatccaggaaaatccctggatggaggataagacacctgttgaatcctgggaggaggtgccctatctgggaaaaagagaagaccagtggtgcggcagccttattgggctgacctctcgcgccacatgggctaagaacatccagacggccattaatcaagtccggtccctcatcggaaacgaggaatacaccgactatatgcctagcatgaaaagattccggagagaggaagaggaggccggcgtgctgtggtga

SEQ ID NO: 19535 - RNA, 9876 nt, synthetic construct
  misc_feature 1..9876: note = derived and/or modified CDS sequence (opt5) from DENV-2__LC121816__SS-prME
  source 1..9876: mol_type = other RNA
accgtgggaatgatcattatgctgatccccaccgccatggctttccacctgacgaccagaaatggggaacctcatatgattgtctcccggcaggaaaagggaaaatccctgctttttaagacggaagacggcgttaatatgtgcaccctgatggccatggatcttggggaactgtgtgaggacacagtgacctacaattgcccgcttctgagacaaaatgaacccgaggatatcgactgttggtgcaactctacaagcacctgggtgacgtatggaacctgtacagcgaccggcgagcacagacgggaaaaacgctccgtcgctctcgtgcctcatgttgggatgggactggagacaagaaccgaaacgtggatgtctagcgagggcgcctggaagcacgcccagcggattgagacatggatcctgcgccatcccggcttcaccatcatggctgccattctcgctcacacaatcgggaccacctactttcagagagtgctgattttcatccttctgacagccgtcgcgccttccatgacgatgcggtgcattggaatctctaatcgcgattttgtggaaggcgttagcgggggatcctgggtggacattgtcctcgagcacggcagctgtgtgaccacaatggccaaaaacaagcccaccctggatttcgaacttatcaagacagaggctaaacagcctgccaccctgagaaagtattgcatcgaagctaaactcacgaatacaaccaccgcctctcggtgtccgacacaaggggagccctccctgaacgaggaacaggacaagcgctttgtgtgcaaacatagcatggtcgatagaggatggggcaatggctgtgggctgttcggaaagggcgggattgttacctgcgcgatgtttacatgcaagaaaaacatggagggaaagatcgtgcagcctgaaaatctcgagtacacgattgtgatcacaccccactctggcgaagagaacgccgtcgggaatgacacaggaaaacatggcaaggaggtgaaagttacccctcagtccagcattacagaagctgagctgaccggctatgggacggtgaccatggaatgttctccccggacaggacttgatttcaacgagatggtcctgctccaaatggaaaataaggcctggctggtgcaccgccagtggtttcttgacctgccgctcccttggctgcccggcgctgatacccaggggtccaactggatccagaaagagacactggttaccttcaagaaccctcacgccaagaaacaagacgtggtcgtgctcggaagccaggagggcgccatgcatacggctctgacaggggcgaccgaaatccagatgtcctctggcaatcttctgtttacaggacacctcaagtgcagactgcggatggacaaacttcaactgaagggcatgagctactccatgtgtaccgggaaattcaaggtcgtgaaggagattgccgaaacccagcatggaacaatcgttattagagtgcagtatgagggcgatgggagcccctgcaaaatccccttcgagattatggacctcgaaaagcgccacgtcctgggacggctgatcacggtgaaccctatcgttaccgagagagattctccggtgaatattgaagctgagcccccttttggcgactcctacatcattatcggggtcgaacccggccagctcaaactgagctggttcaagaaaggatctagcattggccaaatgtttgagacaaccatgcgcggggccaagcggatggccatccttggagatacagcttgggacttcggctccctcgggggagtgtttacctctattggcaaggccctccatcaggtgttcggggcgatctacggcgctgcctttagcggagtttcctggacgatgaaaatcctgattggcgtcgtgatcacatggattgggatgaacagcagatctacctccctgagcgtgtctcttgtcctcgtgggagttgtgaccctgtatctgggcgtcatggtgcaggccgattccgggtgtgttgtgagctggaagaataaagagctcaagtgcggatccggcatcttcattacagacaacgtccacacctggacagaacagtacaaatttcaacctgagtctcccagcaagctggcttccgccatccagaaggcttatgaagaggggatctgtggcattcgctctgtgacgcggcttgaaaatctgatgtggaaacagatcaccccggagctcaaccacattctgagcgagaatgaagttaagctgacaatcatgaccggagatattaaaggcatcatgcaggccgggaagagatcccttcgccctcaacccacagagctcaaatacagctggaagacctggggaaaagcgaagatgctgtctacggaacatcacaaccagaccctgctcatcgacggccctgagacagccgaatgccccaataccaaccgggcttggaactccctggaggtggaggattatgggttcggagtctttacaaccaacatttggcttaagctgaaagaaagacaggacgtgttctgtgacagcaagctcatgtctgccgctatcaaagataatcgcgccgtgcatgcggacatgggctactggattgagtccgccctgaacgatacatggaagatcgaaaaagctagctttattgaggtcaagtcttgccactggcctaagagccacaccctgtggtccaacggcgttcttgagagcgaaatgatcatccccaaaaatttcgccgggccggtgtctcagcataactatcggcctggataccacacgcaaacagctggcccctggcatctcgggaagctggagatggacttcgatttttgtgaaggaaccaccgtggtcgtgacagaggactgcggcaatagagggccctccctgcggaccacgacagccagcggaaaactcattaccgaatggtgctgtcgctcctgcacactgcctccgcttagataccggggcgaggatggctgttggtatgggatggagatcagacccctgaaggaaaaagaggaaaacctcgttaattctctggtgaccgccggacacggccagattgacaacttcagcctgggggtccttggaatggctctctttctggaggaaatgctgcgcacacgggtgggcaccaagcatgcgctcctgcttgttgccgtgtccttcatgacgctgatcaccgggaatatgtcttttagagatctcggacgcgtcatggtgatggttggcgctgccatgacagacgatattggcatgggggtgacctacctggccctgcttgctgccttcaaggtcagacctacatttgcggctggactgctcctgcggaaactcaccagcaaggagctgatgatgacgacaatcggcattgtgcttctgtcccagtctaccatccccgagacaatcctcgaactgaccgacgccctggcccttgggatgatgattctgaaaatcgtgcgcaacatggagaagtatcaactcgctgtcaccattatggccatcctgtgcgttcctaatgcggtgattctccagaacgcttggaaagtgagctgtacaatcctggccgtcgtgtccgttacgccccttctgctcaccagctctagacagaaggccgattggatccctctggctctgacaattaagggacttaatcccaccgccatcttcctgacaaccctctcccggacgaacaaaaagcgcagctggccgctgaatgaagctattatggccgtgggcatggtctctatcctcgcgtccagcctgcttaaaaacgacattcctatgacagggcccctggtggccggaggcctgctcaccgtttgctacgtgctgaccggcagatctgctgaccttgagctggaacgggccgctgatgtccgctgggaggaccaggccgagatctccgggagctcccctatcctcagcattacaatctctgaagatggaagcatgtccattaagaatgaggaagaggagcaaaccctgacaatcctcattagaacgggcctgcttgtgatctctgggctgtttcccgtcagcattccgatcaccgccgctgcgtggtatctgtgggaagtgaaaaagcagcgggccggagttctctgggacgtgccttctccccctcccgtcggcaaagctgagctggaagatggggcctaccgcatcaagcagaagggcattcttggctatagccagatcggcgccggggtgtacaaagagggaacattccacaccatgtggcacgttacaagaggcgctgtgctgatgcataaggggaaacggattgaacccagctgggccgacgtcagaaaggatctcatctcctacggaggcgggtggaaactggagggagagtggaaggaaggcgaggaagtgcaagtgctcgcgctggagcctggcaagaacccgcgcgctgttcagaccaaacccgggctttttaagacggacaccggaacaattggcgccgtctctctggatttcagccctgggacctccggaagccccatcgtggacaaaaagggcaaagtggtcgggctgtatggaaacggcgtggttacacggtctggcacctacgtgtccgccatcgctcagacagaaaagagcattgaggataatcctgagatcgaagacgatatttttagaaagcgccggctcacgatcatggacctgcaccccggggccggaaaaaccaagagatatcttcctgcgattgtccgcgaggctatcaaacggggcctgagaacactcatcctggccccgacccgcgtggttgccgctgaaatggaggaagccctccgggggctgcccattagataccagacccctgctatccgggccgagcatacaggacgcgagattgtggaccttatgtgtcacgcgacgttcaccatgagactgctgtctcccgtccgggtgcctaactataatctcatcattatggatgaagcccatttcacagaccccgcttccatcgccgctcgcggctacattagcaccagagttgagatgggggaagccgccggcatctttatgacagctaccccgcctggatcccgggatcccttcccccaatctaacgcgcctatcatggacgaggagagagaaattcccgagcgcagctggaactccggccacgaatgggtgacggattttaaggggaaaacagtctggttcgtgcctagcatcaaggccggaaacgacattgctgcctgcctgcggaagaatggcaaaaaggtgatccagctttctagaaaaacctttgattccgagtatattaagacccgcacaaacgactgggatttcgtcgttaccacagacatcagcgaaatgggggccaattttaaagctgagcgggtgatcgatccgagacgctgtatgaagcccgtgattctgaccgacggagaggaacgggtcatcctcgccggccctatgcccgtgacgcactctagcgcggctcagagacgcgggagaattggccggaaccctaagaatgagaacgaccaatacatctacatgggagaacccctggagaatgatgaagactgcgcccattggaaagaggccaagatgctgctcgataacattaatacaccggagggcatcatcccttccatgttcgaacccgagcgcgaaaaagttgacgctattgatggggagtatagacttcggggagaagcccgcaagacctttgtggacctgatgagacggggcgatctgcctgtctggctcgcgtacagagtggccgctgaggggatcaactatgccgaccgccggtggtgtttcgatggagttaaaaacaatcagattctggaggaaaacgtggaggtcgaaatctggacaaaggagggcgagcgcaagaaacttaagccccgctggctggacgctcggatttactctgatcctctcgccctgaaagaatttaaggagttcgctgccgggagaaaaagcctgaccctcaatcttatcacggaaatgggccggctgcccaccttcatgacacagaaggcgcgcaacgccctggacaatctcgctgtgctgcacaccgccgaggctggaggcagagcctataaccatgccctttccgaactgccggagacactcgagaccctgctgctccttacactgctggctaccgtcacagggggaatttttctcttcctgatgtctggcaaagggatcggaaagatgacacttggcatgtgctgcatcattaccgcgagcatcctgctctggtacgcccagattcaacctcactggatcgctgcctccattatcctggaatttttcctgatcgtgctccttattcccgagcccgaaaagcagcggacccctcaggataatcagctgacatatgttgtgatcgccattctgaccgtggtcgctgccacaatggcgaacgagatgggctttctcgagaagacgaagaaagacttcgggctgggaagcatcgccacccaacagccggagtctaatattcttgacatcgatctgcgccccgcttccgcctggacactctacgctgttgccaccacatttatcacccctatgctgagacacagcattgagaactcctctgtgaatgtgagcctgacggcgatcgccaaccaggctaccgtcctcatgggccttgggaagggatggcccctgtccaaaatggacattggcgtgcctctgctcgccatcgggtgttactctcaggttaatcccattacactgaccgctgcccttctgctcctggtggctcattatgccatcattggacctggcctgcaagcgaaggccacacgggaagctcagaagcgcgccgctgccggcatcatgaaaaacccgaccgtcgatgggatcacggtgattgacctcgatcccatcccttacgaccccaagttcgagaaacagcttggacaggtcatgctgctggtgctctgcgttacacaagtgctgatgatgagaaccacatgggccctttgtgaagcgctgaccctcgctaccggccctattagcacactgtgggaggggaatcccggacggttttggaacacgaccatcgccgtctccatggctaatattttccgcggcagctatctggccggggccggactcctcttttctatcatgaagaacacaaccaacacaagacggggcaccggcaatacgggggaaacactgggagagaaatggaagaacagactgaatgctctcggcaagtccgagttccagacctacaaaaagagcgggatccaggaagtggatcgcaccctggccaaagagggaattaagcggggcgaaacagaccaccatgcggtttctagagggtccgccaaacttcgctggtttgtggagcggaacctggtcaccccggagggaaaggtggtggatctcggctgcggcagagggggatggagctattactgtggcgggctgaaaaatgttcgcgaagtcaagggactgacaaagggcgggcctggacacgaggaacccatccccatgtctacgtatggctggaacctcgtgcggcttcaaagcggcgtggacgtcttcttcacccctcccgagaaatgcgatacactgctgtgtgacattggggaatcctctcctaatccgaccgttgaggctggaagaacactccgcgtgctgaaccttgtggagaattggctgaacaataacacccagttttgcatcaaggtcctcaatccctacatgcctagcgtgattgagaagatggaggccctgcagcggaagtacggcggggctctggttagaaaccccctctcccgcaatagcacgcatgaaatgtattgggtgtccaacgcctctggaaacatcgtcagctccgtgaatatgatctctcggatgcttattaacagattcaccatgcgccacaaaaaggcgacatacgagcctgatgttgacctgggcagcgggaccagaaatatcggaattgaatccgagacacccaacctggacatcattggcaagcggatcgagaaaatccgccaggaacacgagacctcttggcattatgatcaagaccacccgtacaagacatgggcctatcatggcagctacgaaaccaaacagacggggtccgctagctctatggtgaatggagtcgtgagactcctgacaaagccttgggatgtgattcccatggtcacccagatggccatgaccgacacaacgccttttggccagcaacgggttttcaaagagaaggtggataccagaacacaggaacccaaggaggggaccaagaaacttatgaaaatcacagctaagtggctgtggaaagagctcggaaagaagaaaacccctcggatgtgtacacgcgaagagtttaccagaaaggtgcggtccaacgccgctctgggcgccattttcacggacgaaaataaatggaaaagcgcgcgcgaggccgtcgaggattctagattttgggaactggtggacaaagagcggaacctccacctggaagggaagtgcgagacctgtgtttataatatgatgggaaaacgcgaaaagaaacttggcgagttcggcaaagctaaggggtccagagccatctggtacatgtggctgggagctcggtttctcgagttcgaagccctgggctttcttaacgaggatcactggttcagccgcgaaaattctctgtccggggtggagggagaaggcctccataaactggggtacattctgagagacgtcagcaagaaagagggcggagccatgtatgcggatgacacagctggctgggacacccggatcacactcgaggatctgaagaacgaagagatggtgaccaatcacatggaaggggagcataagaaacttgccgaagccatttttaagctgacgtaccagaacaaagttgtgcgcgtccagagacccacaccgcggggaaccgtgatggacatcatctcccgcagagatcaacggggcagcgggcaggttggaacatatggcctcaataccttcacgaacatgggggctcagctgattagacaaatggagggcgagggagtgttcaagtctatccagcaccttaccgccacagaagagattgctgtccaggactggctggcccgcgtgggccgggaaagactcagccgcatggcgatctccggggatgactgcgtcgtgaaacctctggatgaccggtttgcctctgctctgaccgccctcaacgatatgggaaaggttagaaaggacattcagcaatgggagcccagccgcggctggaatgattggacacaggtgcccttctgctcccatcactttcacgagctgatcatgaaagacgggcgggtccttgtggtgccttgtagaaaccaggatgaactgatcggacgcgctcggatttctcagggcgccgggtggagcctcagagagaccgcgtgcctgggcaagtcctacgcccaaatgtggtctcttatgtatttccatcgccgggacctgagactcgctgccaatgctatctgtagcgccgttccgtcccactgggtgcccacaagccggaccacgtggtctattcatgctaaacacgaatggatgacaaccgaggacatgctgaccgtctggaacagagtgtggatccaggaaaatccttggatggaggataagacacccgttgagtcctgggaagagattccttacctgggaaaacgcgaagaccagtggtgcggcagcctcatcgggctgacctctcgggccacatgggcgaagaacatccagacggccattaatcaagtgagatcccttatcggaaacgaggaatataccgattacatgcccagcatgaagcgctttagacgggaggaggaagaggctggcgtcctgtggtga

SEQ ID NO: 19536 - RNA, 9876 nt, synthetic construct
  misc_feature 1..9876: note = derived and/or modified CDS sequence (opt5) from DENV-2__LC111438__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacccactttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacatcctgccacccttagaaagtattgcattgaagctaaactgacgaacacaaccaccgcctctcggtgtccgacacagggggagccctccctcaatgaggaacaagataagcgctttgtgtgcaaacacagcatggtcgacagaggatggggcaacggctgtgggctgttcggaaagggcgggatcgttacctgcgcgatgtttacatgcaagaaaaatatggagggaaaggtggtgcagcctgaaaacctggagtacacgattgtcatcaccccccattctggcgaagagaatgccgtggggaacgatacaggaaaacacggcaaggagattaaagttacccctcagtccagcatcacagaagctgagctcaccggctatgggacggtgaccatggaatgttctccccggacaggactggacttcaatgagatggtccttctgcagatggaaaacaaggcctggctcgtgcaccgccaatggtttctggatcttccgctgccttggctccccggcgctgacacccaggggtccaactggatccagaaagagacactggttaccttcaagaatcctcatgccaagaaacaggatgtggtcgtgctgggaagccaagagggcgccatgcacacggctctcacaggggcgaccgaaattcagatgtcctctggcaacctgctttttacaggacatctgaagtgcagactccggatggacaaactgcagcttaagggcatgagctactccatgtgtaccgggaaattcaaggtcgtgaaggagatcgccgaaacccaacacggaacaattgttatcagagtgcagtatgagggcgacgggagcccctgcaaaattcccttcgagatcatggatctggaaaagcgccatgtcctcggacggctgatcacggtgaatcctattgttaccgagaaagactctccggtgaacatcgaagctgagcccccttttggcgattcctacattatcattggggtcgaacccggccagctgaagctcagctggttcaaaaagggatctagcatcggccagatgtttgagacaaccatgagaggggccaagcgcatggccattctgggagacacagcttgggatttcggctcccttgggggagtgtttacctctatcggcaaagccctgcaccaagtgttcggggcgatctacggcgctgcctttagcggagtttcctggacgatgaagattctcatcggcgtcgtgattacatggatcgggatgaatagccggtctacctccctgagcgtgtctctggtccttgtgggagttgtgaccctctatctgggcgtcatggtgcaggccgactccgggtgtgttgtgagctggaaaaacaaggagctgaaatgcggatccggcattttcatcacagataatgtccacacctggacagaacagtacaagtttcagcctgagtctcccccgaagctcgctagcgccatccaaaaagctcatgaagaggggatttgtggcatcagatccgtgacgcgcctggaaaaccttatgtggaagcagattacccctgagctgaatcacatcctctctgagaacgaagttaaactgacaattatgaccggagacatcaagggcatcatgcaggccgggaaacggagcctgagaccccagcctacagagcttaagtattcctggaaagcgtggggaaaggccaagatgctcagcaccgaactgcataatcacacgttcctgattgatggccccgagaccgctgaatgccctaacacaaatcgcgcctggaactctctcgaggtggaggactacgggtttggagtcttcaccacaaatatctggctgaaacttaaggaaaaacaagatgtgttttgtgactccaagctgatgagcgctgccattaaagacaaccgggcggtgcacgccgatatgggctattggatcgagtctgctctcaacgacacctggaagattgaaaaggcctccttcatcgaggtcaaaagctgccattggcccaagtctcacacactgtggagcaatggcgttctggagtccgaaatgatcattccgaaaaacttcgctgggcctgtgagccagcataattacagacccggatatcacacccagacggccggcccctggcatcttgggtctctcgagatggattttgacttctgtgaaggaacaaccgtggtcgtgaccgaggattgcggcaaccgcgggccttccctgcggacaaccacggccagcggaaagctgatcacagaatggtgctgtagatcctgcaccctcccgcccctgcggtaccgcggcgaggacggctgttggtacgggatggagattagacctcttaaagaaaaggaggaaaatctggttaactctctcgtgacagctggacacggccagatcgataattttagcctgggggtcctgggaatggcgcttttcctcgaggaaatgctgcggaccagagtgggcacaaagcacgccattctgctcgttgctgtgtcctttgtcaccctgatcacggggaacatgtctttccgcgaccttggacgggtgatggttatggtgggcgccaccatgacagatgacattggcatgggggtcacctatctggccctcctggctgcctttaaaatcagacccacattcgcggctggactgcttctgcgcaagctcaccagcaaagagctgatgatgacgacaatcggcattgtgctcctgtcccaatctaccatccctgagacaattcttgaactgaccgatgccctcgccctggggatgatggtgctgaagatcgtcagaaatatggagaaataccagcttgctgttaccattatggccatcctgtgcgtgcccaacgcggtgatcctccagaatgcttggaaggtcagctgtacaacgctggccgtggtttccgtgagccctctcctgcttacctcttcccaacagaaggccgactggattcccctggctctcacaatcaaaggactgaacccgaccgccatttttctgacaacccttagccggacgtctaagaaacgctcctggcctctgaatgaagctatcatggccgtcggcatggtgagcattctcgcgtcttccctgctcaagaacgatatccccatgacagggcctctggttgccggaggccttctgaccgtgtgctatgtcctgaccggcagaagcgctgacctcgagctggaacgggccgctgacgtgcgctgggaggagcaggccgaaatctccgggagctctcccattcttagcatcacaatttccgaggatggatctatgagcatcaaaaatgaagaggaggaacagaccctgacaattctcatcagaacgggcctgctcgtcatttccgggctgttcccggtgtctatccctatcaccgccgctgcgtggtacctttgggaggttaagaaacaacgggccggagtgctgtgggacgtccccagccctccccccgtgggcaaggctgaactggaggatggggcctatcgcattaagcagaaaggaatcctcggctactcccagattggcgccggggtttataaggaaggaacatttcataccatgtggcacgtgacaagaggcgctgtcctgatgcataaagggaagcggatcgagccttcttgggccgacgtgaaaaaggatcttattagctacggaggcgggtggaagctggagggagaatggaaagagggcgaagaggtgcaggttctcgcgctggaaccgggcaagaacccccgcgctgtccaaaccaaacctgggctcttcaagacgaacaccggaacaatcggcgccgtgtccctggactttagccccgggacctctggatcccctatcgtggataaaaagggcaaggtcgtggggctttacggaaatggcgttgtgacaagaagcggcacctatgtctctgccattgctcagacagagaaatccatcgaggacaaccccgaaattgaggatgacatcttccggaagaaaagactgacgattatggatctgcaccctggggccggaaagaccaaacgctacctcccggcgatcgtgcgggaagctatcaagagaggcctgcgcacacttattctggcccccacccgggttgtggccgctgagatggaagaggccctcagagggctgcctatccgctatcagacccccgctattcgggccgagcatacaggaagagaaatcgtcgacctcatgtgtcacgcgacgttcaccatgcgcctgcttagccctattcgggtgcccaattacaacctgatcattatggatgaggcccactttacagacccggcttccatcgccgctagaggctatatctctacccgggttgaaatgggggaggccgccggcattttcatgacagctacccctcccggaagccgcgacccctttcctcagtccaatgcgcccatcatggatgaggaaagagagattcctgaacggagctggaactctggccatgagtgggtgacggacttcaaggggaaaacagtctggtttgtgccgtccatcaaggccggaaatgatattgctgcctgcctgcgcaaaaacggcaagaaagtgatccaactcagcagaaagaccttcgactctgaatacatcaagacccggacaaatgattgggactttgtcgttaccacagatattagcgagatgggggccaacttcaaagctgagagagtgatcgacccccgccggtgtatgaagcctgtgattctgaccgatggagaagagagagtcatccttgccggccccatgcctgtgacgcactcctctgcggctcagcgccgggggagagttggccgcaatcccaaaaacgaaaatgaccagtatatttacatgggagagccgctggaaaacgatgaggactgcgcccattggaaggaggccaaaatgctcctggacaatatcaacacacctgaaggcatcattcccagcatgtttgagcctgaacgggagaaggtggatgctatcgacggggaatacagactgcgcggagaggccagaaaaaccttcgtcgatctcatgcggcgcggcgaccttcccgtgtggctggcgtatagagttgccgctgaggggattaactacgccgatcggcgctggtgttttgacggagtgaagaataaccaaatcctggaagagaatgtcgaagtggagatttggacaaaggagggcgaaagaaaaaagctcaaacctcggtggctggatgctagaatctattccgacccccttgccctgaaggagttcaaagaattcgctgccgggcgcaagtctctcgcgctgaacctgattaccgagatgggccggctcccgacgtttatgacccagaaggccagaaatgctcttgataacctggccgtcctgcacacagctgaagccggaggccgcgcctacaatcacgctctcagcgagctgcctgagacccttgaaacactgctcctgctgaccctccttgcgacagtgaccgggggaatcttcctgtttctgatgtccggcaaagggatcggaaagatgacgatgggcatgtgctgcattatcacagccagcattctcctgtggtatgctcagatccagccccattggattgccgcctctatcatccttgagttctttctgattgttctcctgatccccgaacctgagaaacaacggaccccgcaggacaaccagctgacctacgtggtgattgctatcctcacagtcgttgccgcgaccatggccaatgaaatgggcttccttgagaagacaaaaaaggattttgggctgggatccattgctacgcagcaacccgagagcaacatcctggacatcgatctcagacctgcctccgcttggaccctgtatgccgtggcgacaaccttcattacacccatgcttcggcactctatcgaaaatagctccgtgaacgtctctctgaccgccattgctaatcaggccacggtgctcatgggcctggggaagggatggcctctgagcaaaatggacatcggcgttcccctccttgctattgggtgttactcccaggtgaaccctatcaccctgatggccgctctgctcctgcttgtcgcccattacgcgattatcggaccgggcctgcaggccaaggctacacgcgaggcccaaaaaagagctgccgccggcatcatgaagaatcccaccgtggacgggattacagtcatcgatctcgaccctattccctatgatcctaaatttgaaaagcagctgggacaggtgatgctgctcgttctttgcgtgacccaggtcctgatgatgcggacgacatgggcgctgtgtgaggctctcaccctggccacaggccccatcagcaccctttgggaagggaacccgggacgcttctggaataccacaattgctgtgtctatggccaacatctttagaggctcctacctggccggggctggactcctgttcagcatcatgaagaacacggccaatacccggcgcggcacaggcaacaccggggagacactgggagagaaatggaagaatagactcaacgcgcttggcaaatctgaatttcaaatttataagaaatccgggatccaggaggttgaccggaccctggccaaggaaggaattaaacgcggcgagacggatcaccatgctgtgagcagagggtctgccaagctgcggtggttcgtcgagagaaatctcgtgacacctgaaggaaaggtggttgacctgggctgcggccgcgggggatggagctactattgtggcgggcttaaaaacgtcaaggaggtgaaaggactgaccaagggcgggcccggacacgaagagcccatccctatgtccacctacggctggaatctcgtgcggctgcagtctggcgtcgatgttttctttacaccccctgaaaaatgcgacaccctgctctgtgatattggggagagctccccgaaccccacagtggaggctggaagaacgcttcgcgtgctgaatctggtcgaaaactggctcaataacaatacccaattctgcatcaaggtgctgaacccttatatgcccagcgttatcgagaagatggaagcccttcagcggaaatacggcggggcgctggtgagaaatcctctctcccgcaactctacacacgagatgtactgggtcagcaacgcctccggaaatattgtgtctagcgttaacatgatctcccggatgctgattaatagatttaccatgcgccataagaaagctacatatgaacccgacgtggatctgggctctgggacccggaacatcggaattgagagcgagacgccgaatctcgacatcatcggcaagagaattgaaaaaatcaagcaggagcacgaaacctcctggcattacgatcaggaccacccttataagacatgggcctaccacggcagctatgagaccaaacaaacagggtctgcttccagcatggtcaacggagtggtgcgccttctgaccaagccctgggacgtcattcctatggttacacagatggccatgaccgatacgacacccttcggccagcagcgggtgtttaaagaaaaggtggacaccagaacccaagagcctaaagaggggacaaagaagctgatgaaaatcacggctaagtggctctggaaagaactgggaaagaaaaagaccccccgcatgtgtacaagagaggaattcacccggaaagtccgctctaatgccgcgcttggcgccatttttacagatgagaacaagtggaagtccgctagagaggccgtggaagacagcgggttctgggagctggttgataaagaacggaatctccatctggagggaaagtgcgaaacctgtgtgtacaacatgatgggcaaaagagagaagaaactgggcgagtttgggaaggctaagggatctcgggccatctggtatatgtggctcggcgcccgcttcctggaatttgaggcgcttgggttcctgaatgaagaccactggttttccagagagaacagcctctccggagtcgaaggcgaggggctgcataaacttggctacattctgcgggatgtgagcaagaaagagggaggcgctatgtacgccgacgatacagccgggtgggacacccgcatcacgctcgaagatctgaagaatgaggaaatcgttaccaactatatggagggagaacacaaaaagctggctgaggccattttcaagctcacataccagaataaagtggtcagagtgcagcggccgacccctcgcggcacagttatggacatcatttctagacgggaccagcgcgggagcggacaagtggtcacctatggcctgaacacgttcacaaacatggaggctcagcttatcagacagatggaaggggagggcgtgtttaagtccattcaacatctgaccgtcacagaagagatcgccgtggagaattggctcgttcgggtgggacgcgaaagactgtctcggatggcgatcagcggcgatgactgcgtcgtgaaaccccttgatgaccgcttcgcctccgctctgaccgccctcaacgatatggggaaggtgagaaaagacattcagcagtgggagccctctcggggatggaatgattggacgcaggttcctttttgcagccaccacttccatgaactgatcatgaaggacggcagagtgctggtcgtgccgtgtcgcaaccaagatgagctcattgggcgggctagaatctcccagggagccggctggtctctgcgcgaaaccgcgtgccttgggaagagctacgcccagatgtggtccctgatgtattttcaccggagagacctccgcctggctgccaatgctatttgtagcgccgttccctctcattgggtgcctacatcccggaccacatggagcatccacgctacccacgagtggatgacaaccgaggatatgcttacggtctggaacagagtgtggatccaggaaaatccctggatggaggacaaaacacctgtcgaatcttgggaggaaattccctacctgggcaagcgcgaggatcaatggtgcggatccctcatcggcctgaccagccgggccacctgggcgaaaaacattcagacagccatcaatcaggtgagatccctgattgggaacgaggaatataccgactacatgccttctatgaagcgcttccggagagaggaagaggaagctggagttctctggtga

SEQ ID NO: 19537 - RNA, 9876 nt, synthetic construct
  misc_feature 1..9876: note = derived and/or modified CDS sequence (opt5) from DENV-2__KF744400__SS-prME
  source 1..9876: mol_type = other RNA
accgccggcatgatcattatgctgatccccaccgtgatggctttccacctcacgaccagaaatggggaacctcatatgattgtcagccggcaggaaaaggggaagtccctgctttttaagacagaaaatggcgttaatatgtgcaccctgatggccatggacctcggggaactgtgtgaagatacaatcacctacaaatgcccccttctgagacaaaatgaacccgaggacattgattgttggtgcaactctacaagcacctgggtgacgtatgggacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacacactttcagagagctcttattttcatcctgctcacggccgttgcgccttccatgaccatgcggtgcattggaatctctaatcgcgactttgtggaaggcgtcagcgggggatcctgggtggatattgttctggagcacggcagctgtgtgacaaccatggccaagaacaagcccacacttgacttcgaactgatcaaaaccgaggctaaggaacctgccacgctcagaaaatattgcatcgaggctaagctgacaaataccaccacagagtctcggtgtccgacccagggggaaccctccctgaacgaggaacaagataaacgctttgtctgcaagcatagcatggtggacagaggatggggcaatggctgtggactcttcggaaagggcgggattgtgacatgcgccatgtttacgtgcaaaaagaacatggagggaaaaatcgtccagcctgaaaatctggagtacaccattgttatcacaccccactctggcgaggaacatgcggtggggaacgataccggaaagcacggcaaagagattaagatcacacctcagtccagcaccacggaagccgagcttaccggctatgggacagtgaccatggaatgttctccccggacaggactggacttcaatgagatggtcctcctgcagatggagaacaaggcttggcttgtgcaccgccaatggtttctggatctcccgctgccttggctgcccggcgccgacacccaggggtccaattggatccagaaggaaacgctcgttacattcaagaaccctcatgctaaaaagcaggatgtggtcgtgctgggaagccaagagggcgccatgcacaccgcccttacaggggctaccgacattcagatgtcctctggcaacctgctctttaccggacatctgaaatgcagacttcggatggacaagctgcagctcaaaggcatgagctactccatgtgtacagggaagttcaaggttgtgaaagaaatcgcggagacgcaacacggaaccattgtcgtgagagtccagtatgagggcgatgggagcccctgcaagatccccttcgaaattatggacctggagaaacgccatgtgctgggacggctcatcacagttaatcctatcgtgaccgaaaaggattctccggtcaacattgaggccgaacccccttttggcgactcctacgtgatcattggggttgagcccggccagctgaaacttaattggttcaagaagggaagctctatcggccagatgtttgagacaaccatgagaggggctaaacgcatggccattctgggagatacggcctgggacttcggcagcctcgggggagtgtttacatccatcggcaaggctctgcaccaagtcttcggggccatttacggcgcggctttttctggagtgagctggaccatgaaaatcctgatcggcgtgattatcacctggattgggatgaactcccggagcacatctctttccgttagcctcgtcctggtgggagtggtcaccctgtatctcggcgtggttgtgcaggccgattctgggtgtgtcgtgtcctggaagaataaagaactgaagtgcggaagcggcatcttcattacagacaacgttcacacgtggaccgagcagtacaagtttcagcctgaatccccctctaaacttgccagcgctatccaaaaggcccatcaggaggggatctgtggcattagatccgtgacacgcctggaaaatctcatgtggaaacagatcaccccggagctgaaccacattctgtctgagaatgaagtcaaacttacaatcatgaccggagatattaaaggcatcatgcatgctgggaagcggagcctcagacctcagcccacggagctgcgctattcctggaaaacctggggaaaggccaagatcctgagcacagaatctcacaaccaaaccttcctcattgacggccctgagacagcggaatgccccaataccaaccgggcctggaactccctggaggtggaggattacgggtttggagttttcacaaccaacatctggcttaaactgagagaaaagcaggacgctttttgtgaccctaaactcatgagcgccgctattaaggataatcgcgccgtgcacgcggacatgggctattggatcgagtctgccctgaacgatacgtggaaaattgaaaaggcttccttcatcgaggtcaagaactgccattggcccaaaagccacacactgtggtctaatggcgtgcttgagagcgaaatgatcattccgaagaacttcgccgggcctgtgtcccagcataattaccggcccggatatcacacccagaccgctggcccctggcatctcgggaaactggagctggactttgatttctgtgaaggaacaaccgtcgttgtgacggaggactgcggcaacagagggcctagcctccggacaaccacagcctctggaaagctgatcaccgaatggtgctgtcgctcctgcacacttccgcccctgagatacaaaggcgaggatggctgttggtacgggatggagattcggcctctcaaggaaaaggaggaaaatctggtgagctccctggtcaccgccggacacggccaaatcgacaacttttctcttggggtgctcggaatggctctgttcctggaggaaatgctcagaacgcgcgttggcatgaaacacgcgattctgcttgtggccgtcagctttgtgaccctgatcacagggaatatgtccttccgggatctcggaagagttatggtgatggtcggcgctaccatgacagacgatattggcatgggggtgacctatctggccctgcttgccgcttttaaggttcgccccacgttcgccgcgggactgctcctgagaaaactcacatctaaggagctgatgatgaccacaatcggcatcgtgcttctgagccagtccaccattcctgagaccatcctcgaactgacagacgctctggcccttgggatgatggtcctgaaaattgtgcggaagatggagcgctaccagctcgccgtgacgatcatggctattctgtgcgtccccaactctgttatcctccaaaatgcctggaaggtgagctgtaccatcctggcggtggtctccgtgagccctcttctgctcacatcttcccagcagaaagctgattggattcccctggccctgaccatcaagggacttaacccgacagccatttttctgaccacgctcagcagaacatctaaaaagcggtcctggcctctgaatgaagctatcatggccgttggcatggtgagcattctcgcttcttccctgcttaaaaacgacatccccatgaccgggcctctggtcgccggaggcctgctcaccgtgtgctatgttctgacaggccgcagcgcggaccttgagctggaaaaggccgctgatgtgagatgggaggaccaggccgagatctccgggagctctcccattctcagcgtcatcgtgtccgaagatggatctatgagcattaaaaatgaggaagaggagcaaatcctgaccattctcatccggacaggcctgcttgtcatttccgggctgttcccggtgtctatccctatcacggctgccgcctggtacctgtgggaagttaagaagcagcgcgctggagtgctctgggacgtccccagccctccgcccgtgggcaaagcggagctggaagatggggcctatagaattaagcagaaaggaatccttggctactcccagattggcgctggggtttataaggagggaacctttcatacaatgtggcacgtgacccggggcgccgtcctgatgcataaagggaagcgcatcgaaccttcttgggccgacgtgaagaaagatctcattagctacggaggcgggtggaagctggagggagagtggaaagaaggcgaggaagtgcaagttctcgctctggagccgggcaagaaccccagagccgtccagacaaaacctgggcttttcaagaccaatgcgggaacgatcggcgctgtgtccctggactttagccccgggacctctggatcccctatcattgataagaaaggcaaggtggtcgggctgtacggaaacggcgtggttacacggaacggcagctatgtgtctgccatcgcccagaccgaaaaatccattgaggacaatcccgagatcgaagatgacattttcagaaagaaacgcctcacaatcatggatctgcaccctggggctggaaagaccaagcggtaccttccggccatcgtcagagaggcgattaaacgcggcctgcggacactcatcctggctcccacgagagtggttgccgccgaaatggaggaagctctccgcgggctgcctattcggtatcagacccccgccatcagagctgagcatacaggacgcgagattgtggaccttatgtgtcacgccaccttcaccatgcggctgctgagccctatcagagtccccaactacaatctcattatcatggacgaagcgcactttacagatccggcctccatcgctgcccggggctatatttctacgcgcgtggagatgggggaagctgccggcatcttcatgaccgccacacctcccggaagcagagacccctttcctcaatccaacgctcccattatggatgaggagcgggaaatccctgagcgcagctggaactctggccatgaatgggttaccgacttcaaggggaaaacagtgtggtttgtcccgtccattaaggcgggaaacgatatcgccgcttgcctgcgcaagaatggcaagaaggtgatccagcttagccggaaaaccttcgactctgagtacgtgaagacgagaacaaacgattgggactttgtcgttaccaccgatattagcgaaatgggggccaatttcaaagccgagcgcgtgatcgacccccggagatgtatgaagcctgtgattctgacagatggagaggaacgcgtcatcctcgctggccccatgcctgtgacccactcctctgccgcgcagcggagagggcgcattggccggaaccccaaaaatgagaacgaccaatatatctacatgggagaaccgctggagaatgacgaagattgcgctcattggaaggaggccaaaatgctgctcgacaacatcaatacacctgagggcattatccccagcatgtttgaacctgagagagaaaaggttgatgccattgacggggagtaccgccttagaggagaagctcggaagaccttcgtggatctgatgcgcagaggcgacctgcccgtctggctcgcctataaagtggcggccgaggggatcaactacgctgatcggcgctggtgttttgacggaattagaaacaatcagatcctggaggaaaacgttgaggtggaaatttggacgaaggagggcgagcggaagaaacttaaacctagatggctggatgcccgcatctattccgaccccctcgctctgaaagagttcaaggagttcgccgctgggcggaaatctctgacactcaatcttatcaccgaaatgggcagactgccgacatttatgacccagaaggcccgcgatgcgctggacaacctcgccgtcctgcacacggctgaggccggaggccgggcttacaatcacgcccttagcgaactgcctgagaccctcgagacactgctgctccttaccctgctggccacagtgaccgggggaattttcctctttctgatgtccggcagagggatcggaaaaatgacacttggcatgtgctgcattatcaccgctagcattctgctctggtatgcgcagatccaaccccattggatcgccgcttctattatcctggagttctttctgattgtcctccttatccccgagcctgaaaagcagcggacgccgcaggataaccagctgacatacgtggttattgccatcctgaccgtggtggccgctaccatggccaatgagatgggcttcctcgagaagacaaagaaggacctggggcttggatccatcgcgacccaacagcccgagagcaacattctggacatcgatctccgccctgcctccgcttggacactgtatgccgtcgctacgacctttattacacccatgctgagacactctatcgagaatagctccgttaacgtgtctctcaccgccattgcgaatcaggccacagtgcttatgggcctggggaaaggatggcctctgagcaagatggacatcggcgtccccctcctggctattgggtgttactcccaggtgaaccctatcacccttacggccgctctgctcctgctggttgcccattacgctatcattggaccgggcctccaagccaaagcgacccgggaagcccagaagcgcgctgccgctggcatcatgaaaaatcccacagtggatgggattaccgccatcgaccttgatcctattccctatgaccctaagttcgagaagcagctgggacaggtcatgctgctcgtgctgtgcgtcacacaagtgcttatgatgagaaccacgtgggccctgtgtgaagcgctcacactggctaccggccccatcagcacactgtgggaggggaacccgggacggttttggaataccaccatcgccgtttctatggctaacattttccgcggctcctacctcgccggggccggacttctgtttagcatcatgaaaaatacaacgaacaccagacggggcacaggcaacattggggaaaccctgggagagaagtggaaatctcgcctcaatgctctgggcaagtccgagttccagatctataaaaagagcgggattcaggaagtggatagaacacttgccaaagagggaatcaagcggggcgaaaccgaccaccatgcggtctctagagggagcgccaagctgcgctggtttgtggagcggaacatggttacgcctgagggaaaagtggtcgatctcggctgcggcagagggggatggtcctactattgtggcgggctgaagaatgtgcgcgaagtgaaaggactgacaaagggcgggcccggacacgaggaacccatccctatgtctacctacggctggaacctcgttcggcttcaaagcggcgtcgacgtgttcttcacaccccctgagaaatgcgatacactgctgtgtgacattggggaatccagcccgaatcccaccgtggaggctggaagaacactccgcgtcctgaaccttgttgagaattggctgaacaataacacgcagttttgcatcaaggtgctcaatccttatatgccctccgtgattgaaaagatggaggccctgcagcggaaatacggcggggctctggtcagaaaccctctctctcgcaatagcacccacgaaatgtactgggtgtccaacgcctctggaaatatcgttagctccgtgaacatgatttctcggatgcttatcaacagattcacaatgaagcataaaaaggcgacctatgagcccgatgtcgacctgggcagcgggacatgtaatatcggaattgaatccgaggtgccgaacctggacatcattggcaaacgcatcgagaagattaagcaggaacacgagaccagctggcattacgatcaagaccacccttataaaacgtgggcctaccacggctcttatgaagctaagcagaccgggtccgccagctctatggttaatggagtggtccggctcctgacaaaaccctgggatgtgatccctatggtgacccagatggctatgacagacaccacaccctttggccagcaaagagtcttcaaggagaaagttgatacccgcacgcaggaacctaaggaggggacaaagaaacttatgaagattaccgccgagtggctgtggaaagaactcggaaagaaaaagacccccagaatgtgcacacgggaggaatttacgcgcaaagtgagatccaacgctgccctgggcgcgatcttcaccgacgagaataagtggaaaagcgcccgggaggctgtggaagattctagattttgggagctggtcgacaaagaacggaacctccatctggaggggaagtgtgaaacatgcgtgtacaatatgatgggaaaacgcgagaagaaacttggcgagttcggcaaggccaaggggtccagagctatctggtatatgtggctgggagcccggtttctcgagttcgaggccctgggctttcttaacgaagatcactggttcagccgcgaaaattccctgagcggggttgaaggagagggcctctacaaactggggtacattctgagagacgtgtctaagaaagagggcggagcgatgtatgctgatgacaccgccggctgggacacacggatcaccctcgaagatctgaagaacgaggaaatggtcacaaatcatatggagggggaacacaagaaacttgccgaggctatttttaaactgacctaccagaacaaagtggttcgcgtgcagagaccgacgcctcggggaaccgtcatggacatcattagccgcagagatcaacggggctccggacaggtgggaacatatggcctcaataccttcacaaacatggaggcccagctgatccgccaaatggaaggggagggcatcttcaagtctattcagcatcttaccgctacggaagagatcgccgttcagaattggctgacaagagtgggacgggagcgcctcagcagaatggcgatttccggcgacgattgcgtcgtgaaacccctggacgatcggtttgcctctgctctgaccgccctcaacgacatggggaaggtcagaaaagatatccagcaatgggaacccagccgcggatggaacgactggacacaggtgcctttctgttcccaccactttcatgagctgattatgaaggatggccgggttcttgtggtcccgtgcagaaatcaggacgaactgatcgggcgcgctcggatctctcagggagccggctggagcctcagagagaccgcgtgtctggggaagtcctacgcccaaatgtggagccttatgtatttccaccgccgggatctgagactcgctgccaacgctatttgctctgccgtgccctcccattgggtgcctacgagccgcaccacatggtctatccacgctaaacacgaatggatgaccacagaggacatgctgaccgtttggaatcgggtgtggattcaggagaacccctggatggaagacaagacacctgtcgagtcctgggaagagatcccctacctgggcaaaagagaagatcagtggtgtggaagcctcattggcctgacctcccgcgccacgtgggcgaagaatatccagacagccattaaccaagtgcggtctcttatcgggaatgaggagtataccgactacatgcctagcatgaaaagatttcggagagaagaggaagaggctggagttctgtggtga

SEQ ID NO: 19538 - RNA, 9876 nt, synthetic construct
  misc_feature 1..9876: note = derived and/or modified CDS sequence (opt5) from DENV-2__KF744401__SS-prME
  source 1..9876: mol_type = other RNA
accgccggaatgatcattatgctgatccccacagtgatggctttccacctcacgaccagaaatggggaacctcatatgattgtcagccggcaggaaaaggggaagtccctgctttttaagacagagaatggcgttaatatgtgcaccctgatggccatggacctcggggaactgtgtgaggatacaatcacctacaagtgcccccttctgcgccaaaatgaacccgaggacattgattgttggtgcaactctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacacactttcagagagctcttattttcatcctgctcacggccgttgcgccttccatgaccatgcggtgcattggaatctctaatcgcgactttgtggaaggcgtcagcgggggatcctgggtggatattgttctggagcacggcagctgtgtgacaaccatggccaagaacaagcccacacttgacttcgaactgatcaaaaccgaggctaaggaacctgccacgctcagaaaatattgcatcgaggctaagctgacaaataccaccacagagtctcggtgtccgacccagggggaaccctccctgaacgaggaacaagataaacgctttgtctgcaagcatagcatggtggacagaggatggggcaatggctgtggactcttcggaaagggcgggattgtgacatgcgccatgtttacgtgcaaaaagaacatggagggaaaaatcgtccagcctgaaaatctggagtacaccattgttatcacaccccactctggcgaggaacatgcggtggggaacgataccggaaagcacggcaaagagattaagatcacacctcagtccagcaccacggaagccgagcttaccggctatgggacagtgaccatggaatgttctccccggacaggactggacttcaatgagatggtcctcctgcagatggagaacaaggcttggcttgtgcaccgccaatggtttctggatctcccgctgccttggctgcccggcgccgacacccaggggtccaattggatccagaaggaaacgctcgttacattcaagaaccctcatgctaaaaagcaggatgtggtcgtgctgggaagccaagagggcgccatgcacaccgcccttacaggggctaccgaaattcagatgtcctctggcaacctgctctttaccggacatctgaaatgcagacttcggatggacaagctgcagctcaaaggcatgagctactccatgtgtacagggaagttcaaggttgtgaaagagatcgcggagacgcaacacggaaccattgtcgtgagagtccagtatgaaggcgacgggagcccctgcaagatccccttcgagattatggatctggaaaaacgccatgtgctgggacggctcatcacagttaatcctatcgtgaccgagaaggactctccggtcaacattgaagccgagcccccttttggcgattcctacgtgatcattggggttgagcccggccagctgaaacttaattggttcaagaagggaagctctatcggccagatgtttgaaacaaccatgagaggggctaaacgcatggccattctgggagacacggcctgggatttcggcagcctcgggggagtgtttacatccatcggcaaggctctgcaccaagtcttcggggccatttacggcgcggctttttctggagtgagctggaccatgaaaatcctgatcggcgtgattatcacctggattgggatgaactcccggagcacatctctttccgttagcctcgtcctggtgggagtggtcaccctgtatctcggcgtggttgtgcaggccgactctgggtgtgtcgtgtcctggaagaataaagagctgaagtgcggaagcggcatcttcattacagataacgttcacacgtggaccgaacagtacaagtttcagcctgagtccccctctaaacttgccagcgctatccaaaaggcccatcaggaagggatctgtggcattagatccgtgacacgcctggagaatctcatgtggaaacagatcaccccggagctgaaccacattctgtctgaaaatgaggtcaaacttacaatcatgaccggagacattaaaggcatcatgcatgctgggaagcggagcctcagacctcagcccacggaactgcgctattcctggaaaacctggggaaaggccaagatcctgagcacagagtctcacaaccaaaccttcctcattgatggccctgaaacagcggagtgccccaataccaaccgggcctggaactccctggaggtggaagactacgggtttggagttttcacaaccaacatctggcttaaactgagagagaagcaggatgctttttgtgaccctaaactcatgagcgccgctattaaggacaatcgcgccgtgcacgcggatatgggctattggatcgaatctgccctgaacgacacgtggaaaattgagaaggcttccttcatcgaggtcaagaactgccattggcccaaaagccacacactgtggtctaatggcgtgcttgaaagcgagatgatcattccgaagaacttcgccgggcctgtgtcccagcataattaccggcccggatatcacacccagaccgctggcccctggcatctcgggaaactggaactggattttgacttctgtgagggaacaaccgtcgttgtgacggaagattgcggcaacagagggcctagcctccggacaaccacagcctctggaaagctgatcaccgagtggtgctgtcgctcctgcacacttccgcccctgagatacaaaggcgaggacggctgttggtacgggatggaaattcggcctctcaaggagaaggaagagaatctggtgagctccctggtcaccgccggacacggccaaatcgataacttttctcttggggtgctcggaatggctctgttcctggaagagatgctcagaacgcgcgttggcatgaaacacgcgattctgcttgtggccgtcagctttgtgaccctgatcacagggaatatgtccttccgggacctcggaagagttatggtgatggtcggcgctaccatgacagatgacattggcatgggggtgacctatctggccctgcttgccgcttttaaggttcgccccacgttcgccgcgggactgctcctgagaaaactcacatctaaggagctgatgatgaccacaatcggcatcgtgcttctgagccagtccaccattcctgaaaccatcctcgagctgacagatgctctggcccttgggatgatggtcctgaaaattgtgcggaagatggaacgctaccagctcgccgtgacgatcatggctattctgtgcgtccccaactctgttatcctccaaaatgcctggaaggtgagctgtaccatcctggcggtggtctccgtgagccctcttctgctcacatcttcccagcagaaagctgactggattcccctggccctgaccatcaagggacttaacccgacagccatttttctgaccacgctcagcagaacatctaaaaagcggtcctggcctctgaatgaggctatcatggccgttggcatggtgagcattctcgcttcttccctgcttaaaaacgatatccccatgaccgggcctctggtcgccggaggcctgctcaccgtgtgctatgttctgacaggccgcagcgcggaccttgaactggagaaggccgctgacgtgagatgggaggatcaggccgaaatctccgggagctctcccattctcagcgtcatcgtgtccgaggacggatctatgagcattaaaaatgaagaggaggaacaaaccctgacaatcctcattcggacgggcctgcttgtcatctccgggctgttcccggtgtctattcctatcaccgctgccgcctggtacctgtgggaggttaagaagcagcgcgctggagtgctctgggatgtccccagccctccgcccgtgggcaaagcggaactggaggacggggcctatagaatcaagcagaaaggcattcttggctactcccagatcggcgctggggtttataaggaaggaacatttcataccatgtggcacgtgacacggggcgccgtcctgatgcataaagggaagcgcattgagccttcttgggccgatgtgaagaaagacctcatcagctacggaggcgggtggaagctggagggagaatggaaagagggcgaagaggtgcaagttctcgctctggaaccgggcaagaaccccagagccgtccagaccaaacctgggcttttcaagacgaatgcgggaaccattggcgctgtgtccctggattttagccccgggacatctggatcccctatcatcgacaagaaaggcaaggtggtcgggctgtacggaaacggcgtggttacccggaacggcagctatgtgtctgccattgcccagacagagaaatccatcgaggataatcccgaaattgaggacgatatcttcagaaagaaacgcctcaccattatggacctgcaccctggggctggaaagacaaagcggtaccttccggccatcgtcagagaagcgatcaaacgcggcctgcggacgctcattctggctcccaccagagtggttgccgccgagatggaagaggctctccgcgggctgcctatccggtatcagacacccgccattagagctgagcataccggacgcgaaatcgtggatcttatgtgtcacgccaccttcacaatgcggctgctgagccctattagagtccccaactacaatctcatcattatggacgaggcgcactttacggacccggcctccatcgctgcccggggctatatctctacccgcgtggaaatgggggaggctgccggcattttcatgacagccacccctcccggaagcagagatccctttcctcaatccaacgctcccatcatggacgaggaacgggagattcctgaacgcagctggaactctggccatgagtgggttacagatttcaaggggaaaaccgtgtggtttgtcccgtccatcaaggcgggaaacgacattgccgcttgcctgcgcaagaatggcaagaaggtgatccagcttagccggaaaacgttcgattctgaatacgtgaagacaagaaccaacgactgggattttgtcgttaccacagacatcagcgagatgggggccaatttcaaagccgagcgcgtgattgatccccggagatgtatgaagcctgtgatcctgaccgacggagaagaaagagtcattctcgctggccccatgcctgtgacacactcctctgccgcgcagcggagagggcgcatcggccggaaccccaaaaatgaaaacgatcaatatatttacatgggagagccgctggaaaatgacgaggactgcgctcattggaaggaggccaaaatgctgctcgataacatcaatacccctgaaggcatcattcccagcatgtttgagcctgaaagagagaaggttgacgccatcgatggggaataccgccttagaggagaggctcggaagacgttcgtggacctgatgcgcagaggcgatctgcccgtctggctcgcctataaagtggcggccgaggggattaactacgctgaccggcgctggtgttttgatggaatcagaaacaatcagattctggaagagaacgttgaagtggagatctggacaaaggagggcgaacggaagaaacttaaacctagatggctggacgcccgcatttattccgatcccctcgctctgaaagagttcaaggagttcgccgctgggcggaaatctctgaccctcaatcttatcacagagatgggcagactgccgacctttatgacgcagaaggcccgcgacgcgctggataacctcgccgtcctgcacaccgctgaagccggaggccgggcttacaatcacgcccttagcgagctgcctgagacactcgaaaccctgctgctccttacactgctggccaccgtgacagggggaatcttcctctttctgatgtccggcagagggattggaaaaatgacccttggcatgtgctgcatcattacggctagcatcctgctctggtatgcgcagattcaaccccattggatcgccgcttctatcattctggagttctttctgatcgtcctccttattcccgaacctgagaagcagcggacaccgcaggacaaccagctgacctacgtggttatcgccattctgaccgtggtggccgctacaatggccaatgaaatgggcttcctcgagaaaaccaagaaggatctggggcttggatccatcgcgacacaacagcccgagagcaacatcctggacattgacctccgccctgcctccgcttggacgctgtatgccgtcgctaccacatttatcacccccatgctgagacactctattgaaaatagctccgttaacgtgtctctcacagccatcgcgaatcaggccaccgtgcttatgggcctggggaaaggatggcctctgagcaagatggatattggcgtccccctcctggctatcgggtgttactcccaggtgaaccctattacgcttaccgccgctctgctcctgctggttgcccattacgctatcatcggaccgggcctccaagccaaagcgacacgggaggcccagaagcgcgctgccgctggcattatgaaaaatcccaccgtggacgggatcacagccattgatcttgaccctatcccctatgatcctaagttcgaaaagcagctgggacaggtcatgctgctcgtgctgtgcgtcacccaagtgcttgttatgagaacgacatgggccctgtgtgaggcgctcaccctggctacaggccccattagcaccctgtgggaagggaacccgggacggttttggaataccacaatcgccgtgtctatggctaacatcttccgcggctcctacctcgccggggccggacttctgtttagcattatgaaaaatacgaccaacacaagacggggcaccggcaacatcggggagacactgggagagaagtggaaatctcgcctcaatgctctgggcaagtccgagttccagatttataaaaagagcgggatccaggaggtcgacagaacccttgccaaagaaggaattaagcggggcgagacggatcaccatgcggtgtctagagggagcgccaagctgcgctggtttgttgagcggaacatggtgacacctgaaggaaaagtcgtggacctcggctgcggcagagggggatggtcctactattgtggcgggctgaagaatgtgcgcgaggttaaaggactgaccaagggcgggcccggacacgaagaacccatccctatgtctacctacggctggaacctcgtccggcttcaaagcggcgtggatgtgttcttcacaccccctgaaaaatgcgacaccctgctgtgtgatatcggggagtccagcccgaatcccacagtcgaggctggaagaacgctccgcgttctgaaccttgtggaaaattggctgaacaataacacccagttttgcattaaggtgctcaatccttatatgccctccgtcatcgagaagatggaagccctgcagcggaaatacggcggggctctggtgagaaaccctctctctcgcaatagcacacacgagatgtactgggtttccaacgcctctggaaatattgtgagctccgtcaacatgatctctcggatgcttattaacagattcaccatgaagcataaaaaggcgacatatgaacccgacgtggatctgggcagcgggacccgcaatatcggaatcgagtccgaggttccgaacctggacattatcggcaaacggattgaaaagatcaagcaggagcacgaaacgagctggcattacgaccaagatcacccttataaaacctgggcctaccacggctcttatgaggctaagcagacagggtccgccagctctatggtgaatggagtcgtgagactcctgaccaaaccctgggacgtgattcctatggtcacacagatggctatgaccgatacaaccccctttggccagcaacgcgttttcaaggaaaaagtggacacgagaacacaggagcctaaggaggggaccaagaaacttatgaagatcaccgccgaatggctgtggaaagagctcggaaagaaaaagacaccccggatgtgtacgcgcgaagagtttaccagaaaagtgcggtccaacgctgccctgggcgcgattttcacagatgagaataagtggaaaagcgccagagaagctgtcgaggactctcggttttgggaactggtggataaagagcgcaacctccatctggaagggaagtgcgagacctgtgtttacaatatgatgggaaaaagagagaagaaacttggcgagttcggcaaggccaaggggtcccgggctatctggtatatgtggctgggagcccgctttctcgagttcgaagccctgggctttcttaacgaggaccactggttcagcagagaaaattccctgagcggggtggagggagagggcctctacaaactggggtacatcctgcgggatgtctctaagaaagaaggcggagcgatgtatgctgacgatacagccggctgggacacccgcattacactcgaggacctgaagaacgaagagatggtgaccaatcatatggaaggggagcacaagaaacttgccgaggctatctttaaactgacgtaccagaacaaagttgtgagagtccagcggccgacccctcgcggaacagtgatggatattatcagcagacgggaccaacgcggctccgggcaggttggaacctatggcctcaatacattcaccaacatggaagcccagctgattagacaaatggagggggaaggcatcttcaagtctatccagcatcttacggctacagaggagattgccgtgcagaattggctgacccgggtcggacgcgaaagactcagccggatggcgatctccggcgatgactgcgtggtcaaacccctggatgacagatttgcctctgctctgacagccctcaacgatatggggaaggtgcgcaaagacattcagcaatgggagcccagccggggatggaacgattggacccaggttcctttctgctcccaccactttcatgaactgatcatgaaggacggcagagtgcttgtcgtgccgtgtcgcaatcaggatgagctgattgggcgggctagaatctctcagggagccggctggagcctccgcgaaacggcgtgcctggggaagtcctacgcccaaatgtggagccttatgtatttccaccggagagacctgcgcctcgctgccaacgctatctgttctgccgtgccctcccattgggttcctaccagccggacaacctggtctattcacgctaaacacgagtggatgacaaccgaggatatgctgacagtgtggaatagagtctggatccaggaaaacccctggatggaggacaagacccctgtggaatcctgggaggaaattccctacctgggcaaacgcgaggaccagtggtgcggaagcctcatcggcctgacgtcccgggccacatgggcgaagaatattcagaccgccatcaaccaagttagatctcttattgggaatgaggaatataccgattacatgcctagcatgaaacggtttagacgcgaggaagaggaagctggagtgctgtggtga

SEQ ID NO: 19539 - RNA, 9876 nt, synthetic construct
  misc_feature 1..9876: note = derived and/or modified CDS sequence (opt5) from DENV-2__KF744402__SS-prME
  source 1..9876: mol_type = other RNA
acagccggaatgatcattatgctgatccccacggtgatggctttccacctcacgaccagaaatggggaacctcatatgattgtcagccggcaggaaaaggggaaatccctgctttttaagacagaggacggcgttaatatgtgcaccctgatggccatggatctcggggaactgtgtgaggacacaatcacctacaaatgcccgcttctgcgccaaaacgaacccgaggatattgactgttggtgcaattctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcaccctgccacgctcagaaaatattgcatcgaagctaagctgacaaataccaccacagagtctcggtgtccgacccagggggagccctccctgaacgaagaacaagacaaacgctttgtctgcaagcatagcatggtggatagaggatggggcaatggctgtggactcttcggaaagggcgggattgtgacatgcgccatgtttacgtgcaaaaagaacatggaaggaaaaatcgtccagcctgagaatctggaatacaccattgttatcacaccccactctggcgaggagcatgcggtggggaacgacaccggaaagcacggcaaagaaattaaggtgacacctcagtccagcatcaccgaggccgaacttacgggctatgggaccgtcacaatggagtgttctccccggaccggactggatttcaatgaaatggtgctcctgcagatggagaacaaggcttggcttgttcaccgccaatggtttctggacctcccgctgccttggctgcccggcgccgatacacaggggtccaattggatccagaaggagaccctcgtgacgttcaagaaccctcatgctaaaaagcaggacgtcgtggttctgggaagccaagaaggcgccatgcacacagcccttaccggggctacagagattcagatgtcctctggcaacctgctctttaccggacatctgaaatgcagacttcggatggacaagctgcagctcaaaggcatgagctactccatgtgtaccgggaagttcaaggtggtcaaagaaatcgcggagacacaacacggaacgattgtggtcagagtgcagtatgagggcgatgggagcccctgcaagatccccttcgaaattatggacctggagaaacgccatgttctgggacggctcatcaccgtgaatcctatcgtcacagaaaaggattctccggtgaacattgaggccgaacccccttttggcgactcctacgttatcattggggtggagcccggccagctgaaacttaattggttcaagaagggaagctctatcggccagatgtttgagaccacaatgagaggggctaaacgcatggccattctgggagataccgcctgggacttcggcagcctcgggggagtctttacgtccatcggcaaggctctgcaccaagtgttcggggccatttacggcgcggctttttctggagtgagctggacaatgaaaatcctgatcggcgttattatcacctggattgggatgaactcccggagcacctctctttccgtcagcctcatcctggtgggagtggtcacactgtatctcggcgtggttgtgcaggccgattctgggtgtgtcgtgtcctggagaaataaggaactgaaatgcggaagcggcattttcatcaccgacaacgttcacacatggacggagcagtacaagtttcagcctgaatccccctctaaacttgccagcgctatccaaaaagcccatcaggaggggatttgtggcatccgctccgtgacccggctggaaaatctcatgtggaagcagattacaccggagctgaaccacatcctgtctgagaatgaagtcaaacttaccattatgacaggagatatcaagggcatcatgcatgctgggaaaagaagcctccgccctcagcccaccgagctgcggtattcctggaagacgtggggcagagccaaaattctgagcaccgaatctcacaaccaaacattcctcatcgacggacctgagaccgcggaatgccccaatacaaaccgcgcctggaatagcctggaggtggaggattacgggtttggagttttcaccacaaacatttggcttaagctgaaggaacggcaggacgtgttttgtgacagcaaactcatgtctgctgccatcaaggataatagagctgtccacgccgacatgggctattggattgagtccgcgctgaacgatacctggaaaatcgaaaaggccagcttcatcgaggtgaaatcttgccattggcctaagagccacacgctgtggtccaacggcgtgcttgagagcgaaatgattatccccaagaatttcgctgggccggtctctcagcataactaccggcctggatatcacacacagaccgccggcccctggcatctcgggaaactggagatggactttgatttctgtgaaggaaccacagttgtggtgaccgaggactgcggcaatcgcgggccctccctgagaacgacaaccgctagcggaaagctcattacagaatggtgctgtcggtcctgcaccctgcctccgcttagataccgcggcgaggatggctgttggtacgggatggagatccggcccctgaaagaaaaggaggaaaacctcgtcaattctctggtgacagccggacacggccaaattgacaactttagcctgggggttcttggaatggccctcttcctggaggaaatgctgagaacccgcgtgggcacgaaacacaccatcctcctggtcgctgtgtcctttgttacacttattaccgggaatatgtctttcagagatctgggacgggtgatggtcatggtgggcgcgacaatgaccgacaacatcggcatgggggttacgtatctcgccctgctggctgcctttaaggtgcgccctacattcgccgctggacttctgctcagaaagctgaccagcaaagagctcatgatgacaaccatcggcattgtcctgctttcccagtctaccatccccgagacaattctggaactcacggatgccctggcgctggggatgatggtgcttaagatcgtgcggaatatggagaaataccagctggctgtcaccattatggccatcctctgcgttcctaacgccgtgatcctgcaaaatgcttggaaggtgagctgtacaattctcgccgtcgtgtccgttagccccctgcttctgacctcttcccagcagaaagcggactggatccctctcgctctgacaattaagggactgaaccccaccgccatctttcttacgacactgagccgcacctctaagaaaagatcctggccgctcaatgaagccattatggctgtgggcatggtcagcatcctggcctcttccctcctgaagaacgatatccctattaccgggccccttgtggctggaggcctgctgacagtttgctatgtgctcaccggccggagcgccgacctggagcttgaacgcgcggccgacgtcagatgggaggagcaggctgaaatctccgggagctctcctattctgagcatcattatctccgaggatggatctatgagcattaaaaatgaagaggaggaacaaacactcacgatcctgatccggaccggcctcctggtgatttccgggcttttccccgtctctatcccgattacagccgctgcctggtacctgtgggaggtgaagaaacagcgcgccggagttctgtgggacgtgccttctccccctcccgtcggcaaggctgaactcgaggatggggcgtatagaatcaaacagaagggcattctgggctactcccagatcggcgccggggtgtataaggaaggaacctttcatacaatgtggcacgttacccggggcgctgtgcttatgcataaagggaagagaatcgagccctcctgggccgacgtcaaaaaggatctgattagctacggaggcgggtggaaactcgagggagaatggaaggagggcgaagaggtgcaagtgctggccctcgaacctggcaagaacccgcgcgctgttcagacgaaacccgggctgttcaagaccaacgccggaacaatcggcgcggtctcccttgactttagccctgggacctctggatcccccattatcgataaaaagggcaaagtggtggggctgtacggaaatggcgtcgtgacacggaacggcagctatgtttctgctattgcccagaccgggaagtccatcgaggacaatcctgagatcgaagatgacattttcagaaagaaacgcctgacaatcatggatctccaccccggagccggcaagacgaaacggtacctgcctgctattgtgagagaggccatcaagcgcgggcttcggaccctgattctcgcgccgacaagagtcgtggctgccgaaatggaggaagccctgcgcggactccccatccggtatcagacccctgctattagagccgagcataccggccgggagatcgttgacctgatgtgtcacgctacattcacgatgcgccttctgagccccatcagagtgcctaactacaatctgattatcatggatgaagcccactttaccgaccccgcgtccattgccgctcgggggtatatctctacacgcgtcgagatgggcgaagccgctggaattttcatgaccgccacaccgcctggcagcagagacccctttccccaatccaacgcccctatcatggatgaggagcgggaaatccccgagagaagctggaactctgggcatgaatgggtgaccgacttcaaaggaaagacggtttggtttgtgccttccattaaggctggcaacgatatcgcggcctgcctccgcaaaaatgggaagaaagtcattcagctgagccggaagacattcgactctgagtacgtgaaaaccagaaccaacgattgggactttgtggtcacaaccgatatcagcgaaatgggagctaatttcaaggccgagcgcgttattgacccgcggagatgtatgaagcccgtgatccttacagatggcgaggaacgcgtgatcctggccgggcctatgcccgtcacccactcctctgctgcccagcggagaggccgcattggaagaaaccctaaaaatgagaacgaccaatatatctacatgggcgaacccctcgagaatgatgaagaccatgcgcactggaaggaggctaaaatgctgctggacaacattaacacgccggaggggatcattcctagcatgtttgaacccgagcgggaaaaggtggatgccatcgacggagagtaccgcctcagaggcgaagcccggaaaacattcgttgatcttatgcgcagaggggacctgcctgtgtggctggcttataaggtcgccgcggagggaattaattacgccgatcggagatggtgctttgacggcatccgcaacaatcagatcctcgaggaaaacgtggaggttgaaatttggaccaaagagggggagcggaagaagctgaaacccagatggcttgatgctcgcatctattccgaccctctggccctcaaggagttcaaagagttcgctgccggccggaagtctctgacactgaatctcattaccgaaatgggaagacttcccacgtttatgacccagaaagctcgggatgccctggacaacctggcggtgctccacacagccgaggctggcgggcgcgcctacaatcatgctctgagcgaacttccggagaccctggagacactcctgctgctcacccttctggccacagtcaccggaggcatcttcctgtttctcatgtccgggaagggaattggcaagatgacgctgggcatgtgttgcatcatcacagccagcgtgcttctgtggtatgctcagattcaacctcactggatcgcggcctctattatcctcgagttctttctgattgtcctgctcatccccgagcccgaaaaacagagaacccctcaggataaccagcttacctacgtggttatcgctattctgacagtggtggccgccaccatggctaatgagatggggttcctggaaaagacaaagaaagactttggactcggctccatcgccacgcaacagccggagagcaacattctggatatcgaccttcggcccgcgtccgcctggaccctgtatgctgtcgccacaaccttcattacacctatgctccgccattctatcgagaatagctccgttaacgtgtctctgaccgctattgccaatcaggcgacggtgctgatggggctcggaaaaggctggccccttagcaagatggacatcggggtccctctgctggccatcggatgctactcccaggtgaaccccattaccctcacagctgccctgcttctgctcgttgctcactacgccatcattggccctggcctgcaagctaaggccaccagagaagcgcagaaacgggccgctgccgggatcatgaagaatccgacagtggatggaattaccgtcatcgacctggatcccatcccttatgaccccaaatttgagaagcagctcggccaggtgatgcttctggtcctgtgtgtgacgcaagttctcatgatgcgcacaacctgggctctgtgcgaagcccttacactggccaccgggcctattagcaccctctgggagggaaaccccggcagattctggaatacaacgatcgcggtgtctatggctaacatttttcgggggtcctacctggccggagctggcctcctgttcagcatcatgaaaaacaccacaaatacccgcagaggcacagggaacattggagaaacccttggcgagaagtggaagtctcggctgaatgccctggggaaatccgagtttcagatctataagaaaagcggaatccaggaagtcgatagaacgctcgccaaggagggcattaaacgcggggaaacagaccatcacgctgtgtctcggggaagcgccaagctgagatggttcgttgagcgcaacatggtgaccccggagggcaaagtcgtggatcttggctgtgggcggggaggctggtcctactattgcgggggactgaagaatgtgagagaagttaagggcctcaccaaagggggacctggccacgaggaacccatccccatgtctacatacggctggaacctggtccgcctgcaaagcggggtggacgtgttctttacccctcccgagaagtgtgatacactcctttgcgacattggagaatccagccctaatccgacggtcgaggcgggccggaccctgagagttctgaacctcgtggagaattggctgaacaataacacacagttctgtatcaaagtgcttaatccctatatgccttccgtcattgaaaagatggaggccctgcagcgcaaatacgggggagctctcgtgcggaaccccctgtctagaaatagcacccatgaaatgtactgggtttccaacgcctctggcaacatcgtgagctccgtcaatatgatctctcgcatgctgattaaccggtttacaatgagacacaagaaggctacctatgagcctgatgtggacctcgggagcggaacgcgcaatatcggcattgaatccgaggttcccaaccttgatatcattggcaaaagaatcgagaagattaaacaggaacatgagaccagctggcactacgaccaagaccacccgtataagacatgggcctaccatgggtcttatgaaaccaaacagacaggatccgcgagctctatggtgaatggcgtcgtgcggctgctgaccaagccttgggatgtgatccccatggtcacacagatggccatgaccgacacgacacctttcgggcagcaacgcgtttttaaggagaaagtggataccagaacccaggaacccaaggagggaaccaaaaagctcatgaaaatcacggctgagtggctgtggaaggaacttggcaagaaaaagacccctcggatgtgcacaagagaggagttcacccggaaagtgcgctccaacgccgctctgggggccatttttacagacgagaataagtggaaaagcgctagagaggccgtcgaagattctcggttctgggagctcgtggacaaggaacgcaacctgcacctggagggaaaatgtgaaacctgcgtttacaatatgatgggcaagagagagaagaaactcggcgagtttgggaaggcgaaaggatcccgggccatctggtatatgtggctgggcgctcgcttccttgaatttgaggccctggggttcctcaacgaagatcattggtttagcagagaaaattccctgagcggagtggaaggcgaggggcttcacaagctgggctacattctccgggacgtctctaaaaaggagggaggcgctatgtacgccgatgacacagccgggtgggatacccgcatcacgctggaagacctgaagaacgaggaaatggtgaccaatcatatggagggagaacacaaaaagctcgcggaggctattttcaaactgacatatcagaacaaggttgtgagagtccagcggcccaccccgcgcggcacagtgatggacatcatcagcagacgggatcaacgcgggtccggacaggttggcacctacgggcttaatacgttcacaaacatggaggcccagctgattagacaaatggaaggcgagggagtgtttaaatctatccagcacctcaccgccacagaagagattgctgtccagaactggctggcccgggtgggcagagagcgccttagccggatggctatctccggggacgattgtgtcgtgaagcctctggacgatagattcgcctctgcgctcaccgccctgaatgacatgggaaaggttcgcaaagatattcagcaatgggaacccagccggggctggaacgactggacacaggtgcccttttgctcccatcacttccatgagctgatcatgaaggatgggagagtcctcgtggtgccttgccgcaatcaggacgaactgatcggacgggctagaatttctcagggcgccgggtggagccttcgcgagaccgcttgtctgggcaaatcctatgcccaaatgtggagcctcatgtactttcaccggagagatctgcgccttgcggccaacgctatctgctctgccgttccgtcccactgggtgcccacaagccggaccacatggtctattcatgctaagcacgaatggatgaccacagaggacatgctgaccgtctggaatagagtgtggatccaggagaacccttggatggaagataaaacgcccgttgagtcctgggaagagattccttatctcggaaagcgggaagaccagtggtgtggcagcctgatcgggctgacatccagagccacctgggctaagaatattcagaccgccatcaaccaagtgcgctctctcatcggaaatgaggagtacacagactatatgcccagcatgaaacggttcagacgcgaagaggaagaggcgggcgtcctgtggtga
